United States Patent 10,662,479 (IMMUNOGLOBULIN EXPRESSION LEVELS AS BIOMARKER FOR PROTEASOME INHIBITOR RESPONSE) - sequence listing, part 8

SEQ ID NO: 607 - DNA, 508108 bp, Homo sapiens
gcgagccagcggctccggctcccgctcccgctccgcgcagcaccagcccgactctccccggcccccgccgcgccccctcgccgcgacctcggccaccggcccgcgccccgcgcccggggtcgccccgagcccgcacctctcccccgccgcccccgcccacccggccctccgcggccgcagctccccggcggaggcaagaggtggttgggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctggtaggtgccgggccgggcactcctgccccgctcctccccgcctccgggtcccggcacccggcgctccggcgcgtccgccccggggctggctcactccgataacttggaaccggcgggagtccgaactcttcgcccggagtgacacgcgcgcccggccctgacaccggcgggcaggactcccgggacgtcgccgtcccgccacacacaccccctggcgcgagagggaggctggccccgtacggtggcgaaggggatccctctccgggccgggcccctcacctccccgggcgcgcccacccgcacgcacccagcggagcggccgcttgccggggtgtgagcccaggggacaggggaggaggagaggccctaagggggcaaaggttcccggagaaacgcgccccggagtaacgggggagcggcggcgattgcactgcgcgcggtccaagttgctggcgagccaggctgggcgcgttcggggtgggggggttgtgtttgtgcttcccatcgggctggactgcgctggcatcttgggcccctgcctactgtaggctgcatctactgggcacggagagactgacttttctgagtgagcagagagagagagagcaaactgttgaaagcttgcagtgggggagggggagttctagcaggcaaatggcacaagggcagagggactcatttaaaatagaccctgtcggccaggcgcggtggctcacgcctgtaatcccagcactttgggaggccgaggcaggcggatcacctaaggtcagtagttcgagaccagcctggcaaacatggtgaaaccccgtctactaaaaatacaaaattagccgggcgtggtggcacacgcctgtaatcccagctactcgggaggctgagacgggagactcgcttgaacccgggaggcggaggctgcagtgagccgagatcgggccactgcactccagcctgggtgagacagagcgagattccgtctcaaaaaaaatgaaacagaccctgtcaactcgagattagacctgtaaccctgttgatgagggcagaggccttatttaagaaaaataatataagggccagaggtcagagatcaggtaatcgccaatgaattcaggcattcttaactcggagggtccctgggggcttatggagaatcgatacatagaagggcttcaggggtctctgaaccctgtaaaactgagggaaattgtgtttgtgaatctttttcctggtgagagaattacagctttcatctgatcctcaaaaggtgtgtgacccttcttcccagatccccgtcaccacacaaaagttttgaaagctggaactaaaggagctctaggtcctctagttagagcagcagtagtttggtttttcttttaagttgcccgacgtcctgactcttctacctcttctttgtggtgtaggaagttccgggcaagacagagctatggctagggcttcttagctccctctccttctaggccagggggagctgcacagggtggcagtcacggagtgaatcctgccaccagccagctgtgtggcacaggtatcttgggccactagggtgagcatagtatggatggctctgtcggaatccatcacacctggggaaaaacatcccaaagggcaggtcccatgatcgtggtgcgaataaggtgtttaatttttcctttcctttttagacatctgctcccaagtacacttttatgaaaagcacagccacctctatgagtgatttccactgtctagtcggcatatgaagcgactgtgctcaaaggagtaggtagtcgtagataaggctatttaaaataaaaatttcggagcatcagggcaaagagaatattgcatttggttaagaggaggtcagctgtgagagtccattaaaagggaacagactgctggtgacttttgcaggaagtaggagagttagaaagggacttgcagcatactgaggctagctattgtctttccactatcagttgcccttgaaggatcagcccctggtgagctgaagaggcgctcaggtcaccaccagtattgtgaagtggaaaatgcccccctgaggatccctgcagcactctgcatttaattgtaaaccaaccaattggaagtcccaggaaaccatccacggggattgtctttttcagtttgctttcattattgcttctacggggtccttgatttacacgtttatttcaatattaaatcactgatatttttaagcgaaatgtttagagttagatatggtttttagtaggggggatgactctaagttaattttaaaagtatgtgaaatactttgtacatgaaacattctatgtgaagcaagagattatgactctcaaccttccgaagaaattttaatgcagttcattctggtagaacaatacctgcaattgaacgtccacgtcagggttctctgcttacagagtaaattctctaaagtcatgtacaagaacaaaatagcctccctatgtgctttgaatgctattggttctcagtagaaattagatcgtggtcatctcaaatgcaaacaataggaattatattttctaagatctggtttcttaagccaacattaaatgttaaaagtgatgccgtttggcagtttctagacatgtgatattttaaacaaaaagaagccactttgttatctttagggagataaaaacaattttcatttggtcttcaggaacaaaataagcaacttccttttacaattttaaccataaactgttttgttacttgaatattgtgttgtagccaacaagtttgaatatacagtcatgttcttgtcttgaaattttagtattgataacatagtataaaaaattggaaaaaaggttgatacatcgaaatagttcagtgatcctttataggcaagatttttttccccccaaggttgaatttacacagtaatctgactagatatttaggtatgtttttttctattaaatcattgggtttcacatacaaacctttagtggtagagtacttggtcacataacttgtttaaaatatgctatccaacagaaaatatgttaagatattttgttcttgtttttgtttttcagggggtttgggaaacaaggcttccagtgccaaggtaagctaccacttttggttttattttcaagcacaacatgaaataagcattccaaacaagaacattatttccagtcatattttctttccaataaaaaaatgttatttagataattttgaaatatgagggctgtaaatttgggccttaaaaaataattggggcctactaatctgcatatagagctgcctttttctcattggaaaaaaaaaaaaaaagcctttctgtaattttattttttgccgagaacattcttgtcagaaactgctgtctttgtgtgggtgttgagaaaaaaatggaatcactttgtattcaagtggcttttcttccttgttcttcctctttgtttttattcttcatcgcttttacttatgtattgagttggactcactgcaactaattttaggccgtatttcattctagtaagggtttgttttgtttagaataccagttgtcatcgagaacaaagtttgcatgttttaaagttttgttgatgatttgatgactgatttctatggtatgactatgtagcatgctttcctttcagcttacatatctgacaaaacgtgatatcagccatcacatacagaaagaaatccatttgcttcaccctctgatctgtaattgcatttcacacacatcgaatatctaactttttgtactctccattctaattgtttgacttttcctttttgaagaaacccactttagagcttgtgaaggcatcacaggctcattagctaacttttctggctctcctgctcattgtctatattgtgtttatttagttctggttccatttcccatctgggcatagatttattattagggcaagcagaaagtacattctagcctggaaaatattatcctaacactgtttaatattaagtgcattagagagaaaggcactgtgtacttttttacaactttgagattgtgctagtaaattggttgccttttaaaaactagttcaaatttgtgaacttgtttcttgtatacattttctaaacatattttagatgggagtattttatggtatgattattcatttaatattctaccttcctttctccaagatgtgcttaaaacccctactgagtgtatcattttcagagttgcatttgaaaatcaagggatattccttttaaaaagagaagaaagagaaagatgtgttataccagtctctacaaaagatgaaaggaaaatgtagctctttctagttctcaaagttgtgggcctgaactttatgggtgagatttgagcctaggcttgaacatgactttagggagtttaaagatgtaaggttctgggccaatgtgattgacatctgttatttttggtgatatttttcgtttgggtggggacttacataaatctataagaaaatttttgtactgaatcttctccatactgcttgtctgggagaaagtggttgtcttgttctaaaacttttatcattttctgcataaataaaaaataaggttgattagaataaggttggttcctcttagacccgctcatctgagcagattttgtggaaatcacagtggccgtattactaggctctagggggttttgcatgatttcccccagagcatctcttgaacttttagtggattagcagattaatagtttcatggcaacataactcccttttacctaaattaaaaaagtgaaacccataaaaattttaaactgtataaaataaaaagtgaaattgcatatgcttctcttttccctcctccagagataacttctgtttgagacaaccattcgttcactcactcacacatacttagtttttaaaaggagatcaaaattttatacgactttgcaacttgctcttttcactcagcagtagatggtggatattcttccacatcaaagcatcagttctgccttactctgcttagtggctgcatgtgtggatgtatccaatttattcacccattcctctatcaaggggtattttgtaattcgttcttactagtacaaatacctttgtcaagagcattattggacactagtataggtatttctacaatagatagccagaagtgtgtatgtgtgcatcttacattttaacgggtgctgctaaattgctcttcaagagttccagtgcacatttttttgtattaatgggacttcctcttcatttttaccagtgaagatatcgggtaatatacatcttttacattttttaccaatctggtaggtgaaaaggggcccctcttttagatttccatctcctgcattatgggtgagcttgaactttttttttcaaatgtgttttagccatttgtgttgtgtgaattgccttactctacctaatatttgaaactctggatttacaaaccagacaaattagagaagtgactatgtgctttctatatagttctttgctttggtgaagaatttaacctcagatctctttaaataatgaattaccctagtgcgtttacaaattacagttcacagagaccttttccaatagtatacatttatttgtaacatgctgtctgcttgttatattttgtttactgtgtctcatctgtatttgacttctagtaggcatatgctagtccattgtattttattgtttgttgtaacttaagaaggatatgttacctcagggtgatgcttttaatcccacaaatatagttacccagcattttctgttttggctcctaccgcaaaattaatctttctattaacatctgactatcgtagagtgaagttttcttttaatgctctctaattttgttttttttttcctcggttttgtttgatagaacatcattcttctgcaggagaataactcattctcattcatacctttggcaacacactctctggaaatgacagctggagtttgaaactgctttttgtattcctcatacatcagattatttttacccgatgaggcagtgctttctgtccactagtatgtagtatgttgctttggttagtaggtaaaatatctgcagcaagcatagtttttctttttttaactagaggggtgtgtatgctcccagtgactcacatattcatgcagtaagtaatatagctttagatccaaaatatttatcttcattttacttagtaaatggtgagtaggtatttgaagactaaagaaataagtgagttttagtccttaaaactgggtttgtaatttatgccatttagagaatggcatcttacaagcatgtgaagtactaaagttatttctactttcatttatgttgtatcttggggaagggaagggcgtttctctggagagacttattggcttattctcatgttcccttcatggactctgtgccattcttctttatattgcaatataggtatacaatcctgaaaactgatattaccagggcaagtaacacaggatcccgttgtcagaatttgctgcctgaaacggtgaaaccaagggccattcttctggggaggagaaagatgagtgtgtagtagatttccaagtgggaaatacttttcttaaggtcctcagagataaagacaagcgtgttccttcacagctctgaagtgaccctttttacatgacttggagttgccttcttatttttggttgaatgtttttttgcttgatgtacccctagcactcatttcatctccataaaactagcagagatctagtccttgcccactttttttttcccccgtcagagaaaggagaagaagacaggaagtagatttgtgtggtatggacattgatgaagttgagtttcaagtctggaaggtctgtttccagttggtagtttctgtcttgcactggctacttccaaagtcagtcatcagagaacagagcgatccactgtactgctcaaatgcactctttctctggggcagtggagctgaaacagtgttatccactgctttcagtactggaaaagggaaagagccaactcgatttttttccccctccttaggcggagcaacacccatgcacttctctaattacagtggtagaaacagcctctcaaaatgtgacctgcctatttcaaatgccaaacagttaacatagtttgtttcatctgcctaacctccacttgttttctctaatttttttttttttttgctattctttgtcttttaatatcacaaatgaaaatgtgctacaaacctaggctctttgatgaggtgaagatactcaagagacagcgtgagaattaagctctgtcagtaaccatgaccaacaggagcctgttgtccctgaatgatcgtcactggattttgaggggtctgctgggaaagaatttacatttttgtgctttcaatgatgctactaaagttgttttgaatcttgagtcatttccctgctaagaacataacacatattgtacttcatctgtgacttcaactgaagctctgcatttttcagtgttaagggttaaaaaatcagctactcttcccctttgatattttgttttgaaggcctgtttcagagaaggtatttgcattggctcatctgagcagggtggtgatttctattccttctgtaagaatgaaagttggtgtttaagggaagaaaaaaaagaatgagtctcctcttggctgtgtgagctgagggattccagaaaacaagactacttaaggaaggtggcctttaaacagaaagggggcagtagcgagtgagtcaccagcctttcagaaaagggatgcgccgttgtcctcatccgccacggtgttctgagagctgagttgtatggacaccaagtaccaggagataggagactgaggtacaagttgggtggaatcatgaggtaggccagattgagcagaggatctgtctgtcctccctatggccaacttgagcagaggatctgtcctccctatgtactgcattgaccgctgcttgcactgtgtggcctctggctgcccgctggttttcaaagttagtgccagggttttccattattctgtcttcaggaggggttcagcccttggtacctcagttttgattggttacccatccccaaattgtaagttatgttaattagagataaactcttggaggtttagttccaaaaagatagaatgcatggaagactgagtataatttgaaacctagagtttttgtagtaatgccaggtcaaagcattatctcagtctcaaagatgaaatggtcagtaatgcctgaattacagagaaaagtggtggaggtggacagttagaactgcctttctgtggttgggtgcagtggctcatgcctgtcatcccagcactttggaaggttgaggcggtcgaattgcttgagcccagaactttaagaccagcccgggcaacatggcaaaaccccatcgctacaaaaaatagaaaaagtagctgggcatggtggtgcagcacccgtggtctcagctacttgggaagctgaggtgggaggatcacttgagcctgggaggtcgaggatgcaatgaggtgtgatcgtgccactgcattccagcctgggcgacagagtgagagcctgtctcaaaaaacaaaaccaaacaataacaaaaaatgctatttttcttttcaacagtgtttttcctccgtaaaactgcattaatacttagaagtagggatggttagataaaactagtgttgagtgttcccatttggtgctatatacttgttataaaatgatttctgattaatgactttctgaattgctactcttttactttatacggtaagtgaaagtgtttcgttaatttattcacacatcaatcctacccccgccaccagaagctggggttgtagcatatggagaggctatttatcctcataggtcgtgaaagccgaataaatgtttacttttgcagataaatctgatgtttgagtttccttttctttatattattttatttttttgagatggagtctcgctcttgtctcccaggctgcggtgcaatggtgcaactttggctcactgcaacctctgcctcctgggttcaagcaattcttctgcctcagcctcctgaatagctgggattacagatgcatgccaccatgcccagctaatttttgtatttttagtagagacggagtttcaccatattggccaggctggtcttgaactccagaccttaggtgatcctcctgtttcagcctcccaaagtgctgggattacaggcgtgggccactgcacccaaccagagtttccttttctttacattttttggtggtttcctgccctccgagtatttcactctcctggatgatactattgaaatttaagtttttagacacattaactcctcacttgctcaattgtttttcttcatgcagattcagagtattccatttccaaatagcattagtttcacagctgccctatcaggataagtccaactccttagcaagacattggaagactcttaaagtctcctgcctgacctcttcagacttacctacaatgctttccttcttcctatccctgggtcattgtgaataagttgcagtttcccagaaagtgcttgtttcaattctttcctcaaccccgtttgcccagatgatatctgtttcacctgttaagtcttagtctaaggtttagctctggtctttcccaattgtcctattctacatgttcttcctatcgtaggaccttttttttttttttttttttgtgagacagagtgtcactctgtcacccaggctggagtgtgcagtggcacagtctcacttcactgcaacctttgcctcctgggctcaagaaattctcatgccttagcctcctgagtagccgggattacaggcacataccatgacacccagctgatttttgtatttttagtagagacggggtgtcgccatgttggtcaggctagtctcgaactcctgacctcaagtgatctgcctgcctcggcatcccaaagtgctgggattacaggcgtgagctcccgcgccccacccttcctatcataggaccttcacactgtatcacctctctacttctgtttcctctgccagttttgagtgcgaggactgagtcttatttctttttgtgtctccagtgtgtaatgtggtgcctgacactcagtagatactatgtaaatatttgttgggtgtgtgattatataaatattaagagatgtgatacaagcattcataaccagaaagatcacagtgacttctgcctggctgccttttctatatttttttaaagcaagtttataatccaaagttgtgccaactaagatcttaggatcattaaagaaaaagtacttttaaagctaagcatacttattcaaaagagggagcagaaaattctacctttatgtatataataagttaacatatgtaatggctaaacctaacacattaacactgcagaaataaaccacttaatgtgtcttctttctatctttagaatattatccaagcatcaagaataaatcttattgcacaaataaaacaagagtgtatcatgggctatagcaggagggggaaaatgtcttgggtatagggtgagaaagtaaaaccagcttttagtacttgtttggtacagttatttaaatgctctattttactttgagattggtaataactggagctcaatcatcatgctccagagggagtagtagctcaacttcactgattctgttatttttaaaatttttgtacctgaaaggtttttgtgcgttaatacattttttgtgccttaatacaaataataaaggtttttgtgctttaatatgcaagtaaatgtacatgaatggcagcggcagctttggagtgaaacagctgtgattatgtttatcatcacagattataacggtgattagaatcactttcaagattttattcaattgaaaggaaagaaaatggatatgtattcaatgctacattatgtcagacatctagctttcatattttatatgctttcattccaaaagcaccccataacaggatgttatccccatcttagaaatagagctaaagtacttaaccaggctggtggggcgtgtcatgggttcagattctaacggttctgcagaaaacattcttcagagccaagtggaaacttttggtatgaatgaagcccggatttatattaggagaggaaagaatgatgccattatgaaacatttcttggtgacataaaattaaggtttcactgtcctcatcagtctgtcaaaatttccacggcagaccctttatttcaggtcttgttttccacccaaactgtgaaatctcatgctaaacttaaggcatggccacttcagtgttggctgtgtctagtagaaattgctataactgcattaaaaaaactctttattaaattatacaaaagggaaaatggtttctggaaatagatttctatcaaggatggaatggaagggaatgatttgattaatggccagcacgagataagaattatttgagagcaagtccatcaagtaagattagcgtaagggcagttcatctttaatgccttctcttgctgttccccctccagtatccatgagcaatagtagatccatctgtcccgtccacggtgactgcagtaggtagttaggaaataaaccataaggatgtaaatatgagacatgagtttagctctgacttggacaagcttcctcaagtttgaggggatgggtcaatgagggtccagttaacagttgaattgagagtaaaattctactgtagagattaactcatggttttaccgtcaggaaaactggtagttttgagttaatctctacgatagaatttctttctctctctctctctctagatatatatatatgtgtgtgtgtgtgtgtgtgtgtgtgtatgtatgtatgtgtatatgtgtgtatatatatgtgtgtgtgtatgtgtatgtatatatgtgtgtatatatgtgtgtatgtatgtgtatatatatgtgtatatatgtgtgtatatatatgtgtgtgtgtatatatatatacacctagcttgtgtgatacacacaagttcgtgtgtggttgtgcacaaagtttatgacgtaggggttttcttatacttgaaacactacaactgatagccagcacccatatagcacttactgtatacactgttctaagcactcacttttaactcacttgatcctcacacaattctgaagagataggcagtgttgtgattcccgttttacagatgaggaaacaggcactgaggcacagggaggtttagtaacttgtccacagccacatagttagaaaatggtggggctgggattcagacctgggcagtatgagtccagatgccatgctgttaagccaggtgttctgctgcctctcacaattctccttttcttgaagttttgtcacacttaaatcacaccattaacttgaatgtcgaggtattaaagaatgaagtgttttttctttttttttttttttctgagacggagtcttgctgtgttgcccaggctggagtgcagtagtgtgatctcaactcactgcaacctccgtctcctgggttcaagcaattctcctgtctcagcctcccgagtagctgggattacaggcatgtgccatgatgcccggctaatttttgtattcttagtagagatggggtttcactgtgttggccaggccggtgttgaactcctgacctcaggtgatccgcctgcctcggcctcccaaagtgctgggattacaggcatgagccaccacgtccagccggaagtgttttttcaattcagtagcacttaatgtgcttcctgcctgtagtgggagcttatggcctgatacatggacctctgtttagtctatgtcatgccagaccctgcagggcgcaggacagaagacatatatgaaaacaacacattgtaacaatacatctatcacgtacattatattacatcttagtctgaatgaaataacagtttttgaagcatgtgggaaggaaggagatattttttgagctcatcaggagatggctcttgttttgggctttgtaggttgctagaatttcctttgattaggaaaatggaggaagctcttctaaggtaagggaatggcatgcgtgagagagggatgagagtgactcacgttccaggagtagtagactgagagagcccatcttatttgggatgttgcccccactgacctccaaatggaagaacagataggaaaaatatgtagggagctacttcatgctttgccacatactgattctttattaaatacatggtttcctcttgtaactttttgttttcatgtcatcattttcagaacaaagttacaaatacagagattactgtatctacatgtagaagatacattgtactgaagcttggaaaataacttcttgtgtttaaaataagcttgttcaaccggtgggccgcatgcagcccaggatggcttagaatgtggcccaacacaaacttgaaaactttcttaaaaaattatgaatttttaaatttttatttatttatttgttttaaaagtttatcagctatcattagtgttagtgtattttacatgtggcccaagacagttcttccagtgtggcccagggaagccaaaagattggacacccctggtttaaaaagtgtgctactttgacacttctttctgctgatctctctactataaggaagctggcaatagtgattattgattatatatagcatcatgttgggagtccagggtcttaccgcatggaaattatgactggagatgagatactcagttatactagatacatgtattaataagggaaaaataaagaactaaaatatttacatattaaaaatcagcagccgggcgtggtggctcacgcctgtaatcccagcactttgggaggccaaggcaggcagatcatgaggtcaggagatcgagaccatcctggctaacacggtgaaaccccgtctctactaaaaatacaaaaaattagctgggcgcggtggcgggcgcctgtagtcccagctactcgggaggctgaggcaggagaatggcgtgaacccggaaagcggagcttgtagtgagcggagatcacgccactgcactccagcctgggtgacagagtgagactctgtctcaaaaaaaaaaaaaaaaatcagtaacactttctattttagaaactgtcaactgatgtattcagtcagaatttctggttcatgatccgtagtttattccttctctctccatgggctaacctcgggctgatgtgttttcaccgtggtcagaaaccttggtaaggaaaggaaaggggtgctgcagtgtactggtatcctagtttggagtattagttttcatctgggattgagatttgagaaatacaagtttacatgatactgctaccatgctactgtgaacttacagtgtactaccaccccatgggtggaaaggatgctggaacagaagctaagtaggctgcccttgtgtgtgactggtgaattgggaagctgtaatttgaaattggggagatttagtgaatgtcttatgtttccattgcagtcgtttttttagttgctgaagctgtacagataagtagccaatccctttttctcaacttatctcttcatttttttccttctcttaggtttctaataaggaatgatttgtggtgctgtttgtgataattggaataaaactctcactggtttagaaagcttggctcacagttgtaaagacttccattagcttccattcagatttatgttgaagttaaatggctgtacactagcttaaatcattttcctccttttgttgaattcatgcatgcaactatacatcctaagtgaatgaactgtcctaaaatgtgaaaatgggagattactcattttttaaaaatgtaaaatattttaacttgattcttaagtatttacaatgtagaaaatagcttaaaacatgactgttaagttctaaatatgaagatgtttttcttaatgctgttatagttgggagaagttgtacatggatgacttaaaatttaataggtgggcttcaaaataagatgatcatattatgagtaatttgcctaacaatacttctgaagttttctttttagtgaacttaattttatcatgtgccaaatttgtttaatactgaagtgacttttgttgctttagtttcacattagtttcttcaatctgaatggcacattaatatggaaaacttctctagaattctgttttaattaaaaaatgaggctttgtttctgtatatcacatagatgtgactttaaaatggaaatgatcgttaattacaaacagtttagaaacatggaggaatgatttttttttaatttttaggtgctaattcaagtttagggataatggctgataggcaccattatccttttttttttcttttttacttattttgtacaactaggcaccatagcacatgctggtattgagctggattgatgtctgtgtgatgcaaattaactttcaagtcatattttataaagctgagttgtcgggctggagcgggaatagttggtatgcttaagacttgtcatggtgggttgggcgtggtggctcacgcctataatcccagcactttgggaggccgaggtgggcagattgcttgaggtcggtagtttgagactagcctggccaatgcagtgaaaccttgtctccactaaaaatacaaaaattagccaggcgtggtggcgggtgcctgtaatcccagttacttgggaggctgaggcaggagaattgcttgaacccgggaggcagaggttgcagtgagccaagatcacgccactgtactccagcctgggtaacagagcaagactcggtctcaaaaaaaaaaagacttgccgtggtggctggcctaagtaggcagattgcttgaattcatgaattttagaccagcctgggtaacacggcaaaaacctgtctctacaaaaaaatattttttgtaataaaattacaaaattaggctaatttttattagcctatagtcccagctactttggaagtgggaagattgcttgagcccggtggttgaggctgcagtgagccgagattgtgcagctgcactttagcctaagtgacagagtgagaccctgtcccctccacccccacccaaaaaaaggcttgcaatggtggtctgccatggtggtctgccatgaatctaatgaaatgttgtggaaggataatttagaggctctgggcttttttgtttaattttctgagtaatatgacaattgaagtatattgctaatgcttttctagatgttatatgttttatttaaagtaaactctggaaaatagaaagcatttgtgattttaattttgacagtatcgtttgtgcacaagttgtttttggctgacttacccgttggtgaagaattattaaaggtcaaagttttatctcgaaattatgaagcacgttattaactttggcttctgttgtatttccagtgtgttcctttttgtcaggttatattttatattctaggtattttatcctgatagcctgatactttttcttatatggagactttttcttagcatgaaaaaaaaatttttttaagtagaatatatttcatgtcagatgagcaaaactttttgtcactaagaagtaactgggtatctcttacatgacattgggttttaatattactaaaattatatattcataggtggtagtcatgcaataacctgaattcatatacttcttttttttttttaattttttatttgagacagagtcttgctctgtcgctcaaggtggggtacagtggtgtgatcttggctcactgtaacctccgcctactgggttcaagggattctcctgcctcagcctcctaagtagctgggattacaggcgcctgccaccacacctgactaatttttttgtatttttagtagagacagggtttcgccatgttggccaggctggtcttgaacacctgacctcaagtgatctgccacacttcagcctcccaaagtggtgggattacaggtgtgagccactccacctgcctcttaattcatttacatttaaatactgacctttgttgaccttcttggtgaatcctgttgtcatagggtcaggaaaagccctgttgttagaattttagagtaagaaaggaccgtagaggctgtctagcccaggttcttgaatttatacctgtagaactggctataagagttaagtgacttgctgtaaaccaaacccccagagagtggccacttaagtctccagcccctacctcctataggatgaccctgtgctatgaacctttgtacttgtactctgtagtcttgactctcaaatgccattcccagtgagtacaagtgcccatccaatactctattttttttttttaaaaaaagaaagcatgagggaatctgcaaacaaagcagacgtgagattccttttattttctttgaaaaacggcagtgccttttagagtcaaatatgcatctaaactctaggagttttaccaggtaaataaggattgtatatttagctttcataatttataggtgaacagtctagtaacaacataaagaactcgtattaaagaatattaaaaatgcttcagacttttgatttgtattggatgagaattcatgggcaaggaagatgaccgttcacgaaattgtatattttttctctctaattttaactctgtgattctctggcaacaggctatacagttctggtgttacttagtctgcaaaaatcttacattgttttcataccagagctgattttgcctttttatatattacctaaaatacacacatacaaataaattactcattagttaatctacaaatgtacatatttttagtagctccctaaacaagatttaaagcttgactaaatgtagtcatggagcttattatttggtagttttgcattctgtagtttatgtaactctatccttaaaattgaaattatttctgagtggtacaagccaaatacagaagtcaaagctttatttttgatagtttcagtgttgttgatttgaggttctgaccttggaaataaagatacagaaaataaacacacaaaatatacaaaataacaatggacatttatgtatgcttttttcaatgtttattttctagctaaatccaagcacaacctaaaagtcttataaatattccatggaaaattttccttcctatgctaggtttctgagttgctttaaaaattagtctgaaacaatggttactttttttctccttggtaaatttccctgggggagtctcttggacattctttattgccctgagtctttgaaccatattcagaatgagaaactgaagacagttggtctgaagatactcggaggatggacagaaatgaccacagctgatttgatatgtatgaataattttgaaaaattttgatagaactcaagtgccaaggacagtttccatgtcgccttctttattgttcctttgtgcctgctatatggatgttattgtcttttttgaataatggcctcccttttcaaataatttagctcactttttaaaaattttttttagacagccttgctctgtcgtctatgctggagtgcaatggcatgatctctgctcactacaacctctgcctcctgggttcaagcgattctcctgcgtcagcctcccaagtagctgggattacaggcatgcaccactgcacttggctaatttttgtatttttagtagagacagggttttgccatcttggccaggctgatctcgaactcctgacctcgggtgatccacccgcctcagcctcccaaagtgctgggattacagggtgttagctaacttgtcttaaaaaaatctttgatagttcccagaatgaagggctgaggggacttgtatttgttccatgaactcagactcatgctatccacatcctgaagtgatcaaaccatccttggctctaacaactggagttctttctcatcattacccttctgaaatctttagaagaaataggtttctttgctccaaactttttaaacttttagttgctttggagtaatgtcactctgggtgaggtcagccttgtcagggtggttgctgagtgcatttatattggttctcattggcagtaatctcatttacaagcatagttaatagaaatggaaggccaaagatcttatgtcattgcctggtctcttaggagagatgaaataggaattcatggagcctcagagatctggaaaagcatcttcctgtagactaacactgtcctgtagaattttgtgtgatcatggagtgttccctaatctgcactgtttagtatggtagccacttgcaccatctggctattaagcacttaaaatgtagaatgaatttttaatttaattcattaaagttaaatggctacatgtagctaatggctactgtattggaagattcaaatttagactatttttaagaaaataaaattctttaaattttttaaagagatggagtctccctctgtcatccaggctagagtgcagtggtacaatcctagctcactgcagcctccaactcctagcctcaagaaaccctcccaccttagccacccaagtagctaggaccacaggcagctctcaccgtgcccagctaatttttaattgtttttttttttttttgtagagatggggtcttgctatgttgtccaggttggcctccagctcctgacctcaagcaatcctgtctcggcatcccacagtagtgggattataggcatgagccactgcacctggctagctttggagtattcttagggagtaacattggatcatattttttaaacctgaatttcattgtaaaataaaacacatacagaaaaccatgcaaaacaaatgcatagtttaatgaattatatgtcaacattcctgtaaccactgcccaaggctaagtagtaaaacttgaccagtcctccatgtgcctcatccctcccaccaaagtaatcactattatgacttttagattcatggcttcctcatgctttttagttttatcacccaagtgataaaacttatccttaggcactatagtttgatcttgcatatttcaaaataattgcaaatgtccttaaatcttttttaaatgatcacttcctcctccatctcctccttttccttataatttatctgggggagtacctgacttcttttgacctgtggagttttccacaatcagaattttgctaattgcatgctcccagtgcacgttaccacattcctttgtattttctgcaaattggcagcttgatccagaggttcaaatgatcagactcaggttgatctgggttatttagtttttaagatgcctttataacttcacatgcttgttaattatgggtctgttattgtggaaagaacaccaatggaatgttttctatcaaggtgtccaaaattgagagcagttagtatgataaaatggtttatgttaaattttgctgtatctaaaatgcaacactgagacatctactgagtgctacttgtggaaaatcagattgtcagaggtttctctaaatgtatttaatatgttcattggacctctatgcagattgagtttttatcaactgcttctgtgggcaagaagtgtgtatgggtatgtctgctggagtggtagaaagaattgctaatcagatgggcacggtggctcatgcctgtaatcccagcactttgggagtccgaggcgggtggatcacctgaggccaggagttcgagaccagcctggccaacatggtgaaaccccatctctaccctaaattcaaaaattagctgggtgtggtggcacattcctgtaatcccagctactgtggaggctgagacagaatggcttgaatctggtaggtaggtggaggttgcagtgagctgagatcacaccactgcactccagcctgggcaacacagcaagattctgactcaaaaaaaaattgctaatcaaatcgttatagccatttacttgtctaaacttcacccacatgactgtacataccatcttttttttttcctggtcttttaatttccaacacaagattaaaattgggttttagttatttttgtgcactggaacatctggtggcaaagaaagcaggaggtgaattgggtgtgttcctgtttgaagaagcagatggtcaataacacttggacctgctgtgtatagaacttcacataaacattgatatggagaaagagttttcataaaaattagcctctttactcttatcagggagtttaaaatataactagataaatatgacttagatacacaaaatactaagggtgcttttatgaagaaatataggcaggcatcagtggctcacgcctgtaatcccagcactttgggaggctgaggcaggcagatcatctgaggtcaggagttcgaggccaacctggccaacatggtgaaaccctgtctctactaaaaatacaaaaaaaaaaaaaaaaaaagctgggcatggtggtgtgtgcctgtaatcccagctatttgggaagctgaggcaagagaattgcttgaacctgggaggcagaggttgcagtgagctgggattgtgccactgcactctcgcctgggcaacagagtgggactctgtcttaacaaaaaaagtcaacatttataagttaatatataaaaaaaatttgagagactttccaatgtgataaaaaaagcagtagactggaaattaggtaatcttgatttgtctccagtttaggcctttgtcctcatctgtgtaaatgagggaattagactctagtagggatagcaaacatatgacattcttgccagatactatggcagataacactcattagtcacggtcttcattcagcttcagaattcttctcaaatttagggctccagtggccattacatattggttgattggaactgacatgggagacaacaatttgccattcctaggctacatcctttccaagtcccttcctagctacagatctcctctgtgaataaagaaaaatccttggaagctctaaattaccctgctagtcagtgtttctataacatatttcccccacttcttttaattcttccctggaagtgcagcatctcagaaaaacaactatgccagtaaaaatttttcctaaaaatgttatccattgaaatattgaacatttcatccaaagcaaaccattggtcattgtggattggccttaggccagaattgagttggtttagaatgggttggggagtgggggaagccaacaatcctttttatcccttgatgttatttttctttattagcagcatgtaaaatgttaaatttttctaatttttgttgggcccaagccgatgtttattacattcaatttatgggaactctttgcagttgaaatttggtatttgagtcacgtattgctttcatggtcttttacagagctctgtgacccaagtagtcactctgttgcctcccgccccactttaaaaaaaaatctggacaggaaataacaaaatactaggagtagacttgtgtttgaccttataggaaccataattaagggtgaaatagtgggatcctcaccccagcaatgcttgatgatagtaggggtagagtgtcctattcataaatccacaggagagaaagtcatgttggaaacagcaagtcaggaggctaatgttcctaaaaaccctttgagaacagggtgtagagaagagagaaaaagccctaaggggcgggtggttgtgatttattgaaagcttactccgaatcctttgagctacctagagagccctaggattactttgagtttataggactgcaagcttttgcatgcacaactcctatttttgaaaatttgacctttaaaatgatttcctttcctgtctcccatccctctccacctttcccccttttaaaactggacttttgtgtaaagttttaggttttagggttgatgtgaaggccctaagacctccatctatgagtggctaccatccattcacacacctaaaaattatttagcaggtaccgtactagttactaggaataaccggaggacctaccatttgttgagaaccccctttgtgtatggcccactgttaggcactttatgtagatatcttttctcatttaatcttcactaaatgaggacagattattttctggatgtaactcagatttaagtgttgctcaaatcacactacgtgactgggttagtgtttgaatgtagagcttcatactcgttcattttgttttttctcatgacatggatttttgtgacatttcataaaaaaaggtttttgaaaggtaatttctccgtgggtttgcatatctttaaaagcaaatgttgtcttccctgccctctgccctcactcacccgtaataaattgtaaaaatctgtctgtaagagcatgctctttaatttcctgtcttatatcctggtggtatgtgatgatataaaacaagtgtggctgagcctggcaaatttataagattgagaaggtttcaaagatgcatgaaaatgggtttacgtataatcaaaggttaattcaactctaacactttacttttgaggagcatcctcttttttgtatccctacctggggatgagagctgctaggagcgcagacaactcagtaattgtgtgcctgcctcatgcctagtctgttcatccttttgagctgtcaagatcaattatgttgaacatagccagagtggggtgtagtctgggtacagactcagcttttcttggcattggcagtatgtgacttctgtatctgatgtgtccatccaattcatattttggaatttacttagatatgcctcttattcatcagtatttgaaaattcttgataatctaaagtttgatccaggggagatttgctgaaagtgacatcaaacagtacctttgttttacttttaataatggattcatgtaaaaatcaccaggcatggtggcagacacctatagttccagctactcaggaggccaagatggggggaatcacttgagccctggagttgaaggctatagtgagctatgatcataccactgcactccagcctgagtgaccaagtgataccctgtctcttaataataattaaataataggccaggcgtggtggctcacgcctgtaatctcagcactttgggaggcagaggcgggcagatcatgaggtcaggagagaccatcctggctaacatggtgaaaccccgtctctactaaaaaatacaaaaaattagctgagtgtggtggtgggcgcctgtagtcccagctacttgggaggctgaggcaggagaatggcgtgaacccaggaggcggagcttgcagtgaggtgagatcgagccactgcactccagcctggatgacagagtgaaactctgtctcaaaaaaaaaaaaaaaaaaaaattgctgggtgtggtggtgtgtgcctgtaattcaagctactggggagactgaggcacgagaatcactggaacccgggaggtggaggttgcagtgagccgagatcgcgcccctgtactccagcctgggcgacacagtgagactgtctcaaaaataaaataaaatttctggatgtttctatcgtcatgtgctcccgtaaccgccagctatctgacatcaactctgtaaacttcatgtcctgtgtctccttcgtccacatgacttacatttttttatttcaattcatcttttctgctctcatctctatttctcatctttttgaaatttgtagtcatcagatagcttttatttgagtattaatatgacaagtttagaggagaattatttcacagaatgaggtctgaaattttaggtgactattcaacagattttttttccctaagcattcatcgtcatatctgccagccacggtgcctgatgctggagatacaagtgagcaaagctgagactacctctgctggaatccctctagtgatggacccagccactaatctgaaaatcatgtggacaagtaacaaaagactgcatatggagttaccaaggaaagcactacgggattttggcagtgtgtaacaggggacctaacttagtctgaaggatcaggaacgtctctcctgagaagataacatttttccctctgttgcccaggtaagagtcagtggtgattgtagctcactgcaatctcaatctcctgggctcggtcctcctgcctcagcctccagagtagctgggtgttaacagatgcatgcccctatgcctggctattaaaagacaattttttttgttttgatagagacggggtctcgctatgttgtccaggtcggtcttgaactcctggccggtcttgaactcctggcctcaagctatgatcctcctaccttggcctcccaaagtgttgggattacaggcatgagccaccatacccagctggaaataatatttgaatgaactctaaaggaggaaaggagttaactgattgaaaatgaaaggaaaacccttctaggtaaagcagccagcaactgcaaaggccctaaaaggggaacattgtgtgttctagaaactgaaggcagaggctgggtgcggtggctcatgcctgtaatcccagcactttgggaggctgaaatgggcagatcacttgaggtcaggagtttgagaccagcctggccaacatggggaaaccctgtctctactaaaaatacgaaaattagccaggcatggtggcacgtgcctgtaatcccagctacttggcaggatgaggcaggagaatcttttgaatctgggaggcggaggttgcaatgagctgagatggtgccactgcactctagcctgggtgacagagccggactccgtctcaaaacaaacaaacgaaaactgaaggcagatctcatttgctggagtgttttgaatgaggattattatggtgagaagaggctggagaggtaggcaggagccaccttgcaggtcttagtccatttaatccgtgttaaaaattcagtgctttagcccaagaaccatggcagtctttcaaagggctttaagcaaggaggtggcctgattagtgtctccttgtgtaggaggatcatgcctactgttatgtgaagaactaactagaagtgggcaagaatggatggggcagcctgttgggaggtctttcctcattctggtgagagacttggttccagaaaccagagatgtggtggaggacaaacgtttgcaaatccaggatcctttttaggaggagagatcagctggacatgatttggaggtagaagggagaggagggtatcaaaggtcagaggactgtggtgccattcactattacgtagcatgctagaggaagaccaggtttcggggaagaccatgtggttttaaacttgctgaatgagaagtgccttagaggtctccaagtgtatggtacagggactggggcagagggtgatgccgggaaggcagctggatttaggtgctggagctgagagaggcagccaggactggagagtcatctgcttacaagttaagttgaatgaatggcaaggatttgagtgcctggaagaaggcacagagagaaaagatgagagggctgatggaatcagtatagtttagtcatctacggagatgggaatgaacaagagagggcagggtttgcccagagaggcaggaacaaaaccaggagctgtggtgttaggaaagccaagagaagagagaattttaagcaggaggtccctactgccataggtaggacaaggtttcaagacaggagctgctctgatggcctgtggaggttggagcttcatcgtaatgggcagagtaaaggaaatacctctgcagccatctgagcagtaattccctggagagttaccaaggattgttcagtcaaacacaccccgtcatttatctggatagttctatttttccatacattgtctttgatcgaaatgtcgatcttttttcaaccagccgggatgaaaatggtgtgaatcgtgttctctctctttagaaagaaactgataaaattgggttttctttgttcttccttttattttcatccattcaatacctagtcctcactgagctggtcttactcaacccattccctctgctggtctgttgggtactaataacagatggaaacaactgggaagataaactattttcctggatttttttttttttttttttaaacagagtttcactcttgtttcccaggctggagtacagtggcacgatctcggctcactgcaacctccacttcctgcattcaagagattctcctgccttagcctcccaactagctgggattacaggtgcccgccaccacacccagttaattttttgtagttttagtagagatggggtttcgccatctcggctaggttggtctcgagctcctgacctcaggtgatccccctgcctctgcctcccaaagtgctgggattacaggcgtgagccatcgcacctggcccctggagataatattgatatgtgactcagggaggtaccaaacccaactgttgccccctttcctttatttacttatccaggatatttatctatatctgtaaaaggatttattattttttagaatcgtacagctgtaatgtctattcatcctgtcagaagagataaagcggatcagtaggcaagcatttgttgctgcttgagagagattttattaagctaaaatattccattagactcaactccattttcaaatattttgttaagagggtctcaggatgactgtaggaaaaaggtatttggaagattgtgtacactgacaataactagattacaaaattttataaattagttaagatggactttaaaatagcaacaggaaaaacaattttggacttgtctgcgagtgcgagtgaagctgatagtaatgagatttatgggttctggccctgcagggatcccagtagggatgaataaagcacatgcctgctagtacattcactgattctgctcttggatatattatttacttctttcctcttttagtaagactttcatctgtattagtaattgttctatacttttaatctctggagcaactccataaattaacaaggggttgtgtctaagatgatgctgatagccctgaagatgttttatttagtgcttttgggatgatgtgcagagatgggatgtcagaaggaataatttggaatcttatctccctgctccttggactcatgttatcaggggaagggagcttggggatgtggctgtcttagctgtgtcctctgatggcctcatctcagtggtttgggttgaaagactgtatctcgtgcttcctgtcccatcaacctctcccttcgtctgtttttctcttctgtgtttaagtataaacagaacccctttgtacctctcatctctttatcttctgaagactctgatgtggctactatgctctcccatttggttaatgctactttaggtatttagtatctttatacttttgttgtgttagttgtgatcagcaaagttctatgctgtagcaacacattaatctgcagatctcagtggcttaacactacagaggtccacttctcccttgctgttcatattcattgtgagtcggtaccgggactctcctctgcacagacttgtaggatctcagtacctagaacctaaggccggatctttcaggagctggggaggagggactggaggatctctcatgggcttttcattgcttcagctcaaaaacacttccactcaaagtcattgggcagagaaaaccacacaacttaattatcttaagaggtggggacaggggaagtggagcgaccgagagaagggttggaacatacagacataagaatgagaaagtcttacgagtgttctggtctctgccccatctgtattatctttgtttctgggaaggaaatttctgacagctgtgttgctagcataacctcttggttggtaaatgcattgctgtagacttttccttgatggaaactttctccaagacaatataaactacgcattgtctctttcttgttaaaccacttttttttacagtttattttttcgtttgctgttgaagatttgatcagtattttccttttgaatccaatggtagcaaaccaattttttttttttagaatatattaaggcaaaagaaaacaacttttaccccattcataataggatgtataaaagtaatacctcttggaatagaccatgggaattctggtgatacctagggcatcttatttgataaaatattttttctttctttccttctttcttccttccttccttccttccttctttttttttttttttttaaacagagtcttactctgttgcccaggctggagtgcagtggcacgatctcagctcactgcaacctctgcctcctgggttccagtgattctcctgcctcagcctcccaagtagctgagattacaggcatgtaccaccatggccagctaatttttgtatttttagtagagacagggtttccccatgttggccagggtggtcttgaactcctgacgtcaggtgatccccctgcgtcagcctcccaaagtgctagggttacaggtgtgagccattgcacctgactgaaagtattttcaaagcctctgctatggagtatagtgtgagatgtggagaagctgcagagggaggggcacgttagcatctaaagactctgttgaccatcatccacattaggtccattctaccattttctatgaagtctaaaataggttcctgattattttgtttttaattttttttttttttgagatggagtctcgctctgtcacccaggctggagtgcagtggcatgatctcggctcactgcaagctccacctcccaggttcacgccattctcctgcctcagcctcctgagtagctgggactacaggtgcccgccaccacgcctggctaattttttgtatttttagtagagacggggtttcaccatgttagccaggatggtctcaatctcctgaccttgtgatccacccgccttggcctcccgaagtgctgggattacaggcgtaagccaacgtgcctggccggttcctgatatttttaagggatttgtttgtgatttaagaatctggctattttataggacgcttaagtgttctttgtttaaataaaattaaaacttcaaattttcctttacaaccatttgaccagttacctctgtttcatctgccatacatggaaatagctttcccagagaaactgacatgaaggcatgcagtctactacatcaatgacatctacattacaaataatttaaaaatagtatatgaagcagagactgggtttacctattagaaaatctaacaaactatagcaaataagcataatttttaaggaaaacagatccctctaaatggtgcaaattttatattaatgaaagaactcaatctttaactcatattcttgttatagcatgaatgatcaagctgttttctgataaatagttcaaggataaagtggtctaatttgaataatgggactttattaggggcatctgcattaacgtgatttgaagcacatgtttgtatgctcactcagttgccttttatataattacattctttatcagttgttggtaaaggttcacttcattttaactagttttcaagttctgtcaggggagagaacctcttattccccatgccctgtgcttgtgaaggggtctgggctacgtaaatgggagggagtgagactgaaggggattaagtcctggcctttgcagttctgttgtcagcctcccccaggaaccagtgcctgactccttgggtccatctgttccgagccctgacagacaggacaagtagaagtaggtctagtctttcttcctactggagggtaacttcggagagtctttaggatgatgctcttcattgaaacctgggggttatactttttaaaaaaatgtgtttcactgtccccttaccctctgattatactagtcttgtgttctttttagaacacctaatataaagtgtaaaaaagtgcaaataaagtgtaaaaaagaggccgggcacagtggctcatgcctgtaatcccagcactttgggaggccgaggtgggtggatcacctgagatcaggagttcaagactggcctggccagcatggtgaaaccccatctctactaaatatacaaaaattagccaggcgtggtggctcagcctgtagtcccagctacttgggaggctgaggcaggagaatcgcttgaacccgggagttggaggttacagtgagctgagattgtgccactgcactacagcctgggcaacagagtgaaactaggtcaaaaaacaaaacaaaacaaaacaccaaaaaaactgtaatatagtataaaaaagaaatgaagttacacatgatcaagtcatctctgttaatcttttgttatactcttctgtctttttaagtgtgtgtgtgcttatttttttttcctcatgttacaaaaatacatttttaggtcttttgttaagaatatattgtgataactcaatttaaaaatgggcaaaggacttgaacagacatttctctaaagaagacatacaaatggccaataagcacgtgaggagatgctccacgttagggaagtgcaaatcaagaccacaatgagatactgtttcacacccattggatggccgttaagagaatagaaacaagtgttgagaatgaggatacattagaactcttgtgcattgctggtggaaatgtaaaatagtgcagctgctgtagaaaatggtatgaaggcttctcaaaacattaaacatagaattcctatgtgtcccagcaattccacttctgggtatctgcccataagaattgagagcagagacttgacagacatttgtacacccatgttcatagcagtattcataatagctgaatggtagaagcaaccctgtgtttgtcagtggatgaatggataaacaaagtatgggaacacatagagtggaatattattgagccttaaacaggaagggaattctgatacatgctgcaatatggatgaacttcaaagacattatgccaagtgaaatgagccaataacaaaaggacaaatgtatagtttcacttacatgagttatacatttcatgtataacttctcaaactcatggagacagaaagtagaatggtagtgggctaggggtagggggaaatgggaagttcgtttttattttcattttatttttttgaggcagggtctcactctgtcacccaggctggactgcaatggtgtgatcatagctcatgacatcctccatctcctggctcaagccatcctcccgtctcagcctccgtaatagctgagactgcaacacatgcaccaccatgcctggctaatttttttgattttttttttagtggagacgaggtgtgactatgttgcccaggctggtctcaaactcctggcctcaagcattcctcccaccttggcctctcaaagtgctgggattacaggtgagagcctctacacatagtgggaagttagtttttaatggtagttccagtttgggaagaaaacattctgcggatggatgatgatgatgattgcagaatggtgtgagcgtagctaatgctgtagaactgagtacactccagcctgggcaacaagagtgaaactccccccactgcccaaaaaaaaaaaagaactgtgtgcttaaaaatggttaaaatattaaattgtatgttattgcaatttcagagtatattgcgatcatttcccacattacatatattttgaaaatgtgtttaatattccattttgtagaatatcttttaccattttatttttagccactgtcatttttctgtttttcactaatgcgaggaatactatgatgaataacctcgtttatcaggtttttctttatagataattacttcaggtaaattcctaggggtgagattactgggctacatagtatgaacctttttaaggctcttgatccatatcatcacattaccctcagaatagttactaaatttcatttcagccaagcacacttccaccagcagtgtatgagggtcagctttcattttatcttcccagacaccatgtgttatctttaaaaataaattgcctgttaagctaaacaatgatatgtcatcattgtttcaatttaatccatttttattactgatgacttctgttttttttccactttcattaatagtacctgaaatatagggagtgcttcatatttgttgaatgaatttgtcaagtatctactaggtgccatatccttttatagatgtgtgggacataatatcaaacaagactgaattatattatacttctctcactgtgtttacagtctagtggaggagtcaattaaacaattgataggtgctatcagttgaagtatgcttgacatgcaaacaaatattggtgatccctaacccaacctgtaagagatggggcttctgtaaggacgtgatgtttaagccaaaatctcgttgaatgggaggcatctcaaggattctccttccaggggatgaaatggagctcaaggaagaaggaatgtttccagaagaaaaacctcaagatgtaaactaaagttggccatttgtattttttcttataggatttggctattcattgtgctttgctctttttccccctctcctattggcttaagtttttttggtggtggtgggggagtaatttaaaagtacctgttatatagtaaattattaaacatttgcctatatagtaaattattaaacatttgctattcatatataatgttttacccttctctggttaattcgccacatcctgaacccctgcaaataagtttgtgtgtgtgtgtgtgtgtgtgtgtgtgtgtgtgtgtgtgtgtgtgtgtttgagacggagtttcgctcttgttgcccaggctggagtgcagtggcgtgatctcggcttactgcaacctctgcctcctgggctcaagtgattgtcctgcctcagcctcccaagtagctggggttacaggcgcccgccaccacgtccagctaatttttttgtacttttagtagagatggggtttcaccatgttgaccaggctggtctggaactcctgaccttaggtgatccgccctcctcggcctcccaaagtgctgggattacaggcgtgagccaccgtgcccagccagacgtgccttctttattgatgtaggaatctgtttaattagatcatttttttcctccgcagagtcaaactcatagtcttgggaggaagataggaagggggcaggcagggaggttacatggggactctgagatgtctgagggtgaggagaggatgaaggcgaggcaaaggaatagatatcgttggtgatccgctaaggacagtgaccttctcaccttatctcagtcctcaacatgtaaagattttcctccattttacaagcaaggaaatcaagtttctaagaggtaagtattgtttgtggtagatctaaggttttgttttgagacagtctcactctgtcatgcaggctggagtacagtggcattatcatggcacaccacagcctcgacctctcaggctcaagtgatccttgtgcttcagcctcctcagtagctgagactaccggtggttgccaccatggccagctattttttttttttaagagatgaggtttcactacgtttcccaggcttgtctcaaactcccggtcttaagcaatccacctgccttggcttcccaaaattctgggattacaggcatgagccactgtacccagcatggatctaagttttaaacctggttgagctaataggaaaacctaacttttaaacttttaataatatacctcaatggttttttaaagggaagtactggaaaactggatgctggctttttgacttctctttgaatattaaatgagcttgactccatggaattcttgtaatcttaaatgccaaagctttagaccataaactaatcactttgtggctttctataagtcaaaaagccaattaaaaaaaaaacttttattgctaaaatttgtaaccagtatggagatttgtgtgtgtatgtgtgattgaacctgggaatcttcccccccctccgccccccttaatttccaattgagtagtgattttttgtggttggagaggtagttttaacccggtgaattcctctagcggttcttgctgaatgatttcctaaggcattttgaaaatctcttgggtagtgcttttaacctggcttcacatttcatctttctttattcagggagtgtttggattttacaccatgcttgaggctgccatgtctcggctgcaataaccagaaaacattggttttctttggtcactgaccaagcttgtcactactcatttctgcctggctctagactgaagacttcagtccaattttccgaatggcctcttttgacttactgtgcaaaacccccactttggctctgaaccattctctgaatattagcataagcacctaatgctgcttgactaaattgtttctgttgagagagggggatgaggaaaggctggcacggggaacatctgttagggctgtaccttttcattgtattaatttttctgacttctgggattattttcattatgcaactcttcaataaagcaaatttggtatgataaggacttaacattcccccccactcattttaaacatatggggtttccaggctgttattcaaagctgtcctacagactaaaatttaaaatacaagtgaaccaagattctgcagctgaatctgggctttgaggagcctacagtgggagaaggggatgaaaaaaaatattttgtggaatgtactataaccaaccaataagatgtttttgctattttaattggctcttcctggcaggagtttcatacagcggtgtctcagacactgaccaaatctgtttatggtaagtcatttttgtagagaacaacaacattcaacaggctatggtatcactccatttggaagtatgtttcctgatcttgaggtcgtagaagaaaatgacaggaacatacttgtgcccacacaggccctaatctgtcttgctggcattccttagacatttatttattgaagagtccttgtgtctatattgaggggagaaactagataggttaaggaatggatgataactttgattctgagagctcttgcgctatcagaaggaatgtgattgacggtgcttgaatgaaagggtaactgttacagtatcaaccaagagatagaggatggctggttttggaagctgacttgcaacactgttatatctggagttataaccttccagagtgttacaaagtttccagtctattcttcctatgtctgccctcagtgagctagcattgagattcggctgtttatttgcagaaatagttaatctatctttcttttaaaattaacgccttctggaaacagtggctcaacggggaaatgaactcttcactaaaatctcacatttcttacgcttccacttggaataagatccctctcaacacaaataatgtttaatttttttaaccactctgaagctaacttaggtttaattttagtttatgctaaaagtttttcttatgtgactcctacagttttcctagagttattgaaaaaactgctcctataaagcaagtttagtttttattctgttcattttagatccttaatattgttctttcattactacttgaggggaatttaaaaagaaagaaatataacagctgttttgaagtacatttgaaaaatggtaaactgcagaatctgttgcttttccttgactctcttcactctcccccaaagacctttaaatagaagctgtttccttttgctgcattaaccccaaaccctatctgatttcttccagttgccgagcaaacagtggcagcttgcctctgaaggccaccaaaaaggaccaaaatgtttgcatggaaatggcaaccaagaaacccctaatattaagaacctaccttgaaatctgccaattaatgaatggaagcttcatcagattttcaaatggcttttataaaattatataatggaggtgaaagtgaaaggtctacactataactcctattacatgagctaaatgtgtaagccttaccatttgatgtgctcttctaggcttaacagtaaggaccattttggagttaaaattgtgtggattagttctgtgttaaacatgtcttcatctcatttatgtattgtattaaactctttggggaaacagataaaaaggacattttaggctttacaaacacgctacacaccataaaatgtttgtttcagcccattgcttactccaaagcaatggccttttgcttgaagataatctcaataatagaaaacagttaccaaaggaactaggttttgggtggacgacttagccctccacaagggactgcagaatcctggtatttgaactggcagggtgtttggtttctttttttttttttcttttttttttttggcttgtttgttttcgtttgtcagaatatggccccagtttggtttaagttttgaatgttcaggaatttctcagagcagacaggggtccataagggcttagtagtgcttctactgtgcaaacagtgatttcttttttctccaaaaattaatttggcgtaagtgtgatcatggctgcttgacatttttttgttttgagatgggagagcataaaccacattcaaaggaaaaattagagcctatgtattagaatatttaaactgcttaatgtagagcaaaggaaaatgtcacaattggatgctgttgtgttctaagcaagcaatgcttctctggatttggatacttgagaaatcctttatttagaagtcattcatattcatctttaatacagcaactgtgaatatcattagccagaagcaataaattttgtgaaaattatttggcaattgagaaggtagggtagccagttgaagtcctgtgggcccaaggaggaacttggcagtgagttattgtcaaaagctgcgagtgccaggagtcagcccaaggagagttctgtgggaatcagaggagtgtggggccagttgagtccttatattatttattcctgcaagcatgacagattgattattacggatctgaaaaatcacttgcatgggtcttctcattctttttcacccctcttttctttctttttgggagtggataagacttaaaaaccacatacctcaggatacattgccgaatcaaaatttttctgatggtcgcagacttccgtgtctagaaagctgctagctttctactatttaaaatacaaattttgggatatggcaagcctcaccatttcttcactgtatgtagtactgcttgctgggcagcagacagtaaatattaagtaagctcttcaaaatcagtttcattccatcagagcatggtgacatttttttcccctgcttttaatctctaaggtgcaaattttgagggatgttaagtaattttaaaaatttatctactgtctttgtgtttgctgtgagatatctttctggagatagaaaattaagtgaggcgtgttgttctgaaatctgggtgccagtaattcttgcatcgtagggagctgtgccttgcactgtgtatacatgtcaaatctgaacatctcacctcgaaagaagtttgccaaaaggtaaaaagcacttcccaaacaatcctacggttttgagtaaggagtactcaaagaaagaaagggactgttttcagatgtttcataaatggtaatcaatcactaataattaactaggtacttgaccatgcaggtatgctcccagcacagtgcgatagcagcttagaatttgagattgaacttttaccctggttatctttagaatactgtttctctttcatttatgtgaataaacatgtattttgcatgttactgtaaacatttatatatccttatacctttgcagtttaccaagaaaggcttataaaattgtgataaagatttctagtgaattattttcttacagctcttatgcaaggaattcaagatttttgtattatcctgagtcatagatataagtggtttgataggttataagctatcttgacactgttctgcatttataaattcagccattctgcaaatgtttctggagcacctgctgcacacagacaccaaggacacaccagcgactaagtcagttgtggtccctacttttgagggagtgttgaagtctattcaattaaaagccaaatcatggcggggcgcggtggctcatgcctgtaatcccagcactttgggaggccgaggcaggcagatcacaaggtcaggagtttgaaaccatcctagccaacttggtgaaaccccgtctctactaaaaatacaaaaatcaggtggacgtggtggcgcatgcctgtcatcccagctactcaggaggctgaggcaggagaattgcttgaatgcaggaggcggaggttgcagtgagccgagatcaggccattgcactccagcctgagcagcagagtgagactccatctcaaaaaaaataaaataaaataaataataataataataataataataataataataataataataaattcagagatggagaaaactttgggaggcagggtgagcatctgaacctatttgaatgtagatataactaatgccaagcaagggaattatggggacaggacagaatgtcaaagttatacacctagaaactataaaaatagtgtaacagagccaaagtctggaggcagagagaggaaaagtaagagaaggtataagcatgctggtgtccacatctttgatagtagatttaactgattctgtctaaaacaaaagcattgttcaaaaaaattgcttcagctttttaaatattttcaccatctcttaatctgaaatttcattaattttattttgttagagtcaagaaaaattatatcagaagtgaaaatagcatgtggaacatgttcccattttcataaagattacttgtcatccatccttgttcatagaaagatggctagaatggtttttgcttagtgttaatgatattatttctgtgtgttggcatttgagttgatttatttttacatttgtctttctactctgcattgcataaattctctatttctttttttaaaaaagaagcataatatgccaagatgtttaaagtagataattttggatgttgagaacctgaataatttttttttttgtagttttaatttccaaaattaggggagagggagcatcttgtttggtttaccgtgctgaccataggttatatgtcattttatgcatataagtttaagtaatttaagtaccaagttactactagtacttgatttcctaagttgctgggaatatacactgtgggctgttcataatttttggtacttaatccatttcctctctgccatgcttagctttttctctatcactttcttccccccttgtctattctggggccatatcactctttgttatccatcactgaatggcctaacttcctttcaaacagagtttccctcatttggttggttttcggttttcatggaaagctattgaagtggtgtaagtgagtatggggtaggggaagctggttttgttatgatcaggtttagaagttcatttggcctgctgtgcagagaccggattggagggagactggagtgagtgagactataccagttgggtactgctgaacagccatccctgaaagtgatggcgacttggacggaggaggtggggaggtggacttaagaggctgtacttgaaaaatggactagacttagtggaagattagatataaagggggggttgaaggacagggagtatccagggtgacttgtaggttctgagcttgcacaataggatggatggcaatccatttgctgagataaggcatgatggaagaggaacttgatgtttgtttatgtctgaatcatctgaatcatgaggctggaccaggtgaccttgggcttcattttaaaattgatagcaccatgatgcctaccattgtatgttttcagtgagggctcatgagtgggtgtcttgggccccatccctccctaacttagaggaaaaaaaaaattgtcagcagcattttctggggagaggttccttccatatttttcattaggctttccaggggggccttggctcaagaaaaattaagaaccactgactaagtatgttcagtcacagtgaccattcaataaataattgtcataggctcgtaaagcagaagaacagtatcgatgaatggaaatttcctattcggcattttagaagggagtttgaagtgctcctaggagccattttcccagcatggtcttttctgaccacctaagaccaaaatgatcattcagtctcttaattcctttagcggtaattgtgcatgtactatttcttggctttatttttatgtttttttgactatgctgtttagcttttccaatagaaacagctagctgtgccgggcgctgtggctcacgcctgtaatcccagcactttgggaggctgaggcgggcagatagcttgagctcaggagcttgagatcaggctggccaacatggtgaaacccatctgtaccaaaaacaaaaaacaaacaacaacaacaacaacaaaaaaacagttagttgttattagcctatccccatgctggctaagttacataatcatccctgtaaagttagtgttggcatccttattttagagatgaggaaactgaggcttagaaatgtaagtaaatggtagctagtaagtggcagaactgtgatttgaatcaaggctctttgactccagagctttctttttgtcacagatattgacaagtcctgctggttggcagaagtcatacctatactctacttttatttattttgagatggagtcccactctgtcacccaggctggggtgcacttgcgcgatctcggctcactgcaacttccacctcctgggttcgagtgattctcctgcctcagtctcccaagtagctgggaatgcaggcacgtgccgccacacctcatgcctgtactttgtatcacacattgtgcattcagatttttactgaaagaacgaatatacctattgcagtatgatcaagcctgttttatgtaatgcccctgcatatgctcagaatcaaggattaccctttttatttttctcatttgtctcctatttcttttgcaaactaaataccctttcccccgcaccctctattgctggattttcttaggaactcttataccttatcttgctttggaaatagcaaaatacacaggattacagaattgttatcaattcacacatttgagatttatatgttaccaccattacttcctacaccagttttctagctacttttgtgtgtgtgtgtgtgtatttaaattgtgattgaattagaaaaccttgttaggaagttgaatttctgaagcaatcatttatgttcagcctgtgtaactaatggacaattatctttcagtttcctctggaatcttgctttaatgactttcagagtagtgtttatatatgccatcacttgcctaattagttttataaggaaatccgtgtcatcccgggtcatcctgccaatagaggcagcttccagttctcttgagcctcccgagggatgcattcccttcacaaagtgctggaagctggctttcctggagctccagggtcagggaccattttcctttttttatcatggaaatgaaaaagtcagtgtcagggaggtggctgactgtacgacagtcctgattattgacttatttctcttaccttaaaacttgagttatttcatcgtaaaattgcaggcaggaaaaatatatagaagcagtagccttcagattgaggatgaagaaatctctctgaacttcaaggaaatttggaaatgagcaaaaattttgaaaacatttgaaaatggaatttatagccctaataaaaaatgcagttaggtgtatcaacattttgattcctagaccaagcacagtgcctggcatataatagatggctaattaatttcattgaacgaatacctaagtagatgatggatgaatgccactggaacataatgtccatgagggcagtgttgctgatatttctagcatcatctggaaggtgctcagtaactacattctgagtgaatgactgagtgccagtaaaagataagctattgcgttatctttttttgctttttttttttttttgagatggagtttcactctgtcactcaagctggagtgcgcacgtggcactatctcagctcactgcaacttccacctcctgggttcaggcgattctcctgcctcaacctctcgagtagctgggactacaggcacgtgccaccacgcctggctaatttttttgtgtttttagtagagacagggtttcaccgtgttagctaggatggtctcgatctcctgacctagtgatctgcccaccttggcctcccaaagtgctaagattacaggcctgagccaccacgccctgctgagatatcttttttaaattaaaaaaaaaaaattagagacagagtcttgctatattgcccgggatggacttttgaactcttgggctcaagcttcttgcttcagcctcccaagtggttggttttacaggtttgcgccactgtgcctggctgttgggtggattttagtatgaaaactacagatcctaagagatgatccctgggcatatcaacaaagtatatgttttaaaaagccaagcttattagaaatattatgtcctatgatactggaaatccatttttatttgaaaatattaaatagagttgacatgttgaattttttagtatagattaaggcactagttcttaggatggcttttggtgcagtgactcacgcttgtaatcccagcactttgggaggccgaggcaagcagatcacttgaggtcaggagttcgagaccagccctggccaacatggttaaaccccatctctactaaaaatacaaaaaattagctgggcgtggtggctcacacctgtaatcccagctactccagaggctgaggcaggagaatcacttgaacgcgggaggcggaggttgcagggagccaagatcatgccactgcactccagcctgggtgacagagcaagactccatctaaaaaaaaaaaaaaaattattggggactctaaagagttttatttacatagattttatctactgatattggtcatattagaaatttaagatgagagattttaaagatttattaattgatttaaaatagtaatagtaatccctttatacagttacacaaactacataattttatgaaaaaggacattttccctaacaaaaaaaatttagtgggaagagtggtgttttacatccctcttctgtctgacttaaataaaacatagttggactctcagctgcttctgcttcaatctgttgtgatatgttttggttgaagtgtatgtctaacacatatatgtaattgaaaaaaggagggaatattttaatagctttttcacgtaactggagatattctttgatacttttgatagtggtcgttggcaagtaagtttctcaaaggttggttgcaaggtagagaatgaaaccgtgtctgtgtttcatattggtccatcttatgtgttgaatggctcttttatgtgttggtgtgaccgcattctttagtttggaaaacactatttcattgagttctgcaggttcttctaaatgttgacacatttcattattcaacatcaaaaaagtcacaattattagtatcaccatcagtctcatcaaagagcctttaagtattattaggaagccgtcaagctgacggtagatgcacattttctaagattgtgtttttcacttggaaaactttattgtatttcaaaaaagtatctgccaaatatccaagtctaagcaaccatattgtagttgttcttttgagtcaaagtggtgtttcatggagagagtggctgctcagctcaagacagccctcatccctggagtgtagccaaatgctttatgtgtcagaatatttactcagaattctgaacctttttttttttttttttttgagacaaagtcttgctctgtgcccaggctggagtgcagtggcccagtcttagctcactgcaacctccacctcctgggttcaagcgattctactgcctcagacttatgagtagctgggattacaggcacacgccaccacgcccggctaatttttatagttttagtagagatggggtttcaccatgtttgccaggctggtctccaactcctggcctcatgtgatccacctgccttggcctcgtaaagtgctgtgattataggtgtgagccaccatgcctggcccagaatcaataattgttaatgcttcatcgagactttcttaaatgaaactggcataaaagacaacaaaaagcccctgggatttcatggtgggaagaacataattcctgctagtaccgcctggcactgtcaccttgactcaggctaaggttcctgctgtcacaccaccattgctcttgcaccatcagtgcaaacgtcaacacaaggaaaaaggcaaatagtggctcagtattatcattaaagtggtttgatcatgaggacccttaagggtttgtggagcatactttgaggcacactttgatttaagaggttagaaacatcacattaaaattcatactaataaagtgaaattgtgccaattgcccaaaacagtgcatcaatccaaaactcttatttgtcttggagaaatgcattcaaaacatagtcaacaccactatctcattttgtctctgtgttgtgttaagatgggtttgcatactttcagcctcttagagcaggcagttggaacattatccagcagcaggttgaacagcagagggggagggcagctggaagttaggctaatctaacaaatgagtcatccacatgtggataatggagttgtaaaattactctcagctttagtcagcagcaaccaaactatacggttaaaaattacaggtctccaaaatagagacttcctgagaacttttagtatagcatttaactgagaatgtatcaagggtttggttgaggattttttcataaaacctttctgttctggaaggcaagtttgttattaagagcttcagtaatttctcttacgaagtgttcaaaatgcaccagaacctgaacacaatgtgagcagctgagtgttcatcttagctgcgtccatcaagtgaacggtttgctctcttcctgtccataatttgagagtcagcctaatggtgagtggacagtcatctaataaaatatttcatacctgtggcagcaggtataaagcaaatagtttatttttgctttccatgtaaagtttggcagtaaagtttttgtcttgagatttttgttttataagagaaattaaaattccttctgggcttttgctgttctcccctgaggatgaatatgctgcctgcctaccctgctaccccccgcatttggcaaggttgcacatgtcttagggatggaaaaccagtagccaacactaaaccaggcctgctgtgtagacctggcttggtgagtatggagctgttccgcagtagaggtttgcaaagaaaccatcacacccttgtttcctctctccttctggcttttcatttttcttctggccttttgcatggaagaaataagtcatcccttttgaacagtttgggtatggagtgtttgcccatgcggtagactctggcaggacagagagggttttcccgggcctttagttgtccaggtcctgtattctcacatctcctctgggctgctgactgcgcacaaacacaaaattcattcctccaatagaacagtgtttggcctggctcccaaaaactgctctcctcacttgcacggctttgattgagtgttaggtgtctctttggctgcctccagtgtctcttatttttagggccttcgttaatgtcttctgtgtgtgaaacatgaaaatggagccatggctgctggaattggaaacttagggtttttaggccaccattcccttatcacatggcgttatcaggttatttagttacagaggttaaaaaaaaagtccaccctaggagccggcgtgtgtggggaaaggagagagggggcagctgagcacctaatgggcagtgaaaaaagatattgtaactaaagctcgggctagtgtcctcagagcgatggcctttcaggtgctggcaggggtctgcttacagctcagcctggttacaaatgaggggataaattggtggtaacagtgcctttttatttttttcctttttcctttggaaactggcttttcacatgttggaaaacgagcttggatgctcggtgtaggtaacaggcaattctgatctgagaggaagggctcaggaaaggtgtgaccaaatgagccgtctgagtggtcagtcctgcccggggctcacccaggcagggagctggggtctttcatgtgggtgtccgtggacccacaggagacagggagggattgattacaggggagaccacttctgtttccctttcctaaaggaaacagaaaatggaaataaaaatctaaaattatgttattttccatttttggaattctgttcatttgtgtttggggccagttttattattttttttaatcttttttgagacaggatcttactctctcacccaggctgcagtgcagtggcaccgtcgtggctcactgcacccttgacctcccaggcttaagcgatcctcccacctcagcctcccaagtagctgggactataggtgcacacaaccacacctggctaatttttttttccccttggtagagatggggttttgctgtgttgcccaggctggccttgaactcctgggctcaagcaatctgcttgccttggcctcccaaactgctgggattacagacgtgaggcaccgtgactagcctgggaccagtttttgacggtccctagccttccatgagcattcgtgtgcaaatgcacagtccagaggcatgtttagttgactctggtttcctccctccctttcaatgtgtggaactcgcagcgttctttctctgcattgctgcgatctgccacacttctcgttttatcatggactgcagtacaatgtaattgtctgtgtgccagtttcctctgtcttactaaagtgtgaatgtttgatggaagaaactctgagtggacagggtctgtcataatcaccccagtattccccatcgtgtggtgctgagcttggtatgtagtggggagtgggtatgcagtgaatgtggaatgggtggatgcttgaatgagtacagccgaatttcctggccaggaaaaccatgaagtgttagcactgttctgattttacttcctccttcaggctatgggcgcgtgccaactgacagggcagggactgccatggctagtggctattacctaaactccagcccagttttggtgcccccgtttctgagtcctgagcaagtgttcctggcattgtgttggttcctatggtatgtgttttagtctgtgagactctttcctcagtttgaagatctgaaagtaaaatgtttcacccaaggtttttagattcgagagctcatcccgtaggccagggagagtgagtactaataccctatatgtggctgtgtttagaaagggctattgggaaacataaaaaatagattttgacattggaaacaaatacattttagtatgtgctgctaaagaaatgtgtgctataagctattctcctggggttataaatcattaaatattaactttttaaacgattaaacatgtgactatatcttattggttacaaataataaatgcctactcaaaccagcgtaaaccataaaagtagaatttgtataaggattcacagggtggtttatggggagaagggcaggaaatgctgccaggctacaagggagtctggaaccaggactagggcaataccaggagccaaggcactgctctttcaccccgagaaccctgggactcacccgtgcttctctcccagtatcagattcgttctctgtggcagtggttgggcttcctccacttccctgctcttagggtctaaactggcagtgtcacgtcgtgagcatacctctgccttcaagttcaaatgcagacagacacaagtctctgtttaaattcctgaggaagaatttggttggcccaatgtggtcagctgtctacccaagtccaatgaactctgctcatgggaatggggctggggaataaatgtggcttagagggctgacgtgagatcccagagtctggaagctatttcaaggttctggaaatagtctagtagggctacaaaactcagagcaagccatagggtccggacagtaccctatttcctttatttctaattattttctgctctgccttttgagggaactcatcagtgtcttcctgaggcctggaggcttttctgtgatcatgaaatgtactatctgaggcctggaggcttttctgtgaccatgaaatgaactatcaagagcagggcatgggctctgcagacagcccaggagttctctgctgcagggctaagtgataattctgctgaggcggttgacattcttctggttagctttagggcagatgaaagggaaagaatatcaggagaaaaaagagcatcttgaatttgtggtgttttttgaggttttttttttttttttttttttttgagatggagtctctctctgttgccaggctggagtgcagtggcgcaatctcagctcactgcaacctccgtctcctgggttcaagtgattctcctgcctcagcctcccgagtagctgggactacaggtgcgtgccaccacactcagctaatttttgtatttttggtagagacggggtttcaccatgttgaccaggctggtcttgaactcctgaccttgtgatccgcccgcctctaccttccaaagtgctgggattacaggaatgagccaccgtgcccggcctgagttgtattattttagggtttggggaggagggaagtggcgaagaatggtatatgaagggtgttcttgatttttcagagatgaaataattttatccagccatttatatttctatgtatttcttcggtatctgtttttaatatcctgttagacgttttagtctgtcaagagttattgctaattgtcaaccaactacctggttgcaatgaagataggttctttttatgccatgcactccagagatctactacacagctgggtggctatgatttgcattaaactaataaagtcccctggttaaaggggtatgtcctagatttaacatttgaaatcctttccattaagtgcagcacaagcagatctttctgcacattttggtgaagcttaaccatttttgatgactcattttgatcctaatctttaatttttctgattgcttttggtaaccttctatttgggctgtgtgccgaattttatgataggtatcctttagacggcagatataatcaggtgatttgattcagaaaaggagtttgctttcccttccgacttctgttttgaaagcaccaaggcactgggcatggtgactcatacctgtaatcccagcactttgggaggctgaggcgggtggatcacctgaggtgaagagttcaagaccagcctggccaacatggtgaaaccccgtctctactaagaatacaaaaattagccgggtgtggtggcctgctcctgtaatcccagctattcaggaggctgaggcgggagaattgcttgaacccgggaggcggaggttgcagtgagccaagatcgggccattgcactccagcctgggcgacagagcaagactctttctcaaagaaagcaccaaagaattcccccaatagaaacagtgtgtagaaaataatttggaaatgaaggaattaagatggtctgagatttttgtggcttgctctgtgttttatagccctggtgggctgcaaacaggtatcttgcttcagctctcagagcagcctcagtcactgggaactttttttttttcacggatgctgctttctcagcttctagaattgcctccttagtcctgagttagaatgtcagagacaggttttatgctactttgctggcaaggatcaccatcgcacacgtcatgtagtttatcttgaaattttatgatttgggaatcagattccttcaaataagtttgtgtcatctgttttgttgagagagctcgtggctaggatcgcagacgcgaacattgtttcttcctgaattgtgtccttgagttggttggtgtgtatctccagagtccattgtttcttttgcagaatgaaggaattggtctgcagtgatctcaaagataattccaacccagcacaccaggactcaaacttaagaaagaattatttttgttatgagtcatgtacatttagggttcttaccagacagaataattaaatacatgcagctctgctccatgcaggcaggctctgggtcctcacctctgcatacaggatgctgagcatggtagtggtttaatcaatactgttggtggtgtaaatggatgaatggtggccattctgaaacggctttgtaggatctaagctgtgttgggagccaatgtaagtctggtctctgtcatttggagtatattttgaaaatagaagattaaaacccctcttcatttaagttgccgtctaaggtcctggaccagccttggttcacccaggttttttcctctgcaggacattggctcacagaaaacagggctgcccccttttcctgcatatttggcctcggactgcctacttgactaatcagtttaagctcttccctcttaggccattaatcctatttctccagccgagaagcagcaggataatagtaatgtgtcctgtagctattaaaagatgatattgccttgcacataaataaagtacttttttttcctctgcaaaaggatgatcaaacaaatttaattttcatttatgcttttgcctttttgtgatatttctttgtatcttctagtacaatcaggggagaacatcatttttactgttattgatggttattttctacttgttttcagcatcctaacaaggtatttgctttcctatacatcgttacattttgtcatcctatgatgaactctcgttgctcgagggggcgaaaacagagtgaacgtggaaatgatctttggcatgtggtattttctgaaaaactgaatttcacaataagcacatttcgtggcatttgctaacaataatctccacattcctagaggtcagattttctcattgaacacatttttttttcttttcagtttatatatgcagaaagggcttcattaaaactgagatcattctcattcaatcttaagctggcagccaacccagatccttttaatccctgctgtatgtgctaatgaaaactcagggaagtgctgatgaaagggaggtggtgaggctccttcctctccttgcctggagacttaacctgtacatttctaggcttttcagagttaagttttgcacctgcttgtgcagtggtgatggagctcctgaggtatttctgcatttgcttcctgggtcttgaatttccaccattaaatttcagtctagtggcgggtgcatgggtgtgtgttacatcattctgagtttttttgtacatccaaaataattttgtcatcaccatgatcgtggctgccatcatcatttcgacttttgagagtcagtttatcctctcacccagcaaatctgcttttgagaattggccctaagcaagtaatcttgaatatggaggaagatttttgcacaatgaacctgcccattgctggtttattcataacagcaaaaacattggaaacatccttttccagttttgggggaaatgattcagtgatgattggtactgtatattcaagtaatagaatattaagtatcctttcaaatcattgcttaggataaatatggaaaaatgctcttgaaaatataccttcccaattataggaaagatagtaaattatattcacagtatgattaaagtgatgttttttttgagatggagttttgctcttgtcgcccgggctggagtgcaatggcatgatctccgctcactgcaacctccgcctcctgggttcaagtgattctcctgcctcagcctcccgagtagctgggatttcaggcacgtgccaccaagtccagctaatttttgtatttttagtagaggtggggttttgccatgttggccaagctggtctcaaactcctgatctcaggtgacccacccacctcagcctcccaaagtgctgggattataggcattagccaccacgcccatcggtgattttttttaaatctagtttttaaaatacctgaacagtgatggtgtaaaggacaagatgatagaagacttttttcttttcattttcttgattttctttatcatccacttttttaaaagacaccaacattatttgcataacaaaacaccatataggccggcacggtggctcacgcctgtaatcccagcactttgggaggccaaggcaggcagatcacaaggtcaggagatcgaggccatcctagctaacatggtgaaaccccatctctactaaaaatacaaaaaattagccgggcgtggtgtcgggtgcctgtagtcccagctactcgggaggctgacgcttgaacccaggaggcggaggttgcagtgagctgagatcgtgccactgcactccaacctgggtgacagagtgagactccgtctcaaaaaaacaaaaacaaaaacaaaacaaacaaaacaccatacagatggatatctaaaagtgaatgagacttgaaaatcagccagaaatgtttgctgtggtgataaacataacccttaaaatgattttttaaatatttttttaaaaaatagggtcttactccaatttcccagcctggagtgctactggagtggtgtgatttcagctcactgcagcctccacctcttgggctcaggtgattctcccaccttagcctcctgagtcgctgagactacagccacaccaccatgccctgctatttattgattttttacttttgggagagacggagttttgccatgttgcccatgctggtcttgaactcctgggctcaagtgatccacttgcctcagcctcccaaagtgctggggattataggcgtgagccaccacgcccagccaaaatgaattctttggggtccagaaatcttgtcttttgcaaagatagtttgatggggcagggttgctgggaaatgagggtcccaggctaacagttctctcaaatgtgcttcatggctcctgagtgccagctctgagtcatgggtataggaactggtggaaggagacagagagagagggtgctgaagctgggtggtgggggagggcactagaggcagctgtggtctaagtcacacttgggtcttgcatctggctttctgcttttattactattatactttttaatggcaatgagctgtagatacaaagccagctttgagttgttaagaataatgaggtctgtcctgacagtacaggcagcagaggcataagcaaataaatcccaatgtattataatatgcaattttatatttagacttcgaatgcattatgatcattataaaaaatgtctatttctaattctgttaaggaagatggtatagcagtaggggctttggaattacaacagggttgaatactggcgctacttgttagctgtggtttttggataagtaatttaacttttcctggcagagttttctcgtttataaaatagaaataatactacctttctcataggagtttgtgcttattaaatgagaggtaatgtatgtgtgattcatggtgtatgtttggtagatgatgattatcatgaataactagtaaagtaagtaatgtgatttaagttatgttattagaagtcccactgaatgccgtgtcaataggaacacagactcatactagtttggaagggaaatctggctcggattctaaacggtaccttggaagtgcagatggacaacagaatgattggagatgagtgccttggtaagccagttctttctggtgaacttggaagcagagaaaagagtaacaaaaattatggaatttaattatattaattagaattatatgatgattataatagaattgccttttgttctggagttaacattttataactttataattagatctcttgaacatttgaaaagttcaataagtacttgtttgtgtcatattagtctattctaattgatacacatgcacatagagcacaattttttttttttaagcccaaaaagtttattagcgttgggatgggatttgacgcactgaggttttccctggacaagattcttaccttctttgagggctgagtttaaatagttattcccaggagggcagaggaactcttccgttgtaattgaataataagtgtcattcttgggtaccagataaacttaactgatcacttaattgatgctttgaatggctgcataatgtgtaagtccttagaagccagagatgagatttgttcatattttgcccttctagtacctagaaggtactttgcacatggtaatgaatacatgtgtgaattaatagatggtaatctattacactctacccatttcctttctcaaagattcaagcctaaggctaacatgatattgagaagaagaaacgtaactaccttgctgttgacagtgtagcagcaaatgtaataatgtgtggaacttcagggtttcttgttcattcggtggtcagcatacaaaacatgcgtcagtaccttttttcttgtcctcttaaaattttatttctttacccccagagtgatgttggcacatttgctctgctgaaatgatttcaagagctcttcattgctgattcatttaatgattactgtccaaatggccccactcccacaaggaaaagtgtctccacattaacaagcactttcttctgcttgatttctatggttacatacgttgtgtcactttgaggagttggaaataaatttaacaggatattaggatgagagtacctttaaaaaaaagttctgctaaggaagtgtttcatcctggtgaataatgaaatcaggttaaaatttgtcttaaattaataatgactttcgacgtagtccttgttctcacatttcatgggctgattgcttttttattttagctgaggtcatgttaaaaccaaaataaagttatttgaaaatctagtgcaaaattttatttttctatcaatttgtgattcccagagcaaatttggggagagccaagtaaattaaaaagtgaatttaggtgatgttaagtctaagatagccctcaataaagatcttctcagaaaattcttgagtggcaccaacttttgtcactaatagcccacagacacgcgtcactttaattctttgaaaacctacactcaacagaaatgataaacttataaatgattttgcaatctgctgccggtttcttaaaaaaaattatcagtttcttagtttattctgaactggatttgatacacagaaaactggttttcctgcctgcttaggaatatatcacatcatgtaataagcctctcagagatgtagcattgagcagattaaggcctcatttatagaagaattccaccctggccatgtgggcctgaaactctggagggctttaacaatgtcttgaggtcattgtcatttaaagagatgactcagtggttttatttagtagaaataaatactaaataaataatctccacagattatccagaggggtaagttgaaggatgttgacagataactcagtaaattgcgtctcaaatattaataagtttattctatgccagcaccaaaaatatttcagagatgcttttaggcttctctcaagtatgtcgggaacagaaaaggattatagaaatatttatagtaggcataaacttgcacaaaagctcaaagtaccttaagcaagcttgttgcaattattcttttggagaactggattaagtaattatttcttgttgcctctgactatttaacctcctactaaactgcccattgtttaaatgtctcttatttagctctgtttttatcactccttaaatttaatattctcaaggccaaaattatagcagtgatggtcaggacatctttgaagacaattagattctgagaggataatttatatgtagaattaggaatattcatatcactcagaagtatcataaaaaccattctttcacaataacttttccactcaaacatcgccgaacttgattaccaagaccctaactgtatttcacttctttgcagtatttgaagttggagggaagggcttccacagctgaagagtttggctaaaccatgggaccctttcacattggctgagggggtgacagtgggtattgatccaagccagcccgcccttacttggttggaactctgttttagtacttgggggtgacaggggaaaggcctggagagcatcagtcctccatgagtcttagctgctccacgagaaaaatactcactgttttctcataggcattgccacagtattctctgacgagtgtttagcaggcatggcctggtctgggaaagtcctctattccttggccctgcctggaagttgtggtgcggggaggccatggattggaagaaaccctaaggtggatatccgaagggctcttaaatgttgcttgtggcagctgggaacagggatactaatgaggaaggacaagctcttcgatttcaggtggttcaggagcctcaggcaggagtcagatttaagggataagtggttcctattttcagtatctctcctccacaggtctttatggaaaatcttaaaacccactcttgtcatccgaactggataatgcaggttcttggcccttccagtgctacattgaaccaagggttcagaaacaattgagcggtgggtggtcagttccaaagtggcgcttagaggaagtctcgaagtgaagagggaggtttagggaatgagtttggagtcgtgttttcatttcttttggttgaaggaatttaagagtatcgtctttatctggttttatgtattgcttttctttttgtttggggtaggtgattaaaaatagaaaagtggggaaagagacaaatttagccttcaacaagctctcggtgatctgtgaccatattgttttcactgaagattatttacaacatgatgcggccttggttgctgctgagctggcttcagggcagtagataggaaggatgtttccaaggaaaactactctgaatgaacttgtccttgggtatgtgagtaactgatatcaaccaaaccaaatgtcaataagtcattcattgtgaatcatcctttttcggtcttgacactgcacgtaccagatcagttgatctctctcctttgtaagtctttcaaaagacgcatacattagattttttttttttttaggacagggtctcgctctgttgcccaggctggagtgcagtggtgtgaccctggctcactgttacctccgcttcctgggttcaagcaattctcctgcctcagtctctcgagtagctgggattacaggcacccgccaccacgcctggctaatttttgtattttagtagagatgaggtttcaccatattggccaggctgatcttgaactcctgacctcaagtgatccatccgcctcggcctcccaaaatgctaggattataggtgtgagccactgcgccagcccatacattggattttattttcctccaacagcgtggactctacccagtcttcctggttctggttttccaatagttttcttttcttgaaggtggtcactgtttcttaaatgtttatagatttactttagctttccattaagaaatcaagtaaatcagatgtacttgtcctaatgtagtaatatagataataaaattgttagtggttaatatttcctgaacatgttctctgcgtcaggcaccaatctaagtgggacttggctcagtttccacaaagccccatggaatctggtttacagagaacaatgtgagagtgtctgtttccccacagccttgctatagaggccatggtatcatctagtgacaattttcatcacctgctctattaagccacttgcgtgttctagaaggggttgagctctttctttctttctttctttcttttttgatacggagtttcgctcttgttgcccaggccagagtgcagtggcaccatcttgtctcactgcaacctctgcctcccgggttcaagcgattctcctgcctcagtctcctgagtagctggaattacaggcatgcgccaccacactggagtaactttttgtatttttagtagagactgggtttcatcatgttggccagactggtcttgaactccagacctcaggtgatccacccaccttggcctctcaaagtgcaggggattacaggcatgagccaccaccatgcccagctgggttgagctctttctcacctgtaccttttagtgccacttcctctgagcagactctcccactctttagccttcctgatgcctcttggctctccaggctgggtgtcatctgtcctctgctcaattgtcccacgatttccaatgttcaatgttataattgcctggtggttgttggatgccttcactggatcctgagctccttaaggttgagataagtctcacttttgtgtctcatgggcctgggacacaggagataacaggtgaagtctgttgatcttacctgatggggaaatgtattttttctgtctccctcaactagtgaggtgccttgcaggtttttttttttttttcctctttgttttttaattttttgagacagagtctcagtctatatagcccaggctggagtgcagtcgtgcgatcttggctcactgcgacctctgcctcccaggttcaagcaattcttatgcctcagtcagccgagtagttgggattacaggcatgtgccgccatgccaggctaatttttgtattttagtagagatgggattttgccatgttgtccaggctggtctcaaactcctggcctcaggggatccacccgcctcagcctcccgaagtgttgagattacaggtgtgagccactgtgcctggctgccttgcgggcttttaggcacctcaatgtctagttttgtcagaatagcatcctagaggtcttagaaatcttacctgttggagaaagttttaaagtgccccaaacatcccagcagttgtacatcctttcactcacactaaaattcatcctgttttgctttcacaggtatgtacattttgatgaaaagacactgcaaagatgagcaccagctagccaaattgtgtagtaaacattgcatgtctatctgtgtgtgttttattgttttgttattttatttagtcaacccttttgttattttaccataagttcatttacacagggtaatcttctcccattacagttgcatggaaggaatcttagaggaaacagttactgattttcttagtgtgagaccagaaaaatgaagcgttggtattggccttggggatttgctgtcctttatcctcggtaaagcaaaccagccatccgaatgtaaaggcagctcctttctttccataagtaataagtcatgatttcttaatgaggcaaattatctatcatttagtgaattcatagtatttgttacaagtaaattcattaagaaagagcgctattccaataaagccaatttaattacgcagacaattaaggggcatcttccatgtgctctgcactgtgctagccacggggtggatatagaaatggacaaactagggatgggcttatttatttatttatttgtttgttttgagacggagtctcaccctgtcacccaggctggagtgcagtggcacgatcttggctcactgcaacctctgcctcccgggttcaaacgattcttctgcctcagcctcccgagtacctgggactacaggcgcgtgccaccatgcctggctaatttttgtatttttagtagagatggggtttcagcatattggccaggctggtctgaaactcctgaccttgtgatctgcctgccttggcctcccaaattgctgggattacaggcatgagtcaccgtgcctggcctggaatgggctttttaaaggagattatagccaagggcagtggtgtgcacctgtagtcccagctactcaggaggctgaggcaggaggatcacttgagctcaggagcactgagctgtagtgcactgtgccagttgagtgcactaagtttggcatcaatatggtgacctcccaggagtcggggaccaccaggttgcctgagggaggtgtgaacctacccaggtcagaactggagcagatcaagactcccatgctgatcagtagtgggatctcacctgtgaatagccactgcactccagcctgaccaacatagaccccatctcaatcaatcagtaaattcatttattcattcataggaatcacagacaagggagtcacttaccataaaaaatatacaaaataaatgactccagaggcataaaaccaaaggggttttgtgccaaaaaataggaatcaaggaagtaacatttgaatttgatcttagggaatggatgtaccttaaacaagtagccctgtatggagaagaggagagagggaacgataatgaagaacagagacgtggaggccggaagatgccagctctaccagaaaaagtagcaaaagtcaatgtgattgaagtagggggagtgcgggagcagggagggtgtgattgatgcctggcagctgcccgtaacgtatgatgcagtatggttttcgcctgatttggggtttccagttctccctggctgctgacggggctccctcaggcacacattaatggattcactcagccagtgatttttctgttttctctttcatttccacttttctatcccatcatggttttctgcataaccccatctgattttagaccaattttgatgtgatttttttcttctacgtgagtggctcagtgaaggctttcgaatactattttcccacttgcatactgtttcagaactgaagaaggtaaaatctaattgtaccaggtttttgaaaagcagtagtttccattgtatgtgtttaaaaagtccccaaaggtctatctgtaagaatctttgaaaagacacattgcagcccaaaccttaggagaaaagaaaaaggggacttcacattgtaaaagcagcatttatctttgcatcttgaagttcctagaataggctctcgcctttataagtggagttttcttgtggcttttgtggggagaattcactagaattagggcagattttctggaaagtcccgaaattcagtgttctgttggatttctggcatctattgagcaagacagttgggataatgagtcttggtattaaatgtattctacgggagggaggagagagaagtgggaggaaggtgtatccgtcttgctggcttcctgcagcttaagtaggaggaagaaaaggagagggtgtgagtagatgacccaagccctggactaagccctttaggtacatgatctcatttaatccccttttcagaggaaactgcctgagatatgtttgacccaggctttgtgctcttagccactaaatggcttccctttactgatgattttactctgcctttatcctatagttacttataggcagctatatttacttcctccaaatagattaactctttgtatactctttggtacctggaataagtcctgtgtaatcctaaacgctcaataaatatttcttaaaatgaagataattctccttgacagaaaattgatcttactgagcatatatccactgagaaaacagacgtatgaatgtttaatactccctgattatcgtatgctttcttatttaagcagaagtattaaacgcatgccaaaggctcacataaatgatttattatgcaccaattaacgttatctgagccatggtttttctttgttgttatgaattgagcattgacagcaaggcagcactcatttaccttttgtttctatgcagaaaacatttcaaataggcaactgttgtctctcctgagtagtctgagaaatgtgaatggagacatttgtattaggtgtccatctcgtgaccaatatgctttgtacttttgaagtttgctttatccttaagattgtgagaactgtaaatctgccactggaaccatccctgcagattgtcataatgtgatcagctctaaaaagcttcctgctttttagagtgtgtacccttaaggataacaatcatatagataaccttttagatgtcaacacaggcgatctttttatgtgttttattcatgatgcaatttacagtacttaaaggaaaaaaaatccagaagccttacaaggtctttaataagtacaaatatagattgctataggtagaaagtatgctttaaagcaaacttttttacaccattttctgaggcttttattaattactctgttttccagcgaggctttttcatagggatatgcacctgactaacttattaaaagtaaattgcctttgtggtcttattttcagggcgtggtgctgaagttagaaggcgattgggcagttttgttttctacagagaaaacacaatctgggaagagatcttaattgacctattagctgaattgaggagatgaattagttgtagaaaatttgtcaaagttaaataatagcagtgagtttgaaggggtgagctagcagaactagaagagaaaggagaatgagaagtaactcacaggccagctgcataatgggtagagcgagctataggtgaactgtgagtagctggcttgctctgttggctgaattccttgaaaagaaaggatgagacatttttactccagtaaatcttatgtgtatctcttgtggattgaagaaattattgactcaatatgatttaagttagagacaaagcacactcacaaaattccaaaatcagtcttttaaaaaaagcacttcatagtgagcaaattttaaattaaatcatcatctaaattgtgacatgcattgagaggaacaggtgaggtttttactccacgttggtctccatgtaacaataattttcatgtcaaaatgatcttttcaggttttcaggttgccctcttcccctctcctttctgttttcagataattggatgaaagtaaaatcttttgaaaacattgctttcagcgtgccaaaagcaaggcatttataactggcctcaatttgcaaacaatttaggagtttgataagtttctaacaggaccatggtgagttcacaaaatctgatttctttaatggaaacaaaaagtgtgctttgtggaagttgatgttaggaattacaaagaaacccactgttcagcacaagtgcgcaggcctttggccaagaattcctcagcttggaacctgagctaagaaaaagcccctggtcacacctgtggataaaagacttagtgagagctgggaggacaggtgaaaaatgatggtttggaagccagagactgttaaatagaagtgacagaggtgagagaggtatccaggaaaagccactgctgtacctaaaacagtagttaaaaggaattaaaaatgtaaagtcttagacgtttggaactctgctatttctgtacctttctaaatgatcttctcagcccttcagagtctgttacactgttgcattctaaaagatggtcttgatagtaaatggggtaaaatggtctcatcaggtctatttttctctcctggttaaatgtctacttaggttaaataaaagctgtcctgttgtagtcaaaacaattagttcctggcctcataagaccaggtttgaatctgagctgtgtttttgctggctttatggtattgggcaagttggcaatgttcaacttaattatgtcttctcatttgctaaatggataccaatttatgagactatgctcacaaacctaaagtgaacaggtgaaagaccctctgcaaaatagctgctcaataaactgttgcatgctaatcctaaataagcacttaagaggtatcagttacaatgaattccctgtgtttataaaataacttacaggtgcagttcctcttcatagggagtaacatgaatgagtaacatcacatcaccatactgttctgagaggtacttggcagattggtcaatactgtgaactcagaactccaaccgtgggatcccagccatccattcagtggcatttctaccagaacatctgtgtaagagattgaaggttaattttggcaattcttaccttgtacagaattctgtgcattttaagttaaattactgtaggtgattggggattttgaaaatctaggctcaattgttgacaattccagtgacctttggtctggagcaaatcccttagcctatatatatacacacatatatgtgtgtgtgtgtgtgtttatctatatgtgtgtgtatatatgtgtgtgtgtgtgtgtgtgtatatgtatatatatatatatatatatatttttttttttttttttttttttttggagacagggtctctgtcacccaggctggagtgcagtggtgcgatctcgactcaaggcaacctccatctcccaggctcaagtgatcctcccacctcagcctcctgagtagctgggactacaggcatacaccaccacatccggctaatttttgtatttttttgtagagacgggattgcgctatgttgtccaggctggtctcgaactcctgagctcaagtaatctgcccaccccagcctcccaaagtgctgagattacaggcataagccaccatgcctggtctcttagcctgcatatttcatgtttctcgttcataatataaagacagaaaaggtgcttcctatgggaagatagatgtggacacaatttcacaaattaagttttatacaaatgtaaagtactgcaattcatgttgacctctcagcttagttggttttagagtaaaggggttagctagaggcctgagtcttgctccctggcctggcccaaattacctgacccaggagacatctcaacctctctagcttttagtttcgtaatctgtagatcgtgaggggggttgactccatgattccgtgagctttcttctcaagcatctcattctagaatattccatcggtccttttctgtcaccttcttcccaagtggttgtgaaagggtggcttgtaggcattaggccagagctgtgtgttagccataattcagataatacagcttataattcagcttgtgttgatcagaaactctgcctaagggaaggcccaggtaaaacctgtaaagtcctggagtttcatcacagatgatgctattgcagagcctccaagattttgcctcttttttatgagctttggtgactaccccagcctaatgaggtccaagatatcccagtacttccacgggaggatcatgtgaagattgctgtctggttccaaaattccctcctaaaacagcaagggtggcacctggggaggaggagggacctgggggaggaggagggacctgtgagaggggtatcagtgattctgcaggtgattcctcctcttcctgtcctcttattaaaattccctgaggctgacttcagctagatgttgatcagattaaagcagttggtgctgggatggattaataagcttgaaattttttaacttggatgccttgaggtacttatttcatccccaagcattttccatctctatcccaactagtccagtaaaacctgtggcattgctgagcaataagcaatgcacctgcccgttttcactattggatctggctctgtccactcttttctgggagaacagaggggatgggtggcgtgatggcccactgagtgctgggcttctccatcctccatctgagttggctgcattcctgtcccaggtgtcctctgcctctgttgagcccctgccactgctacctccaagtgtccttccttccctccacatgcagaatggagctttccatccccaaagaactcgagcagcctgtttgcatcactgccaggagacctgtttggtactgccaagcactgcaggtatttctagctcagttgtcttatcattagggtgaacatatttatcctctaaaccaggacacttttgaaagtgaagggaggagagccattaataattaagctgggacaacagtcataaaccaggattgtctgggcagactcaaacatgtggtcgccctacttgttccctgtacttgatggaagccttcctgacggtaaggacagtccttccacatcccctcaacctccacagtggcacagacataattatattgaatgaagcgataaataaagctattttgatactttttttttttttttttttttgagatggagtcttgctctgtcgcccaggctggagtgcagtggcatgatctcggcttactgcaacctctgcctcccgggttcaagcaattttcctgcctcagcctctggagtagctgggactacgggtgcacaccaccatagctggctattttgataagctttaatgacagggatggcgaacagtggttaacagttagtgaggcattgccaggtgcagtatgtgaggtcagcactttgtataattatttaatcttcacaatagcgctatagatttgatactattttttttcttttcttttcttttttttttttttttttttgagacagggtctcactctgtcgcccaagatgcgtgtagtggtgtgatcataggtcactgcaacctggaactcccaggctcaagcaatccttccacctcagactcccaagtagctgggactacaggtgcatgccaccatgcccggctaacattttatgttttgtagagacggggtctcattatgttgcccaggctggtcttgaactcctggactcaagcgatccaccactgcccatcctatttttctgtttttcagagaagaatattgatgcctagagaagttaagttgcttgagagcagagagtaagcagcaaagctagggttcaaacccagagtgtaatctcataggtgctgtattatacagataagctagatgcaggggcaggctggtttgtaagagggcatgttgcctgtagcatttctccttagtgaatctccgaaacaaatcacatcctgtttatttccaacaaaagagaacaaatttgggattatatctgattatagcatgcgagtagcaaataagatatgatgtatgtatttttgcagttttttctttccaagttcccccatctttggccaaaatatcacattttaaaccaatgaagagttaaatctagagttaatcacttagcatcagcagtgcagccagaattctcatctcctgattctaaaactgcctgaccctaccctggagtcactgatcaggttgagaggagttcagaatgaagagagaattgtttcaaccacctgttctgcatgagagcctttcaccattttctgtgtgtttgtgaaatgaccattctgaagttcagatccacatataagactcattcaaaatgatcttcctcaatggaaaccgggggtgagatttgaacctgagagagacagtctgctctggttgatgaacagcatagctctggacccagactgcctgggtttacatctcagctctgccacttctaactttgtgattcaggcaaattatttaactcccagtttttttatctgtaacatggggataataacagcataagagcactagccacactggatggctataagattgaaatcaattactatgtgtaaaaatcttagaatagggcctggcataaagcgacactgtgactgttttatctgtaatatatatgttgctttttaaaggccactaggtgatacattagagcaggcagggtgccatcgaatgacccaaccctttgtcatctggcaatattgcctaaaatccagacggtggattttcaccttcaaagtggttctttgggcacaaggcaagtcttccgaaactccctacttgatgcctggcgtattataggcgtctcatattttttgttaaattgaactgaaaaattgaagcgctttgtatctaaacaaatgtagaaaagtgagacgctgtatccagggtctgaagttgaaaagatttaaaatgtggatggaaacttcagggatgggggttgcatgggatgtttgtaattacttatggatgatatgaagatagtacctgctgtattttaccatgtatatgagtctcgtggggacttcatttaaaaatgtgtcttctgcatctgagatcctgactcaggaggtctagatgggacccaggaatctgcactgacacaggcggtctgtgaaccagacttggagaaacactattttagtccagcgtcttggatgcatgagcttatagttccttgacaatggcaaaattagaagtctaactgaaatcacctacaagatgtgcatgtattacatataccattggagacacccactcggagttttcttattgagagaacatttcagttttgatttcataggtaattgggcggtactgatgaatcactaggttttttttaaatgtaagcagtgatacatccacaaacactttcctgagaggtgatagtctcacgcaaaatttaagaaacttttattcttggcttaatctttgtgactgtattttgtgttatgtgtattctttattttgagacatcctgaaatccttaaattttgctcattttcttaaaagccaaatcccacataactatgtaagtatattctttttcagcagttttctctggggagtttcctaaataaatgaattgaatgggggagccatgatgaatgggtcagtatgctcattgcagtgccatctcttaaagggataaactggcagcaatctaaaagggcaacaggccaggcgcagtggctcgcacctgtaatcccagtactttgggaagccgaggcaggcagatcacttgaggtcaggaattcgagaccagcctgcccaacacggtgaaaaccctgcctctactaaaatacaaaaattagccgggcttggtggcgggcacctataatcccagctacttgggaggctgagttccagcagaattgctggaacctgggaggtggaggttgcagtgagtcaagattgcgccactgcactccagcctgggtgacagagtgagactccttctcaaaaaagaggggaacaaagggagagagattgatttatggctcacatgcataataaatatacctaacaattaactatgaaaatgtagtgtatttgctgtcatgaaaagatgtttgataatcatcttttatgtaagtgaacaagcatgttaaagaacacattgtaaaaaaatatcataatacagccagtatttactgagtacttgctatgtggtggacacttggaacgcattatctcatttaatcctcccgtaaacctgtgtgtttaaagtactattatctgtattttctgatgagagacttgtggcccagagagggtaagtgacttgtccaaggtcgtacagcctgtaaatgttccccaaaagcccatgtactttcttcactgtcatgcattactgcacctggggcagtagctacacactttgtttaaagggcctgtatgaataccccaaaatattcatgatatcgattcaagttgtaggagtttggtgatttgattaatttttctttctgcttccctgcattttcttttttcttccaacagccagttattaagtcaaccaacaaataattctaatggcttcctaaatgtagaaagttggttaattttggtattgcttttgccattcagggatttacatagggacaatcacagagatgctaaaccagttaacctttgtaggaaagcggccattaaaaccctccctcctgttttcacgatcactttcatcctaaaatcgggtagattacctctgcgtttgtaacatcttcagtattcaaggcttggatgtaggagagaagccagtttaaatggtcctcacttgtttagcacctacttatcaccccgggagcccttagagttaataaggagcccagtgcaccggtgatcagctactttatttccagaagtgggatgtgggggccctgctgctgcagtgggggtttgagggcagctgttcacctgggtgcatgtcctggatctcatgttgggggcggcagtgctcccctggaaggggatgagccagggaggagtccgcaagggaggatgggccagggagggagggctctgaagcacacccttgctccctgggcagggtctgcatccagggctccttccttccgcctggagctttcccatgaatccttcctccaccacctcctcaactagcacctccagctcgccccgcctgacccagctccctcagcccatgtgtccccgctttgccagctcttctgtgtgctaagtggcacggactgctgtctgtggcttcagtccccggtgggggagcgctggggtgttccgcctcctaagagactgttggttgagggcccgcatatctgtttctgggtttggtgctatcaaggtcacacgggtgtcgccccagactcctctgctgcttacagggcctcatgctggcgtcaccatggcatcagcccagcctagtggagacttgctatctgatttccatcatcctccattcccctttgcaccgcagccccctgaattaattaagcaagcaagcaaacaatcaagtcttgttcgacactgttaaagggagcaggcttcctggtctgtggggagctgcaggggagggatgtgatgacttaattacaactgccacttgactgagtgtctgctaagtgcagggtgctgagttgcattcttttttttttttttttttttctttctgagacacggtcttgctctgtcgtccaggctggagcacagtggcttgatcttggctcactgcaacctctgcttcctgggttcaagcagttctcatgtgtcagtctcccgagtagctgggactacaggcacttgccaccatgcctggccaattttttatttgtatttttagtagagatgggatttcaccatgctgcccagggtggtctcaaactcctggcctcaagaaatctgcccgccttggcctctcgaagtgctgggattacaggcatgagacaccgcacccggccttagttgcattctttattctgttgaatctttatcctttctgcatggtatgcagccttgaggggggtaatagcttaatgggagaatttatagttttacctgtatattcggtggaagatttcaggtgagcagaagttctgggaggattaagcgtcgagggagatcttgagaatgaacacagttgaaaatgaaatcagtccagttgtaagtaataagtgatcgaggaaaaggaagttccttcacctggttaatgaatatttattgcctgtcacccggaaaaaccctggtctcagaagacttaagggtaccgggtttgtacaacaggcagcttttgcattggacttgctggctgaagccagatacctacatgggctgtatagtgatggatgcttcattcttccttggtctgcttggttggaagtggagtcgatggtgcttctagctgatccccttacctctgaattttgtcccggtagctggtgactccttggtgaagtcagtttaagtctctgggaaaagcatcccatgcatatcatattccaaatgttctgtgtaagccccaggtttctttcacaggccttgtgttattagagttctgggggcagttcttgagggcatgtgtcttttctgccaatatttaaaatagttgttggctttaggcttgttttacacttcaggtcatctacaaaggaaatgttaatttgggggaaaagagatgcaatgaagagataaatatataaagatacagaggctcataaacactctggttcacagctcctggccagccctgtccataggagccatatggacccggcatgtggcttaatcctcgtaagcctgggtccctcagacaactgtgaagggggatattgctacctgcttgctaacatgctgagctgtgaagataactgaggtcatggataatgaagtgctgggcacttgcaaaacatgatttacaatctcagcaaagacttcattgtttattcagtatatatttattgacttccttctgtgtgctgggtacagagccacataccagctctccttggagtgtagtccctgggcaggaagcttcagcctgatggaaacactgtttcctaggtttcctgggccctgctgaagccggctgcatcagaatcttcaggaatcagtgtttaaccaccctcccctgactgatacctagtcatgtttgagaaggccccctggcacagtaggagaggttcagagacaagctaactgctatgggcgaggctggcacaggcagtggaaggtggtagtaaaagaacaggtggtctggcctggcgcggtggctcacgcctgtaatcccagcactttgggagaccaaggcgggtggatcacctgaggtcaggagttcaagaccgggctggccaacatggtaaaaccccatctcttctaaaactacaaaaattatctgggcatggtggtgggcgcctgtaagtccagctacttgggaggctgaggcaggagaatcgcttgaacctgggaggcagagactgcacagaggctgcagtgagccgagatcatgccactgcacttcagcctgggtgacagagcgagactctgtctcaaaaaaaaaaaaattgaataggtcgtctgctgggtgaggacccctccaccccagctctcatcccctggcccgagggttggagcactagacttcatgtaccagttcaggatatgcatatctggggagccgtcctgggcatcggcatctgggagagggggtgaggatgggtgggggtccccatgtaagtcctttcttcaggttgtggcttctgcatagctccttgttgtgtggacctgtgagtacacaccctggaaaggcaagtcaaggcctcctctctgctggtttcaagtggtggagaagccctgcatgactgaggcagagaagatgctggaaactgtggcaccaaaccacctcagagcttgagttcagtcccctgcaaaatcccaaagcctccggatttatttatttatttatttatttatttgagatggagtttcactcttgtcgcccaggctggaatgcaatggcatgatctcagctcactgcaacctctgccttccaggttcaagcgattttcctgcctcagcctcccaagtagctggaattacaggtgtgtgccaccacgcccagctaattttgtatttttagtagagatggggttttgccatgttggccaggctgggctcgaactcttgacctcaggtgatcctcctgcctcagccttccaaagtgctgggattacaggcatgagtcgctgtgtcaggccccaaagcctcaggattttagagcgttgtcaatccccttactctcttggccacctcagaaaaccaagaaacaggaatttacttgtcccaggtctatctggggctgagctaatgcagagcctaggtacacagctgcttttatatatatagatatacgtgtatatatatacatgtatacatgtatatacgtatatatgtatatatataatgcctatattatgtatatataatgcctatattacatatataatatctatattacatatatgtctatattttatatatataatgtctatattatatatatgtctatattatatatataatgtctatattatatatataaaatgtctattatatatatataaagtctatgttttatatatatatatatatatatttttttttttttttttttttgaggcaggacctcactctgtctcccaggctgcaggttgctaattaatttttttcttttaatagagacagattctcactacattgcccaggctggtcttgaactcctggcctcaagtgatcctcccccttcaacctcccaaagtactgggattaggcatgagcccctatccctggcctgctgcttattattgtcattactgttcatcatggtttactgtgaatggataaaagggaaagttaagaaccattgatgggcacattatattgtaccccacatgttaatataaaggttcttctaggctgggtgtggtggcttacgcctgtaatcccagcactttgggaggcccaagtgggtggatcacctgaggtgaggagttcgagaccagcctgggcaacatggcaaaaccctgtctctactaaaaatacaaaaattagctggctgtggtggcgtgtgcctgtagtctcagctactcaggaggctgaggcaggagaatcgcttgaacctggaaggcagtgagctgagattgggccactacactccagcctgggcgacagagcgagactctgtatcaaaaaaatgttcttctgatttttttccctctatcacatatgccatttaaaatataagggatatatggaggtatgattcatgtatcataaaattcaccattttggtggttttttagtattcacggaattgaatgactattaataccatctactttggaacatttttgtcactccagaaagaaaccccagaccccttagcaatcactgtctattctccctctctgtagcccctggcaaccatgaatctactttctgtctctttgaatttgcctagtttgtacacttcatataaatgtaattgagcaggctgggcgtaaagtctcacgcctgtaatcctagcactttgggagaccaaggcgggcaaatcattgaggccaggagttcaagactgtcctgtccaacatggtgtgaaacccggtctctactaaaaatacaaaaattagcctggcgtggtggcacatggctgtaatcccagctacttgggagggtgaggcaggagaaatgcttgaactcaggaggcagaggttgcagtgagccaagatcacaccactacactccaacctaagcgacagagcgagactccatctcaaaaaaaaaaaaaaagtaatgatataatatgtggcttttactgtctggcttctttcacttagcattacatttttaaggttcatttatactgcagaatgaatcagtacttcacccctttttatggcttaatagtaattgattttatttatcagttggtagacagttgagttgtttatactttgactattatgaacagtgctgctgtgaacattcagttgtgcatgagtttttttgtggacgtgtgtgttcattcctctcgggtatatacctaggactgaaattgctggatcatatgttaattctgtggttaacattttaaggaattgccaagctgttttccaaagaagcggccccattttacaatcctaccagcagtatggtagagttcatgtttctccacatcttcaccaacatttattgttcatcctttttatttagtcagcctggtaagaccaatgatgctgagcatcttttcatgtgcttatcagccatatgtgttttggagaaatgtttcttcatattctttgcccattgtttaattgggttgtctttttattgttgagttggaagagttatttatatattctaaacatgaatccctttatcaggtacaggatttgcagataattttctcctattctgtgagttgtcttttagtgatgccctttgaagcttcactaattgtaattttgtaaggaacaaatgtaaattttataccaggctgcactttttgcctgttcggttttggattttcttattgttggtatcattcatgaaagacttagcagcatttcattggttaaagctaacttcaattttgaggaagtccagtttgtctttttttgggaggtcggtcacttatgcttttggcgtcatagccaagaaaccattgccaaatctaaggtcatggatattcctttgttccaagaattttaaagtgttagcaactacacttaggtctgtgatcttttcgagttaatttttgaggtctaatttctattaaaagtgatctttagtcaaggatattgaagtataaagctaaaaaaaaaatagccttgatttttctaaaatggactgtgatactcagctctgtcctgtcaattactagtcacaggatgctaaaattataggtttagttttttaagggaataaataaatgcctcaatctcaaattaattttgctctgaaattgagctgactactaagacgagatccaatttaggaagtgttttgacattacccccagtgagcaatttgagaagcacataagcaaaaataagaaagcattcatgtgggctgcttcatagggtttttttttttttaagtgttgtattcaaccttatgagaaacacttgaaagtatgcaacttgattgtctgcccatacatacatatgttcggatgtgtaggtacaatttctgtagttttactcagggagtaagtgatgtatctcctcaggttcctaataattcccttttcaaaaatgaataaaataatattagatacctcatggggttcttgtgaggattagaaaagtttattaaaagggttggaataaacctgccacttagtaaatgcttataaactgcttactgttattaagtattccatttatttatcctgctatttccagtacattttagccaccagcataatcagtacttctcacttaatgttaaatactgctatatttttgaattattgtataaatatatgctaattatgatttttgcctgcagtaaaggaataataaacagttctcatgaataacttaagtctaataatgtttttattgttttataacatatttttcatctaattgtaattacttaaattcagaaaagcaattgtagaactgggtagcagagtgttttggtgtgttacttgtcctgaatcacgatagtttaaccaatgaaatgatgctagatcttctgtgaatgcacccaaaataaaaagcaaaaccaaatgggcaaaaatacagtctcatataagatttacatttgttccttataaagaatctaaggtatttttattttttatttttctttttttttttttggagacagggtctctttctgtcactcacgctagagtacagtggcaccatcatagctcactgtagccttgaactcctgggctcaagagatcctcttgcttcagcctccagaatagcagggactacaggtgcaagccaccacgcccagctaagttttatattttttttgtagagctggggtctcgctatgttggctgggctggtctcaaactcttggcctcaagcagtccccctgcctcggcctcccaaagtgctgggattacaagtgtgagccactgtgcctggccaggtgtctactttctctcccagaccaaacaggagaaaagttctgaatttgaaagggaaactcatggagcattttgaagatagctttaggccaattatgagtcagtttttctagcttggagttcaaggagcaaagacggtttgtttggatggatgacctgtggaaggactaaatccacctggtggaaggttcaggatgacaaccccatggacatccaggtagaaatgaaatgaccactgggcatcagcatgagagggagggccatgaagtttaaatttgagaggaggagaaggattggacaatcaaggttgtaaaggtagcttgaggccagtttggacttcattccatatcttgctctattctacaaggagtcagatttgcctatgaatgtacttatgtagcatggagcagcaaaatagatgtggatttgctaacacataaagctaaaatttaatagaccatccccactgtcttccaggttttcaattttactgccctgcttgctggcttctaagaaatagtttagcttcttttaccatcactttttagacattctgtgatttctctctgacctgttgtttccaaagcaacagcatgtggccagtcaaaataggatttcactcttgtttgtggagctctgtagtaattaggaaaggattcgaaactccatttgaaacggaggctggtaatacaatgatgtgttggatgtttctcagtggagaataaggtgctccaaaaccatggcagcaaaatactaaatgttgtgagagagatggtgatgtcttcctctgtttgtcaccattatgggaaacttttagatgtggattaactttgcacagatggagcggtgcaaggcaaggaaggttatcctgggggagctgctttggtggagaaaacctggtgtcctgccaaaccttggccttcagagtgaccctagggctggtcttccacattgtggaagagacagacctgctagtcttgtgatctctactcgggggcaatgcactgaagagaaatgcttttagttttgagtaaagagatagtcattaaatattggcttcagctattatttatttatttagacagagtctcactctgttgcccaggctggagtgcagtggcacaatctcagctcactgcaacttcacctcccaggcttaagcgattctcctgcctcagtctcccgagtagccgggactacaggcgcgtgccaccatgcccggctgatatttgtatttttagtagagatggggtttcaccatgtcagccaggctggtcttgaactcctgacctcaagtgatttgcctgcctcagcctcccaaagtgctgggattacagcaggccactgcgcccagctgccatttatttttatttttataaaaatatgtgtaataataagacagaaaaaatagggagtagacaaaagaagtaacttaaacatagtggttctcaatcagggatgattttgcttcccaggagacacctgacagtgtctggagacattttttattgttatactggggctggagggctgctactggcgtctagtgggtagaggttagggatgctgctcaacatcctgtatgtactggacagacacccccccattaccaccaacaagaaagagtgatccagcccaaaatgccagtagtgccaaggctgagaaattctgcaagaatccacccctaacacataataatcccacccctaattgcgttatgatggtgtattttctttcattattttatttccacattatacgtaactgtgtacttagtttttttgtatctggttctcttcattgagcattatatcctaacagagtaattttgtaattttcaaaatttttaaaattcacacatttctctcctatactacatatattctaatttactgctgttgtgaataacctgtaatgaataactttgtgtatttggcttttctttttcttttaatttctagttatttcttaagggtagtatttgtaagttgttcatattatttttctaagtggtgaattttttatgattctcgacagatgtttccaagttgctttccaaaggcatggtactaatttcagtgtcatcaacaatgtatagactttctgtttgcttgtgtttttgcctgcataaagcataaagttactggggaaaagcctatttttttttttggctaagtcaatgggcaaaaagtagtatgtgtttgattagtaatgcttttgtgtgggagaaacactgttctgatcattgtcgtcacaaccctcagaagtcatgataaaaccatctgtttctgtttaacaaaggctctgagagttattctaggtcagtggaatgatgcctttctgtacttactgcgaagaagtttattaagataaattgcgatagtttcaactttcttggagtacttttaaaagagcaagatccactcagatcatcatggaaaatcctgtcaaactctaagaaaattgtctaggaggccgaagtgggtggatcacttgaggtcaggagttcaaaaccagctaggacaacatggtgaaaccccatctctactaaaaatacaaaaattagccgggtgtggtgatgtacgcctgtaatcccagccacttgggaggctgaggcagaatagcttgaacctgggaggcagaggttgtagtgagccgagatggtgccacttcattccagcctgggtgaaagaacaagactctgtctcaaaaaaaaaaaaattgtttttgatgaagccattaatgttatagttaaaatatatttaggtatgctaggactccattgcactttcctattttttatgagttatttgtgtatttaatggggcacctagcactatgacatttcatatatgtagaatatatatatatgcttgacacacggaatgctcagtgaaaatgtattaaatatgaacgaacaaacttctgcccgcactttagggccaagagtataattttctgctgtaatgatgacagagagctatagtggagtgtgaccttttgatgtactgctggtcctgattatagtttacttgactttgaaggcttgatcaggaataaaacctccaattatatcactttttcagtggcaaacctgttttatggagtagtgatttgtcttgcaacagggctttggaaactcattaaaaccagggattttctcgcacatttcctaagagaattacaaatatgaaaagctgtggataaaaattatctgatttttgaagatttgctcatttttagaataaaacgttttcttatattttcatatcatgttttctaaatttttattctttcttgagggaaccattccaagttgtacaagtacgtttctttaaatatttgcatttgacaatgactcccttctctggttcttctaacaccttaaatgacttttttttttttgagacggagtctcgctctgtcgcccaggctggagtgtagtggtgccatctcggctcactgcaagctccacctcccgtgtttatgccattctcctgcctcagcctcccaagtagctgggactacaggtgcccgtcaccacacctggctaattttttttatatttttagtagagacggggtttcactgtgttagccaggatggtctcaatctcctgacctcgtgatccgcccccctcagcctcccaaagtgctgggattacaggtgtgagccactgcacctggctgactgttttaattactagtatgtgtccgtaaatgcctgagcaggggttttgagaactgtgccttcctcttctttgacttttaaaactgatttcttgtgcagtattatctttctgaattatgtagcaattttgctttacccaggattaggtgtgctcctctgggttgggtggttgtgtagtacatcatgtgatcagacagcaggcatggaccaggacggtccctggcaggcactgtgtggggctcaactccttccttcccttgtcttaccttactcactggagcatttgttgctttctctcctctcagcccatcaacctagagttgagtaggaaagagtgcattgaatcaagtatttaaattgctctgatggttttgtatgtgctatagaaggaattcgaagacagtttactttttgtcattttcatgggaatcaagaacctcatttaatcagtagcctggtattagttctaaatcatccacacatagatgtggggtgattttggtcatgttattttatagggcattgcccttctcctccagccaaaatatttgtaatacaaagcccatgattctgtcctctctctgtctctggtttcattgataaacttgtaatattttttataaaaactcttttaaaaattaaaaatagatcctggtatggtggctcacacatggaatcccagcactttgagaggccgtggccagaggattgcttgagcccaggagttttaggccagcctggccaacacagcgagactcttcctgggcaacatagacgctgcctctacaaaataaaaataatacttgatagaaaattcaaacagatggaagggcacaattattttttttccgagacggcatcttgctgtgttgcctaggctgcgtggcgtgatctcagctcactgcaacttctgcctcctggggtcaagcaattctcctgcctcagcctcccaagtagctgggattacaggcactcaccaccacacccagctaattttttgtgttttttagtagagatggggttttgccatgttggccagactggtcttgaactcctgacctcaggcgatccgcccacctcggcctcccaaagtgctgggattacaggtgagagccaccgcgcccagccaggcacagttatttttaagtttcttttcccatgctataggttcattttgcagatgtaaccgcttttgaagtctcgttgtgtcgtttaagaactgcttttgaggtatctctgccctacattatatcatcctacagttctgagacttgcttttttcattaacagtatagatcttggacctctttcaccatcagcacagagacataacttattttgcaattgttcagtagtgcttcgttgtgtggatgtgccaaaatttatttaagcagagcccagttgatgggcatttaagtaaaaaacatgccgtgttttgcctttttaaaacaaagctgcagtgaatatcctttgactgcctggatttgaatcttggctccagcagttgccagttcgtcgactctgagcaagttgctttatctctcatgtctgcaggtttcccctctgtaaaatgggaatattaataatatatgatgggtatgtagaataaaatagccagtgcatatgatacccagaataatgcctgggacacagtgagtgatcagtgatcattagctctgtatggctgcctgtgcctttgcacacttgagagtaagtcagtcaaataaattcctaaatgctgaattgctgggctgctggttcaaaaaatgtacaattcaaattttggtggatactccctgttgccctacacacattataccaagttattcttccactagtaattaaacttttaacctctaaaagccttttttttttcttttaatgtaaggcttgaaagcaagaacattccttcattacttcctcctacttatctttactcttggccttactacgtcatgacacatcttatgaaatactggtgtgataataagcactttgtgcagccctaccatggaagaattggtgaaaatgtaaaggttctcagtggtcttcagacttgtgtttgagtttctctcttgcaacaaggtgcctgactaagagagtaaaggttacttcctgcatgtttaatggggcttgatatttgcatatgggcaggtacatcctgcttaatgaacagtgttgggagccatgtggatgattgacatcaacttgtagtacaacaggaaaacattcctagattaatgttccttttcactgggtagggctagagggcaactgcaacgagtgaaatgctaggctgcaggtagatggcttgtcttgagctatgaataatatgtttggcagcagcatgggcagaaaagttgagatttctggatacaggacctggtgaagcaggttctgtcacagggtcagatcacctctaacacctggccatccccagtgcaaaggaaaactaggagagagagaagtgagtataagaggcagctgagggactcttgacaaagttgagaaggatctggtgtcctgggagagctcctgtcttctggaattagtgatgcatcttttgtggaggctcctgatggctcagtaaaaggagcctttcatcttgcccttcctacagggctgagaggggaggggttcttgggacaagtggcttttagcagagaacaatagaagccgtaggctgggctgtcacttgctttgctacttcttagtttgtaatcatcctctgtgtgtccctgaaagtcccctggttctctctaaactgtggggctccaactgaattcctgtctgctccccaggggtgccccgcagcagttagagcagcttgttgagaaggagccgcaggggtagggcagaggtggaccggaagccggaggaggccacttgacatggcgattggagccctcccagcctgtgctttagacctgccagattcctacccacctcaccttggagtgggacatttcttttcacagtgcccaggcttaactatgctgtccccgggtccattcccaactgttcctattcaagatgtctagacctttgttccctgccttggcattttcctttcctggtgtggagtatctctttttgaaatagctatctcagcttcaacatagcagagcggaaaacctatgtctgggcttgaggcagggggaggaaaccgtagatagatccaggaatggccaaagtaagcagagatccgtgagcctggacgtgtcatgacataacaaggatatgtgggtgggaggggcagggatgacatctttagctttctgtgaaatcatagacatgctttcattattttgtagaatcaaataattttgaagatagagatatctgagtccatcgatacttacctctttttttttttctttgggacggagttttgctcttcttgcccagactggagtgtaatggcgccatctcagctcactgcaacctccgcctcccaggttcaagcgattctcttgcttcagcttcccaagtagctgggattacaggtgtgcaccaccacatctggctgattttgtgtttttagtagagacgggatttcaccatgttgattaggctggtctcgaactcttgacctcaagtgatccacccgccttagcctcccaaagtgcttaggattacaggcatgagccactgtgcccagccgatacttagctcttattggccatagttctcttggagaatttggggaaaagtatgggcctctccacaccataagtatacatgatgtacttaccaaacacgtgcatgcaagtttaggggttcacaggccctggaggtttgtctgcacatctgcactgtggggcagctgcaccttcctatacacaaagacccagggtcgtggagagacggcacttgtgtgggtcacagagttggagacagtgtaccagaagtcattggtccgcagagccgtgtcttgcattttatactccagtacgttgcttcggtgggaagggtgacctcattttttgtttaattcgaagacctcactgggaaagaaacacatagagatgtggaaggaaaaagaaaaagctgtgggaaatcgtgaattcgtggacattgatggtgaaaggttcatttcaacccttgatgggaacatcgtgattctgtttaagaaacagcatcatgtatatgcctttctaataaaacggcgcggcaccttcccacgcaacttgcagccacgaggttaaccagagataaacgtggctttccttttccttacatcttcctgcaacacccttcacaatagcccacaccaagagagttcttagggtaaatatctgtggcgttaaatttcactttaatacagaaaggctggccttgaaggggagggaagagaggagcacgactcacttgggcctcccagaggcaggcttgaggacctctcctgcagcgtagtggatggggaggaacagcacgcggggttcaggctgaccgcagctagactcctggggggtctctagctctgtgaccagagtggctctgcctcagtagcctcccctgcataaggacacctttgcagggatatcgtaaggaatggagagactgtattgaaaaatatgccggaagtatctggtttctatggggccctcagatgatggccagcatcgtcttcaacaacatctttcattgtcatcatcattgctgccatcgttgtcctgggccaggatggttggcagtgagggggtctggcatgcccatcgtgctctgtggtgctctggtgctgtttgaaacatgcgactggttcttttagagattggctgaggagcatcaccttttgtgaaccatgctgatcaagttcatctattgtttgatgttggttgagaaaatcattgatcctaacatttcattcttacacatagccttaatgttctttttaagaaagagatagaagggctttgcccatgcaaaatgcacacgaataatggcttacccacttgcaaataatccatgtgaaaataagttgcttggaataacataaaatcatgaagaggccgggcgcagtggctcacgcctgtaatcccagcactttgggaggccaaggcgggtggatcacctgaggttgggagttccagaccagcctggccaacatggtgaaaccccgtctctactaaaaatacaaaattagccaggtgtgatggcgcatgcctgtaatcccagctactcggaggctgaggcaggagaatcgcttgaacccagtaggtggagggtgcagtgacctgagattacatccttgtactctagcctgagcaataagagtgaaactcagtctcaaaaaagaaaaaaaaaatcatgaagagtggacctttttgcaatttatatatatgttttcctatattctgcgatgcttataatcatgatgtaaactaatccttctttggctgcaatagtcaaaatatagttataggaaataatattgagaagaaaaatatattcctgagctaacaaaaagccatataggaaagaaatgaagtgtgtacagtgggctctcgctcagctttttgttttttaagaaacactccattttaaagagaaaggcccagccatttccacagatgtgtttctctctctgagctgtcagtagcatctgcggttattttctggaaaatggagaggagatgccatgaacttggatttcagagttcccctctgattatcaaattgaccctcttggtgatgaatcccaccattggttcccaaaaggtcataccttagtcactttttaattatgtgacccccctggggtgcacaaaaggagcttcatggggacttcatgggcctctccactgtctgcaacttgaagcctgatttgcaaagccatcggaagagaattccctatggggtgagcagccatagttggcaaacagctccaccaccacagccttggagagggagggcggtgcagactgacccatccaaccaagccaggagtcaacgctggggccatcagcatgcgaagcaaaggaaccaagtagcagaggaaactcagcaaccccaaagagctgctgagaagaaatcagaccctcctgaagacttctggtgcagtccactgctggtgtaaagagagattttccattttgacagatcccatggactcatcttcagcaaaccattgggcagggaatcaaaagtcatcataaagacctccgggtatttttctacatcagtcccctgcgtgctgcgagtcctgaaatggagcttggagagcagcgggtgggaggagaaggttgtcgtccctactgtttttgcttggattgtttcaccctgtccccacacgtggacagattcagccgggtgcttcaagacatcattcaacttgcatatactttgttcgtttattacacaaatatttactggttgtgatgtgatctttgagtgctccttggttcccccttcctcctcctccaagaaaagatggatgttcctctccttccttacacagctcctcctcacctcccatccaaatgccttatggcatctccagtggtgtcatctgctccacattggccaagggtcggtagggtcaggacagaggcctgttcatcacttcatctgcagcacctaccacagtgcctggaggtggaagcttaaacacttattggataagaagtttccgtagtcctcttactcaaccactagatggtcacttagtagccaaaaccaaaaccaaaaaacaacagttttttactttattggacaagcactgattgagccccttctgtttgttttttcacttcaaaattattttctttcggaaactttcaaacagaaaagttgaaagtacagagcaatgaacacttgggtattcctctgtctggatccagcaactgttaacaactcggcacacccactctgtctatctccctccctcccctgtgtgcacacacacatgtgcacagacacagcctcctcttgcgctagatcatcggaaagtaggcaccccaaccctaaatatttcagtcttaggaataagatacgccattagaaactgtggttacaggccgggcacagtggctcacgcctgtaatcccagcactttgggaggccgaggctggcagatcacagggtcaggagatcgagaccatcctggctgacacggtgaaaccccgtgtctactaaaaatacaaaaaattagccgggtgtgatggcgagcgcctgtagtcccagctacgcaggaggctgaggcaggagaatggtgtgaacccgggaggcggagcttgcagtgagccgaggtcatgccactgcactccagcctgggcgacagagcaagactgtgtctcaacaacaacaaaaaaaaaaatgtggttacagaggactacgtgctttgggagtacagagtgggaaaagttactttccaaaaaaaatggaaacaattagaaatggtttctttgagaaggtaacacgtatgctgtgccatttgcatagataccggtttacagtgtttgggtctaaaactttaacaaaagggaaaagataacagtctttcaaaaagcttactatctcctcaaaaaactcattcccctttacagtatttggaggtttgatttttatgattcctctgtggttttgtaataaccacacttattatttccttagcttctcgggctgtcattgaaaaagtgcctttaattttgcttgcatttactagtaagatttattcatgtgcagaggggccgtgtagaccagtgaggtggtgtttagtcagctgcatccgccttgctgtgcgaaatgctggtgaaagctcagtgacttggagcaacaccaaaattcaatttttgcattttaataatagcttaattttgtgattatgcttaacaattctatacatccctaaataaaagaaagtataggccattctaagcagtcagaacttcagctttttctaccatataatggagggttttgctaaatttaaaaatgtgtccttgaagctgaaaggccacctctgaggcactctggggagagtgttcgctttccaacagtcgggaagcaagcaaatggcacacaccctagaccagtgagagaaaggcacttgcaggcctgttaggcattttgttggctaaatagaggggaaatgatggaaaacaaatactgaatattggtttggggagggaatgacaacagcttgtgtgaaacggaggtgattttaaacataagccagtgggtttcagagcacaggctatggtgggaagtggtggggagggggaagcttagcaaatctgggtattggttttgcctgtttttaaaccccctttggagtctagtaaggttaaccactctggttagttcagcgttctaacaggtgactttacattggaggaagatgttcagaaggcgtggaagacacatcttcgagcagccccagcttctgatgattttgttcatctgggttgcagacccaatctgtgtcccagggactgggactggccttcattaccttattgacatgcttctcccggacacacacacacacatcacatttgcagccatctcaatttagtagaggaattacacataaccaaaacactccccaaatgtgtgctggagaacagctcggagggatgggacggcctgtcgtttcctgacgttgactgacttgagtgcaagaccccagagcctgggtgtgtgcagagggcggatagcacatgggtccctgcaggaggcctctcggccttcttccatgtgtgtgcacgtgtgtgtgtgtgtgtgtgtgtgtgcgccgtcaaatgttggagcttctggggaccaccccaggaaccctctggacaggggtgtctagcccaggcctgagtgcagcgccctccctgagggtgagggttggcttttaaaagaggatacctttggctgggcgtggtggctcacttctgtaattccagcactttcggaagccaacgtgggcagattacttgaggtcaggagtttgagaccagcctggccaacatggtgaaagcccatctctactaaaaatccaaaaattggcccgggcatggtggcagacgcctgtaatcccacctactcgggagactgaggcacgagaatcgctcgaacctgggaggcggaggttgcagtgaactgagatcacaccaccccattccagtctgggtgacagactgagactgtctcaaaaaaaaagaaagagtgacacatgaaataaggggcaagaggttctgagggagaagccttagaaaaggcagctctgttcttcctagaggagtcttagtttagcattttaccacaaagaaatgtcttttttttgaaagcagaggcccacagaagctgtgacatggctaagcttagctgtcccaggccaggatcggaactgggtgctcatctcacacctccacacccagcactagcccaaggtgggacccatgaggtgtgcttgggcacagttagggagaaagtcaggatggattggcaggggaagattcacttccgaagtattggcttagcagaggagctggctcactgggggatgagactcaccgatggcagtgtggttatttatgtataatcttcactcatcatttattccctaatcacgacatcgggcacacctgctgggttctaggtgctgagtatttgacagtggataggacagtgaaatcctgttgtaaaggggcttttcttctgtagtattggggcggatgggacccataataagtaaaccccatgatatatttaggctttgtgtccccacccaaatctcatcttgaattgtaatccccataatccctatgtatcaagggagagacatagtggaggtagttgaatcactggggcaggttcccccatgctgttcttgtgatagtgagttctcacgagatctgatggttctatataaggggctctttccccctgctgggctcttctccttcctgctgccttgtgaagaaggtgccttgcctccccttcgccttctgccatgattgtaagtttcctgaggcctccccagccatgctgaactgtgggtcggttaaactgctttagtttataaattaccctggaaagtctcccactgggaaaaataattggaacaggcagcatgactatttttagcattatttcaatatgggtttaaacttttttttaaattgaatattgtaactattaagtttaaacctaaggatatagttgctaagtatagttcttctctcactatgatttaaattatgttataaagaactggcagttctttatagcagtctgaaaatggactaatacaccccacaaaccaacaggaccgtttcagatggtgatgtgaactctaaagaagataaacaatgtgatgatggcttagaacagcagagtggaatggagatccaatgcaagatgtgcaattttaaatattctagtagccacattttgaaaagtaaagagtgagggaaactaacttaatgtaacttataaccggtatgttcataatgttaccattataatatatataaataattgagatattttgcattttctttgcattaagtcttctaaatctggtgtgtattttatacttagagcacacctcaacttggattaaccacatttcacatactcagtaggcacacttggctagtggctttggctagcacagacttagtgcttgggggcggtggtacaggtccactttagattgcatggttatctttaagaaaagtcctgttaactaagcacaaggaacagttcctaccactgatctatgttgtgttttgtttgctgctaatgtgctcatacatcaaggtaaattattattttaatccagatttcagctgattttttaacagcagttttgctgtgtgcacgctgaatgggattctccaaggacaggcaatgagaaatccttcaacattataggaggagacggtggagagagatccttatagtctttgagagaaggctttggggtttccagggcctacattttgtcagagatcttctttcctgtacaggaaagtaggtgttgcaggttccttctttttcactctttccttaattatgggaaggaattccaccaacattgatgtttaacctggaaagtctcccactagggaaaataattggcacaggcagcatgtctgtttttagcattatttcaatatgggtttaactgttttttttttttaattgaatattgtaactattaagtttaaagctaaggatatggttgctaagtatggttcttctctcacctactcagtctttgggtgggtgaaatgctacttgttgaatgaaattagaataatttccatctgagtttttcaggttcagctgcaaatgcaggagttggtttagagtcagtttatgaaggaagttttggaaaacattagagtattttgtgtgtgtgaaaattagacttgtgggaaggagtgtggtaaaaactgctagcaaacactaggcaaaatttttctaaaaatcatttgccttttccttcacgtgtaaaagtcatatatgttctttggagccaatttgaaagagaataaatcatccataatgccatatctttacagtcttttttttccttgtacctttagatgtgtatttggtaatgtagtttttacatagttttatgctgctttttacacttgtcatgtgtattttcacattttcttattttttcaagaatttagcttttaaatggctgtgtaatatttttccttgtgaatgttctgtcattcattctctctcttttttttttttttcgtgacagagtctcgctctgttgcccagactggagtacagtggcgcgatctccgctcactgcaacctctgccttctgggttcaagtgattctcctgcctcagcctccaaagtagctgagattacaggcacccgccaccatgcctcgccctgtcattaatttaatctttaattcaccctctattgttgttttttatttttcattattataagtaatgctgccatgaatacctttctacatacatatttatatgaatatctaattattgcagtaaaaactagtagaagcaatcattcagtcaaacaatcaagacttttttttttttttttttttttttttgagacagagtctgtctctgtcacccgggctggagtgtggtggcacaatcttggctcactgtaacctctgcctcccaggttcaagcgattctcctgcctcagcctcccgagtagctggggctacaggtgcctgccaccatgcccagctaatttttgtatttttggtagagacagggtttctccatgttgccaggctggtctcgaactcctgacctcaggtgatccacctccctcagcctcccaaagtgctgggattacaggcatgagccagcatgcccggccccagtgtagactttttttttttttttttttttagggcttttgatatttgttgccaagttaccctctaaaaacctagtgcaagattacattttcacccctggggtgtgagtgccttttgccccacagtctagaccatgctggatttataattttaagggaatttattaatttgttagatggtggatgtgtcattttgatgcaggactttaaggaagaaaagatatatctttaaaaacgttttctgtttttcttttttagcttgtcttttggagttcttgcctttgacttaagggcaaatgtcttactgagagatgctgggtgcctgggtcacaggtggtttgtcgttgccctttttctttttttttccaactcagctaagttcagcactagttttgtgacttattacacagaagacttgaatacatcaagggcctctagagatttgtggtaacatcaagatgtgtagtctgtaatgtgtcatggggggtgtgagccattcaaggggagttactcttaatggtaccattattcaggatacagtgctgatgcctgcatcctgatggcaccactgtcgtccaactctgtttgtgacattgttcatggcctctgcagagtcagggagctcctcaggataaggctctgtgacatcgtctaaactccaaagaagtagagccatcatatttccttccccaagggagctggcatctaccatcactgaggattttttgagtctctgtaccaggacatggacctcaactctttatttccatgattaatccctatgtcaatgtacatggcaaatgctagcatttccttcattttattgacgatagaatcaaaactcagagtgtttaggtaatttccttgaaattacacagccaggaatggccaaggctgggaattgaatggactccagaacccatggtcgaagtccaagctcaatatctctgagacctggaaggaaatgaaacagactaaaatcagagtaacgcttaaaaccatgaagattccagcccacagattctatctgccacatgcagacacgatttatacccctagagggaaactgaagaaacaaggtggtggtcatacaataatagactcaaaacccaaccacacttttgaagtgaatagtggctcatgatggctttaaacatcttaggagaaaaatcaaagttggtgatgggctaatttggaagattagctgaaaaagttaagtggcaaagaactaagtgatagttggagtgaggaaggcattttggtgtggagagagtaagattggggaaggaaagctccctgggtaactgtaggattagaagctgtgaggagtgtggtttaatcagacaatttggaagcaagacagagagggaacagtccccatttggagagtgttagtgttcagggtaatcagaaaggaagagtcggaagcatatgtaattaatgaacgagaaaggcagatggatgatggggaggtgggtggcgtcgcgctactcatatgttcttttgataagtaaaattatagcataatttctcactcattggaaacaaggttatgcaattaggatcctgctgctgctaaaagcttccagagattttagtgcactgggcagacagagtgatgatgtttactttaaaaatcgaacttctcgtttgagatacttaattttatttaatgctcgatttttgtatttactggttctgcattttctcatgtagattaagatccaatttagagaagaaatatatgggcagtttggctgtagaaagcacagaggaatgatgctgtggatattgatgcaccatgtggtagacagcattttcttttcttttcttttcttttttttttttttttgagacagggccttgctctgtcttccgggctggagtacagtggtgcgatcgcggctcgctgtaccctcaacctcctgggctcagttgatcctcccatctcagccttccaagtagtgggacaccatgcccggctaatttttgtatttttttgtagaagatgggatttcgccccattgtctggtcttgaactcctgagctcaagtgatccgcccacattggcttctcagagtgctgggattacctggctgacagcatttgttttaaagcagtaaatgaaaatttgggtattccttttaagtttttcaaaatttcaatctgcagtttttaatctatacaaaaaactgtggtaaaagacgcctaacataaaaattacaatcttaaccacttgcaagcctacagtttggtagtgttaagtagattcaccttttgaaacagacctccagaactttttcatcttgcaaaactgaaactgtttgcctatcaaacaacagctcttggtttcctcttcctcctaggctttggcagttactattctactttgtttctatgaatttgactgctttaactaactcataaatggactcatacagtatttgtctttttgtgattcgcttgtttcacttagcgtactatcctccaggctcacccacattgtagcatgtgacaggcttcctttccttttcagggctgaataatataacattatatatatggatatgtacattgaatatcccttatctgaaatgcttgggatcagaaatggttcagattggggatttttttagattttggaatatttgcataattcttccaggttgagcatccctaatccagaaatctgaaatgctctaatgagcatttccttgagcatcatgttggtacttaaaaagtttcgaattttggagcatttcagatttcagatttttgtgttagggatcttcaacatcattctatttttttaatctgtcaatgaataaaattacagttttaaccacttgtacacatacggtttggtagtagtgttaagtatattcacctttttttgttgttgtttgagatggagtctagctctgtcgcccaggctggagtgcagtggcacagtctcggctcactgcaacctccacctcatgggttcaggcaattctcgtgccttagccacctgagtagctgggactacaggtgcgtgccaccacgctcagctaatttttgcatttttagtagagatgcggttttgccatgttggccaggctggtctcaaactcctgacctcaagtgatccccccgccttggcctccccaagtgctgggattacaggtatgagcaaccatgcctgggttaactatagtcaccttttgaaacagacctccagaacttttcgtcttgcaaaactgaaactgtctgcctatcaaacaacaactcttcgttgcttccacctcttggctactcttgagtagtgtggctatgaacacgggtgtacaaatatttctgagaccctgctttcaattctttaggatagatagccagaattgagattgctggattacatgatggttctatttaattttttgaggggcttctgtacaattttccattgtggttacaaccattttacagtctaagcaacagtgcacaaaggttccaatttctctgcatcattgccaacaccttttagaaacagtagccatcctaatgggcatgaagactatctatagtttattatgtcaagcttttcttcatggttataaacgaatattgtgatgagtgatttatctatgtttgctgctttactccccaggggaggatgagtataccatatatgtccatattgatacctatctcagaatactggttgtacaaaactattccaggcattgttcttctttaagtatttggggtgtttctttttgcttataatttagtacaaatgttctcagttcagttaataatgagtcctactgtgtggcagttgagaacatgaagataaccagaacacagttcccgccctcaagggactgatgagaagtagccacgttttgtaggaacgggcaaatgaagtggcaaaggaaggtggccatgggttgccataggagcgcaggtgagggatgaggaaaggaagcactaaaccaggtcagcttgtgacgtgggataaagaaggcttcttgcaggtaaagccagagctgaatttggaagatggtaggagttcacctgctaacctgggaggtgtgagtggagtgcctgcggctggacccactttgagcaattggaaagcctgtataggaaaccataggtgacatgatgccaagtggacatgacattcagggagatgataggcagaaggtgaggccaaagaagttggctggatgtatgtcagagaacgtggtttttatgcaatcattgatggaaagctcatgacgcattcagtgatgtggacggctttgtgctctctgcagaccactctgagggcaatgtggaggtggaggcagagagattaggtaagaggtttttgtgaaagttcaagtgagataaggaatgaactagggcagtggtagtaagaatgaggagaagggagaaaacctgccaaatacttaaaaaaattagcagccatatgccggttaagtgtatgagtggtgagacagagggaacattgaagataacccacagatttctggcagtggttccgtgatctgaaattaggaatataagaatagacactgagggtggacaggatcaattcccttttggacattttgggtttgatgtgtctgtagaagacacaaatggtgatgtccagttcaccttgggtttgtgagtcaaatttgacagattcagatagagacacactcttggttcttattagatgtatgcagtagttaaaactatgaaagcagatccatcccctatgttggaggggcacaaagaaaaggagcagcccaccaaggagctggagaatgagaatcggggtggaccaagagggagtcgtgtctcaggggctggggaaagtagaaaggttccagaatgagtgagtggtcaggaacttcagatgtagcaaaagaggtcttagaatgtaaagatggagtcacttggcagtgtcaagatacaaagactgaataagtttggcagcgtggagataccaggccgtgtgaagatccttaggacctttgtccaggcggttttaggagcttggtggttgtgggaaactaatttcaggtaaatgtttataatggcagtagagtgactatggagtactccttcaggaaacttagaaggaaagagagaaaagtgaaaaagaggccaagaaatttttttttttttttttttttaaagaatatgagagacttgagcatgttacagggcaagggaagaggttgttgataattaaagtagctgacattttggagggcttgctccatatcacctacatccaacagctgtatatcaaagagctcatcaaatccatccaacaagtctgaggtgttgggacaattactgttcccagtgttatgaatgagaaactgaggtacaaggatgtcaagtggctctgggtgacaccagcaataagagagcccagtttctcataacctgtgtagatgtcaccatttaccagagcactgagatgtttgctggttttgagggagaagttgaagatttagggtaaagaaggaataattcatagaaccaagttctagaagacactggaagagatgggctgaaagctttgtgaaatttgtttttttaaatgaagatgaaaagtttaatcataagggaaaaatagggacagtaaacagagttggatagagaaagctcctaaatattggagcctgtcctggctctgcctcctgcaagaacagtggttttggtttcttttctgcacaaggtggtccttttagtcacatttattgattgattggtttctttattatcacggtttgagctgtcattgagtatgtgacattctgttattttaacagtgttatattaagaatctactctatgtttgggttattttcagtccagtgacttaaatgatagcatgccctccattcttggtgacttgtgttgagaaatcttatgctggggacatattgaaattgttgcaatgtggtttaatattacatgttttaaaagctaagaagctcctattagtctctgaaatatacctggtttccaatttagtctacaaaggagatatcattcctgaccctgatttagtgggagagacagagatgcctatatattggatgatgtattattccatacacacctacatacacagctctgtaatgtttaggaggcttcaacaatgggcagatagaaacctgcagctcctattgcattatagctcctaaataaggtgttagcatgattatttatgaatttaccctgtgagctataattcaaatccttggccaatcaaagggaaaaataaatcactgggagtagtgttttacttaaaacccattaaagcaatttaagtgaaagtttttttcaggtatgaatacctagctccctgcaggagggcaaatgttgatgtagggatatctttattaatagtcttggtgaaactgaaggagaaggcatacaatacagtctttcacagaactcagcagtagccataaatccatttatgaacagttcaagtaatagagctttgaagcataacattagttttcaataatgatgttattcttttaaaaaatcagaggtttaaatgtaatgcatggggaaatggggcataataaatttgaataagtaagcattacttttcagtggatccagcagattccctttttattttatttattgttcaggttgttgaattttgtttattcaaatagtaaatgagacatagtccagggaagagccctttgcttatgctatatgatttaaggccagctgccgtttttcctgagctacatacgcttcatcatgttggaggaatcaacttcaaaagtcagctggctgttctgcagacaagcaccagacttgttattcaccctgaatcctcagccttagctccccaatctctgttgcacagaaaactacaattcctgggtgcctggaaagagagggacaaatattaatttgcatgacagtatcctgtgcaggacctcgtgctaggagaagcccaggaaatgtttgttggtagttttcactttgtcttgctagaaaagcctctacaggaaatctcctctgcttctaggaacgtcaaatttcaaataatcctggccaagtagctggttcctattcttgactccttcatgggggcggcggaggggaaagcttcctatgataatacattgcagcattacgctgcccaaagtgccaagggcggttgggtactattcttagtgtttatgtctttagttcttgttcttttacttacttatttttggcagattactgtttacaagcctcaggaagttagcagcaagcttgtcccttagtccttagcaataacgtttgagaattgctggaacctgtttgtcttgttagcaactacccaaatacgaagaagcaaggctgcaaggcaagcaccaaacttgttattcaccctgaatcttctgccttggctcctcagtctctgttccacacactcccatgctggctgctggaaaggatggtaggcctttttttttttttttttttttttttttgagacagcgtttcactctagtgcaggctggagtgcagtggcacgatctcggctcactgcaacctctgtctcctgggttcaagcatttctcctgcctcagcctcctgagtagctgagattacaggcgcacgccaccacgcccggctaatttttgtgtttttagtagagacggggtttcaccatgttggccaggctgatctcaaactcctgacctcaagtgatccactcacctcggcctcccaaagtgctgggattacaggtgtgagccactgcgcccggccaagagaggggtaggcctttttgatgggatggaaactgctcttcctgggatttcagcccgcccctatctctcccatcaggagagaaggcagagcacagtgattgtccatgggctggtctctgttcacttccccaaggtgccgacactgcgtgcactccacacgtgaggcaggtgtgggaatgaagctgcctgaaggccgtggggatttcacagctggtgaacctgctgtccctgaagtgccattacttaaacccagagttttctgctcacttctcattttattgaaaatggtgcattggcaaagtgatgttgaactggaactgacaaccagcattgtccctctgctttcctcagactaatccacgggctgtccactcccctgtgatgctctctggatcgggtccagcccttgctttccttggaaaacactacctatatttagtggtaccactagatcttctagcatccgttttctgttgctgcatattcattaataatagggagaaaaaaaaaaccaacccttgtgtaattgctatttgaatttcacagatagagtagacatttaaagatttagttggctttaaaatgtaaatttagaagttcctggtaggcaaagcatgtttctctaagggtttataatccaatcattcaatccctattcctttacacgtaaaattaatcctttccaataggtacaaatgcctgaatggagaagatggaaggttcttggcagatggctatctgtgctcttcattggcaattttttttttaacttgaaaaagtcaagcattttggtaggagaatatgctttgctggactctgccaagtttcttgtggctgtgttcctattagtgggcttcaggggcttcctgtggacaattattatggttggtgtggaggaaaaatggaatacattattttcatcttttcattaaaaaatgtggcttccttcccttttctccagccagctgtcagatttgaatgcctgccctagtttgctctgtcatcatcgagttagtgggttgagtgatgggagctggcagaagcccattagaatgattgccagtttccaaacacaccccgaatcccttgctacagatgtctaggaagacgggataacagaaatttgcctctgggtttcagtacattgatttcttgctcattttaattacaggtctcccattaaagaacggggtgggggagggaaagcagctttgaattaaaaatgtgacttatttatgggtttagttgctttactatgaagacttgctctaaaaagaaagtttcattggatgctcttaaagttctttataaaaagatccccattgtacagatgctgacaacattccatgaacaaaaggcttatctggatcacctaaaggtctgtctggaatccaaaataaaactggtgcccaggtggctaattatcactttctgtatcatgcctggaaaatacacagcctcctttgccaagagtctatggcagggcagaaaacgctgcccaggcagcttcatgtagcattgtagcttttccaggttttttttttttttttttttttttaaatgtcatagaaaagataccggtggatatgaatcctttgtgctgaagttggatggcagttagaacttaaaatttaaagaatgcattcgatcagttgggctaatccgtttgggtggttggagcctgataccaggtaggtaaaattacacagccatctactttcattcttttccacccatttgccatgccctgcactgtctgccaggtgagagagggatgtcagcttagtgcagagttttaccacacctggagaaaagagctcctgtctgcttctaagggactgcgaattgctggcaacttcttgatctgtagaggacacttcctttccaggaaatctaattttgagaaaacgattgcacttctaaagaggtctttcccgtgtgatctctagacactcttcgttgctttaaaatgaaagcctgggttttaatatttttacatcattgcatagattcagagcaactaatattttgcttgttcagtggacaccttgttgaagtatgagtaaatttgtgaattgtagtgtttagccaacctttttttttttcccattggttttatccgtcttaaaaaggtttggatctgtgccccacccaaatctcatgtggaactgtgatccgcagtgttggaggtggggcctggtgggaggtgatcagatcatgggggcggatcctttgtggatggtttagcaccatcaccttgggctgttactgtgatagtgagttctcggggatctggtggtttaaaagtgtgtagaatcttcccctgacacttgtgcctgcaagaaagcttgctccggctttgctttctgccatgattgtaagttttctgaggcctccccagaagccaagcggaagccactgtgcttcctggacagcctgcagtaccgtgagccagttaaacctcttttctttataaattacctagtcacaggtatttctttacagcagtgtgaaaatggactaatgcaccatctatgcattatttatttggacctaaatatatcccaggaattgtgctagactgaaaatatagtttgtatatgcacatttgaagttcatgtgattctgctactctgaaaaatgttttgcattttttgtttaaaaaaaaaaagtagatttccttttctttacagttaaattagcatattagtttaaaaaagtgttgtattttatggttcattaacagaattttacgattttctaacttgccaaggattatggtgtttattcttgaacattgcaagccccattgaaagtttggatgtaacataggtatagatttttatgtgtgtttcttagaaataacagataagcagtttaaaatcattgcttccataaaagctgaaattcgtctttttgaaataggttgggtaaggatttgagcatttatgtaatttgttgttggaaccacccatcctccatggaggttatgctcaattacgtattataaaaattggcattgacactaattcactttctgtatctcttttggatagatggatgatatacagcataagaaagatttactggaaaagatgctgtaatcaaaataggttgtccaaggcaactataggttgatagcgtgttatttgcagataaactgaaattttgaaagaaagaatatttggaaggaaaagaatttcaatccgattatccagtgtttttagaccttctggctatgagattgaattgactatatttcattgactgttaattaattagtacctttgtaatggtataatttagagaactgcattttagggcattactttagtctcaaggttgtcaaatattgtaacttgagctttgaaaactagtttgtaaaaatgagggaatacatttaatccatgtcaactaatttgaatcaatgacataaaatacagcttgggcattaaagcaccgtgtatatgtttgcgtgtgcttgtctaactgggactgtctatgtcaatcttctgttaccttatgcgttgtttggtttatctagctttttaaaaaattggttatagtcttacttcatgcatttttagcacaaatcttcatttcattttaccttcaccagtaataagagcagaaaaagaggtcagcaacaaataatttgctgctcattagttgagttgatgtgtgggaagtatagcacttttgattgaaatggtggttgtcggccgggcgcggtggcttgcacctgtaatcccaacactttgggaggccgaggtgggcggatcacaaggctaggagttcaagaccagcctggccaacacgatgaaaccctgtctctactaaaaatacaaaaattagccgggcgtggtggtgtgcgcctgtaatcccagctacttaggaggctgaggcaggagaatcgcttgaacccgggaggcggaggttgcagtgagctgagatcacgtcatcgcactccctccccagtctcaaaaaaaaaaaaaaaaaaaaaagaagaagaataaatagtggttgtcagttatcagaaaaccttaactttttggtaagtttttgagttacctcttgtaagtaaaggcttgagggagtttaggaagcactgtgacgtccactcatgaaagacagaatataccagggctgggatgggatggaggcagggggtgaataagacttaggggttcgttctccctttctcctcaggttcacttgttgaaagtcttggatgcttctgtgaggccttagggggtaccatgtctaacttgtgccttctctatttttgcatacaaggcaggtgacacctccttgtcttggactcctgtggaccatgtctgttccattgatgaattagcatttatgatagattatttttctagggatggaaaaacttaggaaagccaatgcctgttgcctgcattagtatacctgatagctctgtacaatatatgctgtcactctctcagatggattggaagtattagaaactatcaacctctcaaaattctgtatttgaaaatagtcttgtattttagatagataaaatcagaagtcttcaatattctgagagctccacatagaaatcagactcagggctgggcgcggtggctcacgcctgtaatcccagcactttgggaggccgaggtgggcggatcacaaggtcaggagatcgagaccatcctggttaacacggtgaaaccccgtctccactaaaaagtacaaaaaaattagccagacgtggtggcaggcgcctgtgtcccagctgagacaggagaatgtcatgaacctgggaggtggagcttgcagtgagccgagatcacgccactgcactccagcctgggcgacagagtgagactccgtctcaaagaataaataaataaataaaagagaagaaatcagactcagttagtagatcgtgctggtctgtcatcatctactttgttcactcgttcgtttgtgtgttcattcctttgttcaataaacaagtaccagctgttggcctcctagtgccaggtgctatgccaggcttggagtgaaggtgaggactggttcaatatctccccagtccctttcactaaactttatagcaaatatattaatggatttctaccttgggaatctctctttaattttataggtgataccaacagagattttttttttttgattaatgatttttttgtttgtgttttcattatttggggatgctttttcctatttatatgaggaatatttgtacatgatgaatactgtgaacactgcaaaaagatttcccatgaatgaactcacaaatggaaactcagacgtggctggtctgtgttgcttgtcactgaaaactggactaagtcattatagcttttccttgtttgagggatcttttgcagttgctgaaactgctaaataaacacttcaatataagaaaattacaccttagcttaaaaaatattgttatttttggtttctgagagcagttatataaatttccttccaattcattgacattgttaggtagttgaactttttgtttgtttgtttgtttgagacagagtctcactctgttactcaggctggagtgtggtggcgcgatctcggctcactgcaacctccacctcccaggttcaagcgattctcctgcctcagcctcccgagtagctgggactacaggcatataccaccacgcctggctaatttttgtatttttagtagagacagggttttaccatgttggccagactggtctcaaactcctgacctcaggcgatccgcccaccttggcctcccaaagtgctgggattacaggcgtgagccaccttgcccagccaggtagttgaacttttgaacttaaccagtaaattactttttcatgtgtgcgctctactctggacaggagtttgcttttgctttgccttagagatgcccttacccacccacagagcctgagtgagctgatctgtgcatagacttagtattttccatgtttgataattgtatatattctctgttaattctgtttttgttttgtttgttttgttttggggacagggtcttgccctgtcgcccaggctgaagtgcagtggtgcagtcatggctcactgcagcctcaacctcctgggctcaagcgatcctcctaccttagcctcctaagtagttgagagtatagttgtgcccctgtagcaccaacatctggcttttttttttttttttaagatagattctttctatgttatccaggctggtcttgaattcctggggtcaaaggatcctgccaaagtgctgggattacaggcatgagccactgcgcgcagccatgcttgcaaattcttaagtctttaaaaacagcagtctttggtcttttagacacacttagatgttttgagattatctgtgtacttattgttttgttaaaaaaacaaaaaaccatgaaaacccatcctgaagttttagtttgcctgccctctgggacagctattctcaaggcatggtctgtggactgccgggagtctacaagaccagagggtctttaaggccaaaccacttttcatggtagtacttagatgcttttgttgttttcactgttgacagttgcccgaatggtgcaaaagcagaggtggacgaaactgcttgtgtcttggtgtgagtcaaggcagtggcacagccactagcggccgtcctgatcttcccctcccaccaagtgcagtaataaaggaaaagagtcagtttcacttgagagtggccttgatgaagcagtattaatgtcattaaaccctgactgtgctgcagggattcttgtctgagcaatgggccgcctactttctggtaatttttgagaatattaaaaaaaccttactttttattactttttaaaaatattctttgtaataaaatgagaagtatggataaagtgcctctggacactgagagatcattatttttcaggaaaaaaaatcttttttttttttttttgagtaatgaatggaactagccactattttcatggaacatcacttttacttagtttaattaattaatttacttaagactgggtcttgttccatcacccaggctggagtgcagtggcacgatcactgctcactgcagccttgacttcctgagctcaggtgatcctcccacctcagcctcccaaggcacacaccaccacatccagttgatttttgtatttttgggagagacagtgtttctccatattggccaggctggtttcgaactcctgagctcaagtcgtccaccaggcttggccttctgaagtgctgggattacaagcgtgagccactgcacctggcctatttttaaaatttctatttatttatttacttttgcacttttacttaaaagagcgactgacaaatcagtttttcagacttgggcatttgtcagacgttttctttaaaatgaataaagttaaggtgtcacttcaagggaaataaccctgagtatttgtcctgagccccaggtttgtgaacatctgcccttggaaaatgggagagtccacactaggagctgcagggacccatttgccccacaaacttctgcaggggtttatgtctgagctatgtgccacctgctttctggtgtccttcctttgtgaatttcccaagcgcttttgacttactttagtagcgagatggctgtgttctgggtttgggttagtagtttcatgaagatacaccacccttcctcttcctctgatctgtaagagataggaaaaaaccaaagtgtttttcctattctaatccagatcacttcctccatggtctctaaaacgtgaggatttctccacaccagcagccaatccgttccccagcagataccagccattagagatgggaagaaccgaggcgttcttcctactctgatgcaccactcaacacaacacttcagataccagatatgtggagattctgcaccccccacaacacacacaccaagcaattctccagcagacaccagctgtgtagttcagttcagttctgacgctgcccacctggcagtagtgtcagatcccacaagttaagggctcagtcccaagagactactgcttctctcctcagatgccaacgtaaatcgccagattgtgacctgtgctcctgactgactgtctctaactttggcttcccatcaccccttctcaggctcagttcatctactagggcagctcacagaacttaggcaaatacttatatttgctgatttattataaaggatatttcaagggatacagatgaacagccagaaggaagagatgcacagtagggcatgtaggcaggggggtggagtatccatgccctttccagatgtgccagcctcctggcacctcagcaaccaggagcttgtctgttatgtagacatgattgattacatcattgaccattggtgatcaattcaacccgcagcctctctcccttccccagaggtcagagggtggggttgagagtttcagcctctaatcagatgattttcctggcaaccagccacctacgcatcaggagactattgaggagcccaccaagtgtcgcctcattagaacaaaagaagctcccattacccaacagattccaaaagattttgcagctctgtgtcagacactccggtctctcaggaaattacagagctcttatgagctctgtgttaggaactggggtcaaagattaagtatcagggctgggtgtggtggttcacgtcagtaatcccagcattttgggaggccaaggcaggcagatcactagaggtcaggagttcgaggtcagccttgccaacatggcaataccccgtctctactaaaaatacaaaaattagctgagcatggtggcaggcacctgtaatctcagctactggggaggctgaggcaggagaatcgcttgaaccaggaggcagaggttgcagtgagccaggattgcaccactgctctccagtctgggtgacagagtgagactgcatctcaaaaaaaaaaaaaaaagattaaatatgagaacgaaagatgcatataaatagatagggacgtaatttccctatctatttataagggtttcaggagctctacatcaggaactaaatgtataccagtgatatggtttggatctgcatccccacccacatctcataggaattgtgatccccagtgttggaggtggggtttggtgagaggtgattagatcatgggggtggatccttcaggaatggtttagccccatcaccttggtgctgtgagtgagttctcacgagatctggtcgtttaaaagtgtgtagcacctccctgctccctctttcttcctcctgcttctgccatggaaaatgcctccctcccgctttgccttctgccatgattgtaagttccctgaggcctccccagaaacgtgtcaccatgcttcctgtacggcctgtggaactgtgaagcaattaaacctcttttctgtataaattacccagtctcaggtatttccttatagcaatgagagaacagatgaatacaaccagaggccaaatacatatttcttattacacagcatcatactttgcttcacatgtgtataaccaaggatgtttttgcttgtcttatatggtatgaccagcttggcagtggatctaaccttttaggacttttgctactaactctgcttggtttctgtttgtgtgtgacaatgtgattcaagcagatgttatagtctggtgaacgccaggtgtactgtactggagaaaatagaaaaagtcaggggctggtttgatatcttgtggtcttcctgcatgtactatatgccaggagacttacttcatagtaagacatactatgaagccactagaaattgtttttaaagactagtttagtgacatgatgttaagaagagtggcaaggtacaaatgcctataaatagaccagaatgaaaatatacttaaatgtacctggagaaaaaggccagaaggaagtgcgccaacatgataacgtttatctctcggtgctcatagaatgagtagttttttttttctttatactcttccacattttccaaattttcacaaatgggcttggattacttttataatcagtaatttaaataaaccttttaaaagcacagcttgtctatatttcatagtaaagtctagataatctctgctgactttaaattcagcagtattatatacttaactatgattgagctaaaagatgctgtcattgaatttttaattttgatacgatgtccatttagaaaataagttagaacctcctttggactttttccctcagtgaacagcttatatcaaattagcatgaggttgattctgaattggctcacacttgaagtgaatgtcctttgtaattttcaaagtgatcagtgagggattagaagcttgctgtaaagtggcagtttacctacacttgctcagctgtaaattattaacttttggcccaaaggtagccctggaagtcctgagctattcattcaggagcacggtaggcagaggccaatgaccttaaaaccaaacggccagatttctaagcgcagtcttaaagcattcttctttgtttccacaaagatcaaagatatccttaaatcgatgttagagaaagcgttcaaagaagtgttcagcttcaaagaaaaaaaagtggtaagctttctagccctttccagctcgaagtgccctggggtctgttggtttctgggtaggttgggcgatagggactttgcctggttgccttttttgcgtctgcttcctcatctgtgaaatggggataacaacagtgcctgctcaaacttgttgggtggactgaatgaatccgtccatataaaatgcctggcacataagcactcatcagctgttgttataattaaggtcagtccttgaaaggcttaaagaaacctgggcaggaggctgctgtaagtgacaagccacccacactgtcaggctgcatgcattcccattcgttaggtgcctctttgggaattctggatactgactggcacacagtgggcattctgtaaatggtggttaaatggatgaatgaaccggtaagaccccctccctcactatgggtttctcttactcatctgtaactaattccaaagtctaccatcatgaaagagcctgcactgttgtcacctgcctctactgaggtggctgatagactagctgctgctggtgtctatcacacaggctacaggtcctggacccctgcaggatgggcaaccaccatcctgactggctgagagtggacacccaggaaaagatgggtgtgggccatgcagaaagctgcagcggaatggcattagtgcaactccacgtgtgtgcccgacgtgctggaacagggagagggaagcagaggcagcgtagtgtcagaagcgtacacaggcagaggtggctaggggagtggggagcatccatgtggccggcagctggggactgacaggcacagctggatcctctcccaccgtgtagccacctgcccaaactccactaagccttttcaaggactgaccttaattataacagctgatgaagcttattgtgtgctgggcattttacatagatgagttcagtcaatccacccaatagtctcaagcgggtgctgttgttatccctagtttagagatatcaaagaagttgaacaagccccatcacaggaaaaaggaggtgctgggatttgatccctggcagcctgactctgaagcctgtgtaaccttgtgcttcctcctcctgctggaaacatcctgttcctgtgtgtggactgcacaccccgggtgccagaaacctcactgtggattgtctgtctgagatctaccctgtccatgtgtcacagtattggaaaaggttctggaactctggcctttgtctcaaaaaaagttgggggtgggtgggcggtctcgctctgtcacctaggctggagtgcaatggcgcgatctcggctcactgcaacctccgcctcctgggttcaagtgattctcctgcctcagtctcctgagcagctgggactacaggtgccccctaccacgcccagctaatttttgtatttttggtagagatgggggttttgccatgttggccaggctggtctcaaactcctgagctcaagtgatccatttgcctcggcctcccaaagtgctggaattacaggtgtgagccaccgtgcccagcctggccttttttttttttaatacaataaaaagattaattgaaaattattaaatccatagcatagtttactgcagtttaccgtattgttcaatttaggtataattacagatacaggtgccctaataccacaaaactgtctggctagtgtgaactttggtccctaaagatctggtgaaatccctagccaggtgcagcagaggaatttgtctttgcctggattatcatctttggttcttactgtcctgtgttgcctctgtggcccatccattcctaggctgcaaggatggcttcaggccatttctgcttgtagagacttgcattctctctctggaattgctctaagcttagattttcagttgagcaaacactcatcacatgtacctgcagagagctcctgctgtctcttttctcagttgcataccaccccaggtaaggagggtccctctgcctccagtgtcactgcaaagcgacagctacctgttgcccattgcccaggctcacgtttggtcttttgtttggctgcctctcaggtagtggaaggtgaaacacaggacttttcctgatagagatagttattcctctgttgaaatccaatttaaatatcgttctcttcatggcaaaaaagagtcctagagttgctcaggccattctttggttcacagtccccaggatgcatgcaactgggatttttcttaaactacttacctcttttatttctatggtaactcccatgctaggaatacaaaacacaaatctgcacagcaatgttgcacactctctgttttattttccccaaattagccatgtttgagcgtggacctcttcatgggcagtgaggatcactcagcacacatttctgtaaactttttggtgcgcgtgggttttactgtcttctgttgaagctgtgtcccccatttggaaggacgtgcaggtgtgaaggaaggacagttcttgctgaaaaagatgggaatggcttgcagatgtctgtggattaagcagatctaaaagctatgagaaaactgcctacttgtgtgtgtgcgcgtatgtgtatagtaaatgtatatatgcatatattttatattgacattctgtagatatgtttgaatacagaaacttgtttttactccgactactgaatccagaagtaccaaataatatacagtaaacagtaaaaccaagatttaaggttgtgtcaaaaaggtacagtgattcagtcatatccatttgtcatttgttttagccttttttttttttttgagatggagtcttgctctgtcaccaggctggagtgcagtggcgcgatctcagctcactgcaacctctgcctcccgggctcaagcaattctcctgcctcagcctcctaagtagctgggacttacaggtgcatgtcaccacgcctggctaatttttgtatttttagtagagacggggtttcaccatattggccagggtggcctcgatctcctgacctcaagtgatcttccagccccagcctcctaaagtgcgggattataggcacgagccactgctcccagccggtttcagcgtttttctttgtttgtttgttttttaagagggagtctcactctgttgcccaggctggagtgcagtggcgcgatctcggctcactgcaagctccgccttctgtgttcacgccattctcctacctcagcctcctgtgtagctgggactacaggcgcccaccatcacgcccggctaatttttttttttttttgtatttttagtagagaaggggtttcaccgtgttagccagtatggtcttgatctcctgacctcgtgatcgcccacctcagcctcccaaagtgctgggattacaggcttgagccactgcacctggcctcagcattttttgagtgtttttctttctgcagttgatcagttggatcctccatatcttgcgtatatacatgggctcaattattatgttaggataatcaaataagaatactagttcaatgattagcactgagtggttgttaggcagtcatgtgctcaacactgatgtcacctctttctgtaagcatactgagtagagacattttttaggtttaaattgacttaaatgaaagtgaataaaaaggccttttcaaaagaatgggtttgaaaaacctcagtaccctttaatacatgtacatttctttcctttcttcatttaatataacatgtgtctgttgtaactgtgtttcttaaatgttattttaaggttatatgttctttaattatggtcaaatataatttggtcaccaaaaacgaaataatagtttaaaacaagtagctgttactaagggtgctaaaaatactcattttataattaatttttaaagttttcttagtatattataaattgtgccctggtcaagtacaaatgtacacatcaaaatgcccatattgtatctgtctttagtcacttgatgtgaattatatgtgaattttttttggttcaaagttttactaaccagaattaaacactccgcatgagaaaaacggcacaacacaatcttgaggtcccttctgaatcatcagattatattatgcttcatatgttaaagaaaaaagaaacctgcctactttattaaacttacaagtttaatagagtcttggagattgatgtcttggggcatgattgggaaagtctccaaggcataggtccatccatgtatttcttcatttattgacatcttgtgcccagcacttactgagccacagcaatgtgtagtaaacataatgcgtcctcagtcagtgtttgttgaaggggtaaacaaaccccattctgggttgtgttcttttttttttttttttttttttaaatatgagacggagtcttgctctgtcaccaggctggaatacagtggcgcaatctcggctcactgcagcctccgcctcctgagttcaagcgattcccctgcctcagcctcccaagtagctgggactgcagaagtatgccaccacgcccggctaattttgtatttttagtagagacggagtttcaccatgttggccaggatggtcttgatctcctgacctggtgatccacctgccttggcctcccaaagtgctaggatgacaggcgtgaaccaccacacctggccaggggacatgttcttaaagtttatgaagcatcagctttgtctaagctttagtcaagagtcagaactaatacagatggtcccaacttagcatggtttggcttaagatttttcaacttcatgacggtgtaaaagtgatagaaattcagtagaaattgtacttcaagtacctgtacgaccattctgtttttcatttttcagcacagcattcagtaaatacacaagatacttaacattttattatcaaataggctttgcatgagatgattttacccaactgtaggctcatgtaagtgttctgtggacggttaaggtaggctcggctacgatatggtgttaggtgtattaaatgcacgacaatactttcaatatatggtggtttttcgggatgtaacccattctaggttgaggagcatggagcatttgtagtcagagggaagaaaagacatttggaggattttgactggcgatttttatcattttgagaccagttttggactaagaagacagtcaaatcaatgttctcttttggcctgaagttttggaattcagtgatgtcgttgtcccctgcattcccctcctttgtggaatttcaaaacccccttcacataatgagagaaattaaccctgaagaaagaaaggactggaatttctactagcttgttgataatgcattattgttatgctgtcatgggaaacctgtcttcctaggttctaaattggtggatgactgtctggtgacggagtccaagcgtcattgcacaatgaagatgaaaaacgcatgttggatggctactccagtgaagttgaaaaatgcttgcctgataaaatgcttgcctgatggctactccagttgggcacatgcatactgccttctgcttttgctcaggaggaagataagtgaaactaaaggattttggttgagtaatttagagagagagtaaaaagattttggtgtttgtcatgggagttcacaggctcttctaatggaacagagaactgctttaggggccagtttcaggtttttgcctttctggaaggaaggggcagtcccttttccctttgaccacttacctctattgtcagtttgtgtaattatgtcagaactcagccacagcctctgttttttttttttttttttttatagctctatcaagtgattttcagctttatagggaaagatagctctgaaattttctttcttctttcttctcttctcttctcttctcttttctttctttttttgagacagagtcttactctattattcaggctggagtatagtggcaccatctcagctcactgcagcctccatctcccaggttcaagcaattctcctgcctcagcctcccaggtagctgggattacaggcacccgccaccaggcctggctaattttttttttttttttttcttttagtggagactgggtttcatcatgttggccaggcttgtctccaactcctggcctcaagtgatccacccgccttggcctcccaaagtgttgggattacaggtgtgaaccaccatgcctggccttgaaatttctttttctctactttttcctttttacccactgtttagtttgctagggctgctgtgacagagtaccacagactgggtagcttaaacagcagaagtttattttttcacaattctggtggctagatgtttaagatcaaggtgtcagcagggggttggttttgtctggagcttctctccttgcctcgtcgatgccatctcctccttgtatctttacgtggttttctctctgtccttgtttgtcataatctcttctcataaagatcccagtcctaccagattagggcccaccttaatgacctcatataaccctcttgcctttctaaaaggtcctatttccaaataaggtcacattctgagatactggggattgggactttaacatgagtgatttgaggggagactaacatgaatttttggggggtgaggttcagctcataacacccacttcactttttcgtagtacattggcagttctgtttcaagagctcagttaataattatttgatgtgtcatggattagaacatgaaacaggaattttgttttattcataaaactgtatccctagcacctagagcatagcgtaagccctcaataaatataggttggatattattggatgaatacatgtcatatctggaagaaggataaaggaatgccctgaagacatgttagtttcaaaatgttctaaaggcccagaagggcagtgaggattttcactggcttcagggctctgtgcaataatatagaaatagagaatctcacactgaagccagtcaacaggaccaacttcttttagccagtcctgtctttccagcagcatcatgcaatctaggacataagagagcccgtgtcaaaccatttttatataccgtgacactcttatttttaacacagtggttggattatttataagcaatcttggattcattcaataaccacaggtagatagtgctctcacctcattaaagcattattgcaggccgggcatggtggctcacacctgtaatcctagcgctttgggaggctgaggcaggtggatcgcctgaggtcaggagttcgagaccagcctggccaacatggtgaaaccccgtctctactaaaaatagaaaaattagctgagcatagtggcaggcacctgtaatcctagctactcgggaggctgaggcaggagaatcgcttgaaccagggaggtggaggttgcagtgagcccagatcacgccattgcactccagcctgggtgataaaagcgagaccttgtctcaaaaaaaaaaagtattattgcagagaaggaggtactcttagaactctggactctgttagcaaaagcgttggggattgatagtgatttaattttattcatgatgctgagagagtctcaccggaatgcagcgaggattttgcccctcatgtcatcaagctggtagtactttgttttatgcccggtttcttgtctgatgcaaccttttatgcaccatagtgaaaagttgtgcttaacatgtttatgatcccatatttggaaatcttgccttatttggattttgcaggtttgatagtttgataattcagagaggttggactcaaatttttatctataaacaagggatttactaacaatagtttggaatgatatgactaagaaagatgttcattacttacagatctctttagaagcatcatttacatacaataattacctgactcagaagaaagtcccctagggaagtcatctgacagtcctggtcactgtctgtgctttaaagctggctgttactgaagcctttaatgcatactgtttttcttcccaggtaatctgcaatagtaattatggtttagttgagtggcctcccccagttgagaaacacaatcataccatgcagtaaaaaatatttaaagcacacttatagttctagaactttgcatggataactctaattagtctgggagcgcttccctggagccgaatgtgtttaagaattcaatcttttaagtgccggtgatgtcagtttggagacagcagtatgtggctccattccaccgtgaatcctttgctagctgcagtgtactttagctaatagaatcaagtgcttgtcttcaagttttttaagagcataaaaaccctgtttattaaaacaattctctttggcactttgcagcattatgataatgctgtcttagcagaagtgtagagagctgtgaactcctagggggaggctctggaggaggaccattctttcccattgtatttcttcgggacaagcatcatttctttccttagtcaaaggctttgtctcagcttgcacttcacgttttgaatatctttctggagaaaagcaacagcaagtattctggatattacgcatgatgatggttttctttgatgcctatctaatataaactcccattctcctggaacctcacatattttaaaaaatattacttgaggctgggcccggtggctcacgcctgtaatcccagcactttgggaggccgaggctggtggatcacttgaggccaggagttcaagaccagcctgggcaacatgttgaaactctactaaaaataaaaaaatcagccaggcatgatggcggcatctgtaatcccagctacttgggaggctgaggcatgagaattgcttgaacccaggaggcagagattgcactgacctgagatggcaccactgcactatagccgaggcagcagagcacgaccctgtctcaaacacacacacacacacacacacacacacacatctttgaagtaagttactgatagggatggaagtcttccaaatctggaaaaatcaatgtatgaaagatccataaatattctgaatttgtcttaatgtgtctatgcacaatgtaaggaatgcattgataggtttctgtgctgttccccccacccccaccgccttttttttgtgacagagtcttgctgtgacacccaggctggaatgcagtggcatgatctgggctcattgcagcctcaaccacccgggctcaagcgattctcccgcctcagcctcccgagtagctgggactacagtcctgcaccaccgtgcctggctaatttttttttgtgtgtgtatttttttagtagagatggggttttactgtgttgcccaggctggtctcgaactcctgggctccagcgatccaccctccttggcctcccaatgtgttgggattacaggcatgatccaccgtgcccagcctgtatactgttgctatatagaagagtctagtaaagtctggctcatatttgaacattcaagaaatagtcgttggtcctgtcgctcccagaagctgcacaatttttgagtaaacgtagccaaagttttcagaatcactgaatgctgctagttcttttcttttcgtgattaattcagacaggccgcatccctgcgagacccttcttctcccacctccaccaacatccacagacctctccctccaaggctacaaccaccgagccctctgacagatttgatcgcactgctcaggcttactgtcctcactttgttctgtgtgtggtttggtatttttctgtcctgcccacccaggccaggccttccccacggtgctgtgatagagtattgttatttgttgcttattgtctggagaaaatctctcaattccatatcaaactgttgtttgaggccttttgttttcattgtcaaatgtgtcgggtggcagtctcatgaaaaaaatcacatttgaaggtatattcataatacctggtaggaagagaaaaataatggtgttcctgtgacctgtttacctgattctgaaactaaacagtgttgcatggaaagcgattttagcgatcttagaaaagaatgtgttgtgtcttttttttggaaacccagcgattcagttagcatattatttgtttgcgtgtatcttaccctttcaagaactctaaggtatgtgcgacatggtaaccccaatgcaaacggcattaaattgtggaagcaggaatggtgttaaaaggattcttagaggtggtgccggttaggaggaggaaggaagccgttgcatgccaggtatggtgtcaccacacatatttcgtcctggtagtgatcctgtgaattaccctccgtgaccatgctttgtggttgagcacagtgagtccctgtctgggcaagggatgatgtagcagcaaatggccgagctggctaggagtcacacccaggcctcctttgtctacgttggattactttttctgtgtctaccagcattagaaaatgagaaaagtgtcattatttgcaggaacatagggcatttcaggttaggaaggaagcaagagtgaaagtctaggatagaggtgaacatgaaccaggatattcggggaacgatgatcagacagtccagctggagtggggagtgctggtgtagggtggggaaggaaaggttggcaagaagtcacgcccttctgcccgactgaggaattggttttcatcatctataggaacttttgtaagtttttgaggagaaacactagtgagtgacaacttgggagtggtgtttgaccataaaggttaggcagcctgtgttgtgcaaagtgattatacaggagcaagatttcaggttgtgtcaatggtccagggaggcggagtaaacagacaggaagacaggaaggagtaagtgaaacgttaaaagatttgggtggttgcagaggggaggtggtttgaggaggaagattattgtagcaccatctgctggcaccagtactatctacaccagagccattcctcttcctgtgctgcaagaacccccgttttgttcaactgtccaacccttgcccttgtaacttgggtaaatcctgactgctttgagacagtcgtgggaatacccttcaagggtgggcatgtgattcctgttagtgagcaggtaacttctgagaaaggtttctttaccctaaaaagggacacaaagaagaggttgtttcagctgctgctggatgttgccatgcgtgcatgtatctcctggagcagtggcagccatcctgtgaccatgaggaaagctggcagaaggaaacaggaacttcgtaggtggttgagtggctaaattaattaaccctggggttttcctgcctcagacctttttgtaagattattaacctttattgtttaaggcaggggttggcaaactatggtccatgagacaccagccacttaaaaaaaaattttttttttaatttttaagagacgaggtcttgctctgtcttccaggagcatagtggtgcagtcttggctcactgcaacctccacctcccgggctcaagtgatcctcccacctcagcctcctaagtagctgggactacaggtgtgtgccaccatgtctggctaatttttgtatttctcgtagagacgaggttttgccatgttacccaggctggttttgaactcctaagctcaggcaatccacccgccttggcctcccaaagtgctgggatcataggcatgcaccaccatgcctggcctcacttgttttttgtaaataaagttttattggcatgcagcaatgtcatattgtctgtggctgcttttgcattgcagtggtggaattgagtagttatgaaagagagacagtatggttcacaaagccttaaatatttgctatctggtcttttagagaaaaagtttgttcacttctggtctaagccattttgagttaggttttctgtttatttgtagccaaagcctgtttaagatgctggccttgttttgtacctcttaactggagattgtcctgtaggcaagggctttctagagctgttgtgctgtcaggactgaagatgtgcatttgggattcactttcatatcacagaaagcagttaagaaagagtttctaagtatggggggatttataacatcaagtgcagatttgttgcaatttcaatgtggtggtgaaaagccaagatggcaggtgcttaaaaagggaatgagtgggaagatcaatttattggcataaattaaaagaaatgtttcagatatttcacctgagaacctaggatgcatcttgatggtcctagattatgaaagttaatgtttaatctgacttgctccaaacgaggacaaagttaggcaaaaatgcatcccatgtaacttgtttttgtggcctctgtgattcctcctcctgacctctgctgtgctggtactgagcaaagacttaaggtatatatgagaccctcatgtataatggtttgactgatagccccttacttgtatgatttttttctcatcgtaaatggtgcttttacacagtaattgcccgactcacgtgattcacttcgattccactctctgtggctgatgttgcatgaaggttgtaggcactgctgtgccagagtcaacagggataaagaaacctgatagattgatttgatggcagggatgtgtgattagagaaggtcgaatccataggcctttgcaggaagcagggattccagcaccgatatcgagctgtcttcaaaatactaatgaacaggtgagatgtcaaaggaagacagcatgaaccaaagatgatttatttgatcacttcagggggaataaaaccagttgaaatcacattagaattcaagggaaactgcacaagacatttcaagaaagttgaaaaagatagtccagaaaagttaagctgaaaaatttttctttctttttttttttttttgagatagaatctcgctctgtcacccaggctagagtgcagtggcacaatcttggctcactgcaaccttcacctcctgggtttaagcaattctcctgcttcagcctcccgagaagctgggactacagtcatgtatcaccatgcccagctaatttttatatttttggtagagatgggttttcactatgttgctcaggctggtctcgaactcctgacctcaagtgatccgcccactctggcctcccaaattgccgggattataggtgtgagccaccgcgcccagcctgaaaatcttgaaggagaaggctgctactccttgcctgctgcagatacttaattttgatgaaatagagagtaaaggatcattgaaggagtcactgtaaatttaaactcgtacttaagcatatactacctgaagacgtttaagagccattaatgtacatgaaagtattaggtaaagtttgagataaattgtcttatttttaaatgtagttggaagatctttgggggtgataaagaacaccttttttgtcagcaggagatttctttttgtggtagtttttcacgctcttccgccagatccaaacttcttgagagtgtggactgtgtctggttttgttcagctaaaatctgacatagtgcttggtatctagtagatgcttcataaatatgtgttaaataaatgtgctttactcctaattttataagacttgtgttaaggctgcttcagtagtcaagctccgcatagtagaaacatcttccaaaatgaagattgacaacttagctttaatatcgttgggtttcatgaacgtaatacatgtgtctgaatgcatacatggggttttactttcttttcatgatgggttttgatatatttaacgtttgaaattgatttttagaaacagaacctcagtctgtaccattacagctctgggaagtgagagttttctacttcactgtggtttgatttgtgattatcatttaataaccagttagtagtgaggggttgcatgtacattgcatggaatattagggctgggaagagatttagtgatagttgcatctagtccatttttttttccaaatgaggaaactgaggtaacttcctcacctaaggtccaactgctgattcttttcatagagggaagctaccgcctatctggttccttctctcctcactgccctatcctccctgcccccaatcctgcctgtacctccctgcaaaatttaggcaaaggtagagtccatcttcatgagagtatacattgggtaagagaattaatgtgacggataggaagaagttactataggaatgctgggagtggtggtttatgtagttctctgattgctttaagaccttttactgaagtgaaacctttattcttagcagatttgggttcatggatgtaagcatctgcttaggcttgtgaccagcatctctgtggtctgtgtgatagaatactgcttttctctgcacccttcaaggactcctgagctacacactctttatatgatagagaaaattatagatgtacttatctgttgggtggttctggatgaaagttccgttttctttgtctgcacagcccctgatgagctcttccctgctctgctgggaactggccctcatcctccttttccatcaaggttcctcttcaggctttgagcggatccatgcggagagagaacagtctcccgcctttccccatttcaagtccctggagcctctaggctctggggggcaacaccgaatacagggggcagagtgtggtgcccatccggcatcatcagcttttgcagcctcagcccccagctgactacagggacacctctgccatgcctcctttcccagggccatggctccggaagagccagtatctggagtcatggccctgggaccagaggcatgacagaggtctccctgtagtcaaaacctgtgcttgggttcgtggtaagccatctgaggcatctgctgtgttcctcccctattcttaaggggtggtctctctctctcagggttgaagcctaaatctggggcatgggtctgatgcaggtccttagggggccagccctgtggtgcactgagccacaaagaggttccagattgaaacccttacagatcttcctccattagtgcttgattttcattcatggtgcagagaacttgcaggacaaggttcatttgcccttctctaccattcctcctttgcctttgtccacatagatgaggagcaaggtggccttcaggagactttctggggcactaggaaatggccaagtgataggatgcagagttgaagacggctgttttaggccagggctcccagcactgtagcttgattactgctgattacttcagttcctccaaccaatcctttaccttccatgcagagaggaaaagtcccacttactgactggcagagggctttccaaggaaatcacaggccccaaggaaaagtggagtgttaatttgcttcatggggtgaaactgctttctgaaagcatggtttgggcctccagtttgtaataaaatcacagccagcccttattgttcacactggaaaatttattcttgtttgtgtaccactaatgactagctttcagaatgcttactttcttctcataattgtccactaatttactgtccttctgatgggaagaataacaatgtatttgaagttccttgggctactgggtttattgtttttgatacttttagatatttcaaacatggaccttttacgtgctttatgttgcgcaatattcatatttattagggctatttaatagcgatgcaaatgagttcagtgcagctgtgccggacaatagtcatggaaatgaattcatcttgttgcttttttcttttcttgggtcattctgatcttttcatacttttcttaatggaacaagcacgtttcttcaggaaaggtggcctcatgttttcatttgtctgcaggacaaataatttgagtttcatttcttcctgtggctcatgatccaaattggtcagaataaagttggttgcatcagaaatattgcagaagtttagtctctgctctccagaggttggctgagaaagcttcactctgggtagctgtcgcttcccctctgcgctccagcaaagtccatgctcatcagtgacacacatgcccttcccctccattgtattactcttaaattccttctgaaactaagaatttagcactaaatggaattgattcctgagttggacacattagtagttcaaccctggttgccagctctgtccctcttccgcacatcatttgcagcttttaatcttcactgaaagccaataattaagtatagcagaattatgtctgaagcaaggccaaattggcactgggtaaacctgaggacccgtcccatggaaaaccagtaataatttccccccgcatcctaattcttttttcatttcaaatcagcatttccaaagcactttcaagaccgttccctttttttatccttaggctgaaacatgccctgaaaggaaggggagaatgttttagtgactcatattcaagaaagagaacattgccaaaaatttgcaacaacaaggtaaatttattactcatgcaagtaagaagcagagctctcttcagtggcagctttcctcagcaaagctgggagccgatcttgtttaggatcttgggaagcgtgaagttcgaggctggtcaggctttgagaggtgggagtgagaggtcattagcagggtccttggatgagtgccttgttgatcagctgttgacaaaagcatggggatgtcagaagcccgtgtactggttctgagctgtcattgattcttaaactggtagtttcttgttaccatgactacagatcattcccccacctttacttcccccaagcacactcttcctccacatacgctttttgatgttttctcagacaaagcttcaggagagaccctcagggagaatcttccctgtggtgattaatcttcctccctgataatattttattttcagggggtctgattttcatttgcattaaatatgtgagaaaactacggcttagggaggtcatggggcttttctaagttcctgtatttggccagttggagaacctaggccttgtcacttcttgagatcttaagagtcttgatgccagggactgggccttattcttgtgagtttctttggtattttgcatgtagtaggtctgtagttgctgtttgttgattgaataagtgataccaccagtgcactgagcaggtcagattttgtttctaagtcagcacaggacccatcagtactgataaagccccaaaacccccacctttgcagtcagcctattgtgtatttggttggagcaaaagtaattgtggtttttgctatttttttaatgggaaaaactgcaattacttttgtaccaacctaagacctttcagtaagtgagagggcagcttgtgaagccaggctctttgtgaggtgtgagctactgaaggttaagtgtccaaaactagactctgatgtgtgcagttagccggggggaaggaggtagttcagaaaaccagaaggtggcagctagaattaataatccctgcctcctagtttggatataccctcactgcctttttttaaaagcaagaactctagagattaagtgttccaatagctgggatgcttttggaaggccgtgtatacctcagtgtatgtgttcccagtagtgtgtgccctggaggaaaccccagggcccagagcttccctgcagccccggccccagctctggccccggccctggccctggtcctggccctggaggcatcttctaatgaaattacctccactgaagtttcctataaacatagtcaagagcagcctctctccctgctgagctattgcagatccctcccacttcctcttctgctctcctttctctgaaacaccaagtgaggatgcgtgtttgcttgtttatggatggagtagctaaaggagcagggatggagcttgagttcctccagctcagaagttgatctgaggagtttttttcatttttgttttttatggagacagagtcttgctctgtcacccaggctggagtgcagtggtgttctctcagctcactgcaacctctgcctcccgggttcaagcaattctcaggccacagcctcccgagtagctgggactacaggcacccgtcaccacgccctgcccattttttatattttagtagagactgggtttcaccatgttgcccacgctggtctcgaactcctgagctcaaatcatccacccatcttggcctcccaaagtgttgggattataggtgtgagccactgcacccagtccacctgaggagtttctgaaacatctcactcaaacctccagcagtgaggcctgggcacctggttgttaactgagtttccctgaggaccctcagtcttcctcattagtaggccttgccctggtcaggcttcctcagtttgtggatggagcaggtagggcgcacggaggtgaatctcctgagccaggagcagcagagccaggatggaccctgacttctagcttccctcagcctgagctctttctctcctgccacactcttcttgggcctcttgctgtcaccctgggcttgtcaggtgccagcaggaactcttgggcaaatgggtcctatttctgcttgagtcttgaggtttggagcagcttaactgggagagaaggcagcatcctttaatgggggctggcagtttaatgccatcaaggggtaggatgggagtgtgaatggaagacagcccgtcttcattagactttacaatgtggcttatcaagtgcagtgtttgaagaccttgtgaagacatcatgagcctcacagtgctaagagggacctgaatgaaaggaaaacaatggctttcaatgatgatttgggaaacatggatgatgcactgatctgagcttatagatcctgtccttgggtgaacagggagaggtcagaaacaggaggatgcttaattcattccagccaccgctgctggagttgttttagcaaagctccccatttctgtagttggtgctggcattttgacgatttccccctttgctatggtgatctggaagcacagagccagatgtgtagctgcttctttgttcctaggcacacgccttttttccccgaatgtggccttggagtcagattgcccaggttcaaactttggttcctcggcttgttagctgcatggcctagacagcttgcttaacttctcttgcctgggttagaatgatagcaccccagcagtcctaataacaattcctgggctacagtatttactacctaccttgtggggttattatgaggaacaagtacaatcataacatcaagggctgagagccttcctagaacacagtaactatcccattaatgttcacagaactatcaccactcatgaaatcctagcttgaatatttacattagtcttgtttctcaaacttgactctttggtttgatcgacattttccctaatgctgattttcacctttatttctactttgctgtttgtattcttgggagtaacctttgatgtatgaatgaaataaataaattcaaatgccaggcttttaccatggggtctaatgtgcttgaaatcagaatgcaatagacgcttttgctaagcttgagggcaaagaggggctagtgctgcatccaggggtttcagcctggggactgcgtcctggccctctctgtccaatgccttcctgattctcccccacttaagttgctatcacagtaccttgctagaccaactaactagcacagtttgagacttttctttccttgctctgacttctttgtaagtgcagcttatgttgtcagaaagctcaaaatgttgtgacaataaggctgcagtcccgtgcagccggcgttttgtcgtgtgggtgtgatggtgcttgtgtgctgtgttcttattggcaatcgcgagacgcactcacggaatcacagatgccgcctacaaaaggtatctataaggtatctatgttccataaaagcaggtagcctgtttacttagccctggactaggcctctgggagggaggagggagaggtgggtgtgtgcaaatttggtggggagaaaaagtgttatataaaattgggaagatataaagcactgacaaaaagaaatgtgaaaagatgtgtttaaaacaatgcgcatgaagtgcgaagtctatggggcggttctgatgagcaagcatggaggactttttgggggaggggggtggtcttaagctgtgtcttaaagccaaaaaatgtgaagagaggtttccagatagagaggatgccatgagttaagtggatgcaggcatagcgctaagaataaaggagattgcgtgtttgacatgaccatcgtgaaggacccatgctctgttgaacctagtagtgaggttaggattggagaggccaagttacaggataaggaaagtagctttgtcatcatgggcaagaggaaaccactgcagcttctgagtggatccatggtgcaaatgggtggaaactggtgatggctggcaggggaaaaggggggtcccattttcaggcattatggagaaaagttaccaggatttgttcaataattggatggtaaagaaaaagagtgaagaaaaataattccaagtcttcagtgcttgagaatcaagaggttggatggcattgatgttgaatgaaaatcttgtgaaagctggagatgaatgacttagcagggggaagtcttagcactcttcaagagaggagaggcagtatgtccctgaagtttggattctggactctgcaatcatctgggtcaaaccccggttctaccagtcattagcttttgcaaccttgaccaaatgaacctctgtctgttttccccatttatgagggtgaaaatagcacctacctcagaaggtggtggcgaggattaagtgagagaacacacgtgaaatggttagaacagtgcctggcgtgtggtaagtacccactgaatgccagtgcttttattacggtgaatattcattgtattgaaagtcagacataggtgtggaaccagttatgggagtgaggataagtctagatttgggaatcagtcgcagagaggtggacgatgaaagtctgagaagaaaggatcttgctaatggagtgaactcagagcttgataaagggaggatgagtggaaatggagctcaacgctgtgccttgggaaatacctctgtggattggtgggagcacagtgagaaattcaagaaagacacagacaatggaataaccagagaattaggaggcaaatcgagagactgtgttgtcatgggaaccgaggaaggagaattttttttaaagatgtcgtataagtcagatacaatgagaattaagtgaaaattgaggctaacataatgtaccactgattaggcttgaatattattaaacatgctagagccgttcagctgtgggatgattgagaagccagagtttatgggatatgggaaccgtgatgggagattataggaaaaagatggagtggtgcttagaagaggcagcagagcaaacgaagccaggagttaagaatttaaaagctatacaaagagaactaatagagggcaagaaattagaaatacaaatgcaggcaggaatgcatgtgggagaccaggtagggagttggcagcatggggaacacagaggagaaaggccctgctgagcaggtggagaggaccttttttggcaaacaatggtgggcagatgtgtgcagtggtggagaaatctggatccaggggaaggcacaggctgagaacaggttttctccatcataataaatatctgcctgtgactggtataaatgtcgatgcttctcaaaccttaagaaacttccagcattttgttttgtttttcaaatgataagtttcttattcatactgcttctaagcattgggaaagaagtaactcagggagttttaaaaagcttttattttaaagaggtcttgtctcccaggaaacataacttttggaaacagtttacaaagaatttgctttttctcactgacagatagggtgtcttttggtgggagcagagccccagagccagaggacctgcctgcttgcttggcagtcccccgagcagacacaatttaggaacaggaaaccctagagaaacctgagtcaggatgctgtgggtcccagaagcaactgggtagttgtttcaagtttcctttttttttttgagcggggggtgggtggggcgggggcggcttcaaactggagattagcaaaaatgagttggatatttccttagacagttcaaaccctcataggtgaactcatctccgtctctgtttctgcttagttttctgcacatcctttctaagaactcacttatgtctataaataccttttaacaggttctcttcatatttggataccaggagtaaataagtgattttgcaagtatactcaaggattctggactaggtgctactgtgccctttatacagtctggtggggtttggggggtgggtgtgtgtggaaaagagaaactcccaaaccctcaaagaggatggggaacaatgtcctgaaagaacagggctcaggcagcagaagagctgaggggtctctgttctgaacgggtcccccttctccctgcccttcatcttgtgtgactgcggttgagaaagacctgcaggattaaaggatctggtgaccttgggaccccgcacttgcttggcagtgacagtcctgaggaactgtattctttcagttcctctatcagcaaagcagctcagtaggtaaagggcgaattccggcatttcagtgtctcttgccatgggtagctctcatatttccagttgatgatgtctggacacgtgcccttgtgaaatgagttgagtggtgtgagattgggagcccaaacctgtgaacacccaactgggctttttcctggccataaaaagctcgaataatggagagctttaggaaacaagttgtttgaaaactctgttgagttggctttgagcattcgtggaacattatttttaagaaccggttatttcatttaaaacagagtaaaaagagaagatgattgtattagtctgttctcatattgctgcaaagatactacctgagaccaggtactttataaaggaaagaggtttaattgattcatggttctgcatggctggggaggcctcaggaaactcacaatcatggtggaaggggaagcaaacatgtccttctttacagcgcagcaggaaggagaatgaacgagtgctcagtgaagggggaagccccttataaaaccatcagctcttgtgagaaactaactctcacgagaacaggatgggggatactgccccccatgattcaattatctctgcctagtccctcctacgacatgtggggattatgggaactacaattcaagatgaaatttgggtggggacacagccaaaccatatcagtgattgaggggagaacagggaatgaaacatcccctctcaacagtggtaggaataatggcctgtcatcattattgtcagcagtaactgacatttcttgaagacctcagtgcataaggcactgtactgagcgctttatattctgtgtcttgtttaatttcattcaaccctcccaacagcctgtactacattaaatactactgttacccacttttcttttctttcttttttttattgagacagagtcttgctttgttgtccaggctggagtgcagtggcacaatctcagctcactgcaacctccgcctcccaggttcaagtgactcttctgcctcagcctcccgagtagctgggactacaggtgtgcaccaccatacctggctaatttttgtattttttagtagagacagggtttcagcatattggccaggctggtctcgaactcctgaccttgtgatctgcctgccttgccctcccgaagtgctgggattacaggcatgagccatcgtgcccggccttttacccacattatacaggtgaaaaaaattatgttgctctaccatttccacaaatggcataggctggcctattactgtccttttccaaaatacgtgtctctcaaatagctctgcagctcttacagggctcctcgttgtcctctgtgctttacagtttgagatccttcacgttggaggtttgtagaggaccacagttgcaaaatagggtgcctggggtctctgcttatctgcattttgtcaaaggatactataggtcatggcgcatggtcttttgctgatgttcgttttggcaagaagcactatttttcatcatttgccaagaaaaccttttgtgcattttaccttaaggacctggatagcataagcagagaaagggaatcagcatttccatgttttgaaaagtaaaacaagactctttttggtctttgcgcccccatgccctagaaatcccataataagtgcaactgtctccttctgctgatggatttcctaagtcattcccagaaagaagttgggtgctttgtattgtattaatatattcatcctaaataagggtcttggggttttccccccttccaagatgtattaagaaggttgcttactgtaggctttgatttatttatttcctatgaaatgccagaaacaccaagtcctaaaatcctagatccaagtcattgacttctcagtgattatgaccacattgaattgattaaactcaagtgactgacaaggcgaataaaaatagcccaaaatgagtccagaccccatggttttaagagccccccaccagttccctaaagctacaggacggaaaggactcctgatcctttgtacctgaagagtgtggtgcctaacgtatagccaatgttcatttgtttcttctctctgtattttataaacataattactttgaatgaattgggttattcgggaagtcagcacatgtctccatctcctgctttctatttctagagtcctaagatagactttgctgacaagaagaggcccctgccccttcagagcttagagtgtagcagagagatgggtattcaggaaatcctcaaatagtgacagagccacagcggcagtgagtgacaggcaggagaactataggatgctggaagtgcatacaaccggggtgttacctagtctgggactggtggtcaagggggcttttttgaggcctggacaacccacagaccgagggtgggctagtgagagccagtgagggacactcttcaagatcccagcacttaaaagattggttgggcatgatgactcaggccgggaaccccagcactttgggaggctgagatgggaggattgcttgagcccaggagtttgagaccagccctggcaacaccgtaagaccccatctcaatgaaaagtaaattagtcagggccgggtatggtggctcatgcctgtaatcccagcattttgggaggctgaggcgggtggattgcctgagcttaggagtttgagatcagcctggcaacatggtgaaccctgtctctactaaaaatacaaaaaattagccgggcgtggtagcaggcacctgtaatcccagctactcaagaggctgaggcatgagaattccttggacccgggagacggatgttgcattgagcccagatcgcggcactgcactccagcctgggagacaaagcgaaactctgtctccaaaaaaaaaaaaaaaaaaaaaaaaaagtaaattagctaggcatgatggtacgtgcctgtggtgccaagctcctcaggaggctgaggcagaaggatggcctgaggccaggagttcgagattgcagtgagctgtgatcacacctctgcattccagcttggacgacagaacaacgccctgtttccaaaaaaaaaaaaagattggggtgctcttaagctcacagttctggccatctcctctttcctaagtggagggagatcgtggatccctgagggggaacctacttcccctttcacttcaaagtctgcttctgtttctaaaaatgaactgaaaccccatctgtttgctcatgtatttgaaaacccttgaaaatgtttatttttgtacatcttcatacgactctcgtctcagagctgcttctcctcttcaggtggtttctgggcacactggggacgtctgtgcacctcctctgagtggaagtcaatgcctgtgatcccctttctaaaggaggcacggatagctgctgtgcggttttttcaacctgtagccagttttcatgtttttgttctcaaaataatactttttttttcaggtgaagacaaggaacatttaatttacactgaaatgatttttcctcttagaccttctgaaagctatgacgtatgtatatttataccataatagatgctaatggtgtcctctctgggtgatggtcccagagatgtttataccacggcatttcactccactaataaatgtgggtggatggatggacgggcggacagatggaaatatcacacaggactgtgcccaggttccagacagtttggctttagggccccaactctgccaagggatattttttatatagcatcatgtttttcatcatgatgttagtctctctctcttttttttttctttgagatggagtctcgctctgttgccaggtgtgagtgcagtggcacgatcttaactgactgtgacctctgcctcctggattcaagcgattctcctgcctcagcctcccaagtagctggggctacaggtgcctgccatgcctggctgattttttttttttttagttgagacagggtttcatactggccaggctggtcttgaactcctgacctcaagtgatccacccacccaggcctcccaaagtgctgggattacaggcgtgagccactgcacctgcctgtaacatcatgatgttacagtcccccagctcctcacctggcctccctgtacccattcctggccccctccctccttcaatctcttttccacttcagagagtgatctttagcattcccagctccaccccacgctttctgcctgtaatcatttaaaggcttcccattgcttctaggatgaagtccaggatccttaaactggcctacaaggccctgtatcatcagctgccctgcgtctccagccgcctctcctcatcacccacactttttcttcatagcctccatcccagctgtaatgcagaattttgtttgataattatttaattcatgttcacctctcccattagactgcaagcttagcgaggccaggggctgttttgttgtttacccttgaaccccaacccatagcacatgtaagtactcatttgtcaggtgtttgtgtttcatatccattttttgccttttcttacatacatggacacacttttctctcttttgagataacttccagaattgagtggttatgagcaattcctggatccctgtttgcctcagagccggtaactgttctcaccttttgggaaccataaacgctgccattgttgacctgaacacgaggtgactctggcaggagccctggccatcgtcccttttttggttatcatctgacgtttgtgcagctacacacatcatatctcatttgatctcttggactcccgttggttagtagaaaccttattttatagacaaacagctgaagctcagaggtgttcagaaacttttgccccatttgctgcaagtggtccatgagggtctggaatcaagaccttctggttctggtttgatgctgggactgctctttctgaattgtttctatgcctgtctgttcaatgttataatgatgagggggccagtccctcaccagctgcattctaactggaggctagaaaataatgaatgggaagtaacttaggggaaaactatgatgaggttgttggcatttgttactcttggaaagaagtgtagccttggaaactagaggctaagaaataaagtgaggcttcttagatgtcgttgtgtattaaacaggaagcccgtttgctctggctgtagagtgtgcccatgagagtttatggaagaatgaacttgactcaataaataacccactcagtgcatgatacccttttcttcagctgcaggtaaatgtctgttatggtgagtgacatggtggcatgttgggctctatgaaactgagtccacacacagcctgctgtgctgcctgccctgaaacgggacaggcccttggtaaatgacttgctactgaatggtagtcctcacgatgacatgtgtggcccatttaatgagagaagtaaagaccgcagaggatggaggaaagggcagggggagaagttagctaatattaaattcctgaccacccacacctaatgaaaaagaatgttctctgcttgcagaggcagtgaattaggctggcaaggtaccaagggaggaggaaaagtgtgtgaatggatacccgctacatctgagcacagacttaacccagaaacgcaggcggtcaggaaatctaatgatggcttcggacctgggcagacttgagttgagacctgtgccctccgcctcacgagcctcagaaggctgttgagtctttttctgagtctcagtttctcattctgtaattgggggatgataaggataaaacctgacaagataattgtgactcaaatgccagttcctagtactggtgttagcacaaagctgagtaaatactcatggattcaaaggcgcgagatgtcataccatccaagttatcaggaatgtgtttgctgagggctccctgggtgctgacctggctctacaggttctgaataaagagttgaacagggtctagttcctgtagtcaaggcacttcagatagagagaaactggcttgccaccaactctcatggaatcccagatgtgtgtgctttcatagttcaacgttctggaatccagaggtgtcttacatgatggcctgtcatagtttaatgggccgccttttatttcttggaggtacatctatgatggctgggggtgtggattctcagagacctatcgtcagatagttccttggagcaattctcagagctaggctgcttaaggcatatgagggctcaggactcagagccctccttctttatgaccttccagggaacatcccttttcctggagtgtaaaatactgcatgttatcaggtttgcagtttccttgagttagggtgggggtgtcacaaggcttatctttgaggctgaggttcagtggatttggagaagtgtgttggcaatgaatttcggggagaatcttcccctcgttgtctgcctgtgtaagagttaattttagcagttgtgattgtgaattatttgtcaaaagatactcccacttctgaagcccttgtttgcacctggtggagacaataaagcttctaagagcaaaatataattttcttccctgcttgtttcttttcttagcattttagaaaatcccactcagtttctagagttaacacctttccccactaatcagaacacaacacacaacacacacacactctcacacatacagactccctcactgaccttatgggccctttgctctgctaaacacataggtactggatggagtttgtagcaacatgtccctgccccgaatttgtcatccagatgtcgcctttggatgtcatgtccttgacattgacccagggtgggacttctgcagtcaaatgctctacccctgagctatcccccctacggtgggacttctgaataaagcctgtgtcactgtctctctggttcccttcagcgggagctctctgtggtttaatggagtctccacttgaccaggagtgtttccagatgagaaacccagggagggctgcaagcaaatgagagtgaaaactgagctctgtcccactccaaatggcatccgggattcacataccaaggctggctgggaacagctgatccaggctgatcctgacactggagagtccaagcattggaggccagaggccattcagaagaattacctcggagtagaaggcttcctaatgagcaataaggaggaactcccccattcttagggcacaggcctaattgaaaccatcctgggaagagaacatctaattaagtctgactcctcagaggactcaaatagttatatatgaagaaatgctaatctcgtggccttacttgtggctagggaacctgaggtgatgctcaggacagcaataccagcccttacggccttgctgtgtgtcctgggctgtgaacagtgcagaagtccctgtctgttcccgtgattttgacagaggatgccagaggcagaagtgctgctctttggtggtgtccttggtggtgttttcatctgtctacattagggttgggttcactttttttttttttcttcttttttttcttgagacagggtctggctctggctcaggctctgtccaggctggagtgcagtggcatgatcttggctcactgcaacctctgcctcccaggctcaagccatcctcccacctcagccttccaggtagctgggactacaggtgcgtgccactacacctggctaatttttgtattttctgtagagacagggttttgccgtgttgcccaggctggtctcaaactcctgagctcaagtgatccgtgcacctcggcctccctaagtgctgggattacaggcttgattccagccaaagtgcctggctgactctttgaattagaagttaaggtgagttttagaactctggtcttttctgtgatttgaaatgttgcctctggggaaggtgctgttttctagttttatgaaatgatagactctcttcccaacacacacacacacacacactcacacattcacactcacactcccacctcttgagaagaccacaggagctgtggagacagttgtccttggtgtggccagcctggttgtgggacatgggccttaaggtgcagcacccccattcaccttctccaggatggaaacaattttcttcttcctcattggccttgctcaagaaatatgccaggcattttcaatgtcttctgtccagacccagaaggatactcagactacttctgtttaaatggggcttgtttttcataagcagttgcattgttgatgtggctaaatttagacagaaccccatctagattgtggtcaagggctatgaatgctgcctccactgagcaccaggtgggcttgtacattttggtgactcattgctgcttgtgatgagaggggcctgcacacttaaacccctccaaggcagcactgccctgttcagtcttacctatgactcaacgtcaggaagctgaggaccccggtagcctctagaactgaggtgtacccctgggctgcagtggaagaggatcttggggccctagtgatcccctagatctaaaaagcaaagagacagcttagaggaatagaggatttggtcagggtatgtgtgtgttggaggggtcagggcagttattttcttgcactgaattctgagcataaaaacttctagcttgctttgctttttgtcacccagcgatttctaaagacagtacacttgtgtgttcaaatcccttttcacacctggagaaattcactcttgactcccttccagtgtaagaagtagtttagcatagttccggaaacgcttcgatatcaagccatcaaaagacagactgcgaagtcactccgagtgtaagagctctctgtatgtagaggaccagctttctgagaatgttttggcagggacttgaaaatgtcagtcatgtgtagacagggaagtgtcataccattaagatgtatacgggatggtgacagagtgagagaggccttggggttttgaaagaagggagtgatttttgtagtcccaattcattgtcctctgagtagctcttccctcagcctcttgcatgcgactttggctggtcggggatgccaggcgagttctgagccggagactcatggggagtcctcttgtgcagctgacaccttctggagacaccttcctcactcccaaaggcacggggccttagtgctttctgagtagccaccttggaccatcggttcagtaatttgaatagtaaaatgtgggatggcgttttcttgctaaagtgcagcttaactgggggagtgagttgttaaaagagcagggtggtagcatagatgacaggcgttcataaagcactgaatttagagatctggacctggactgtgctgctgaatgtggaaacctagactcagtgtgaccatctctaagctcctttgagcttctaggagtctgtcatcaaaggtggtttccaacagcctccagggccccctggccctttgtgctccatccccacctccgctcattccagtttcacctggggctatgtggctacctcctcacgtctaggctctcctccttctgagatgctctttctctttcttgtttactggagggcttggctaagaccaaacttgggtaccctgggcagaactagggactcctgtgcctcctttccagagcatcgtgtgtggaccctttttgtcgtgtagttatttggttatttttctgcttctgtcgggcagtgggtatcgacaggtaagactgccttatttgccttggtatctaggagcactcaaaagtgaatagattgaatggaattaaatccttgaaattacagtagaaagcttaggttctttagaatagaatcgtggtgaaagatggcctttgtgttctgtgtattctgtgccctttttccgctaacaagttgatatcgtgctgttattttgttttgttgataacatagtgtggactttgtacttctaaaccttaggaaaacgtggatcattagtcatttttgtcacattgcagtctgccctaataaacatagtattggaaaaacgagatctgttaaagggaatgatgaattttgctgccttggagcttgttgatacctgaaaattggtttcggaaatcgagacgcctgatggaagtttgtgtgtcgttttggctgcgttaggctcttcttgagccctattaggctcgatgccattaaactgctatgcgtaatgagggtgacacgttgcagtgaactcccatcctccaaaggcttttaaactttagaaacctgtgtatatgctgtgcctaccctttatagtatatattaaaataaagtcacacaaaaatccaagtttagtgattaaaataacattagaagtgcataattcacgttataaggaaagtctctcctttcagaagaattcactgtggctttccctgactcttgacatatgatttgatttacaccaaaccaaaaaaaattcagcaacatcacacatccctttaagcaatcaatgaaaatgctcattcagttttacccctcaaaatgtgctttagataagtgagtctaatggtatcaaataatgcctctgtggacaggcataagtgagattctggcaaaaaaaaaaaaatctaaaagttttttaaacttattgaatctgtcagtcttgctcaacttttttttgtagtattcatagtattttgaagagagtaggtccagctttgaaaaactctaaacttaaaaaaaaaaaaaaaaaaaggtggccaggtgaggtggctcatgcctgtaatcctagcactttggaatgctgaggtgggaggattgcttgagcccacaatttccagatcagcctgggcaacatagtgagtccctgtctgtacaaaaaatgaattaaaaaaatagctgggtgtggtggcatgtgcctgtaggcctagctacttgggaggctgagctgggaggattgcttgagcccaggagatggaagtggtagtgagcagcgatagcaccactgcactccagcctgggcaacagcaagaccctatttcaaaaaaacaaaacaaaacaaaacaaaagcaaaaaaagcatgagctttaaagtgaatggataggtagagagattgaggaattttttggtaactccttagctatattgcctttaaaaaaaaaagtgtgtatattactttcagcaaaattatttcagcaaataagtataacactgctcttgtttatattctttcaattgaacctcgctgcccaaccagtagtacatcctcagccttttttcctctccccagatagctcatcttcacgatccctagcacagcactaaatgcaaacaaaatgtccttacatgtgagtcaagtacagtttagtctggagaaaaggcccctgtgtctgaagctgttccttctatgagccaaacatcaagtgttcaagtcagagggactacacagaccaggacagggggctggcttccagggctgaggttgttgctgtaattgtttttgggtgtgcacctgcagcgcctgtgtaaaggtggagacagtggtgggaggagtgaaatctcccaccgtggttggatgctggacgaacggcctcaggtgtaggcagcttttttgttgttgtttttttgtttgttttgttttgttctgccatgcgcttcagtttggaagcagcctatattgtacacgttgattactttgaagaagtgatttcttattttgcttcatgttcattttcaaggaggtataccttggggagtgggagtgttttttgtttttgttttttttttaagcattgtttatagccacaatagaatgtcattggaaagagtggaggctttggaattacatttttatcccatactaactgggtgacctttgacaagatcgttaactcatactgagtggagttcctgtttcatgctgggaatcatgctgggacctcaaagacctcctgttctggagagagagatgctcatcgggggccagcagagccaagttcacaggacagagcagggatgccccagccagtctgcaagaattggaacagcttggtggaagagagacacagtccctcttagtcacagtctccttgtctggaagtaggggcaatggtaccgcagaggggtggtactgagtgctaagtaaaacgagttagaaatgcctttcacagagtctgatgaatgaacgtgggtccccatctttggtacctgaagacggccatgtcccacaggtgtgtggtcagagggtgcacagttcacagaaggcctccacagtgaggtgggatgcaggtggaaagagaagtcccaggaaaagggaggcaggggaggaaacagaaagctgcggttggaagaagacctcagcacaggtgcactttttctcttgtggattagttattaccggatgactttcatccacacacttaacactctctttgcagggacagttttggggaagggtaggcgtctgctttcacagaaggtaattaccgcaaaagctggtaccagctcatgctgttctgatgttttggttacgcaatcatgggcccctgtactagtacatttgtcttcataagctgtgctgaattattttttaaaaccgctaactgatgcgattagtaaaacattttggtttttaacttttgatgaaaatagcactgtttggaactgtgatgcaggggtttactgctgagtgaagttctagaattttgctgaaagtaacatgacctgctctgtgggtctcactctgtctctctgttaagattgttgagtgaatggaagaaaaggaagacttggtgtgtttccagtgatctataaagaaatgatgaagtgaatatgttctgtggatctctgttctctctttgactctattaaccaagtaatatcttaatttaaaatgatgaaatttaggaaattagacattgctattcatcttagaagggaacaaagtatccatgctggtctagtgaagccacatattaaatcctcttaaaacttaaactgtgccttttttccagatttgatctacgtgtggatattctaatgattgaatataataggattccattctttaatttcaaaacttttagaatacggagttagaatttatttatttatttatttatttatttatttatttatttattacctaaaacaagttcagtggaagatgctttttgattattatcacattttgggcttttgtttttggtaacatgcaggccatatatgaatgaaattttgctctttcacagaatgatatgagcatctgtttcttctaattagaatacatctacaggagaagagggattttaattttcatgttgtagcgaatgtctaagggttgaccgggtattttggaggagtagttgtactttgatcatatttgtatttgcttttctggtcaggagcctggataaggaagcgccccctaacgggtgggtggagcagagggagtggggcgagagatggagaggaggggccggggcaaggaaggatccctaggtctgccttcctgtccacagcactgcccgccagccacagctcctgagtcaaaggctctgaagcaaagttgtatgatgaaccttggatttcctgtacaatttggctaactctagggtgatctctaataaagacaaaggccaggggacagaaatatctttcttttgctcctggcaaatcccattttgattctatctcaatctaactgtccagaaaattggattgaaagcaggacaccgccgggaggtaaatcagattagggcttcctctaccacagcctccagcagacatttcattttgcagtgtgcgtccctcatttatatgaagccgtgtatggcccctccatgcagcagggtgcgtccaagctgacccagcgaaccaagacatcaggtgaccctccaatttgattcactgaaaatactgccggtggcttcattttctccagagaactgtctgcacctctgttcctttctttttatttgggtgcctatgatgacctcattgaagtcttcatctttttcttagccaatgtagcgtttgctaaggagccagacctcagataggaatggagagccccagaatccaggtgcagcacaggtgcttccagaaccttctatgtggtcccttcgggaaaggatcatctgtttttgtgaggcttaacaggaagacagaactagggaagaagcagggtgaggagggagaagtgcagctgtgtatagcgagaataaggatctgccgaaatttatcttggggtttttatttcctcttgaaatgttgtgcgttctgagaacctcgaggagtgtttttgttgcctgataggaactggcccggcttgttcctattgcactgaagccttcaggaatgcggcctctgcacctgtgatgaaaacaacatccaagaaacccaccagtgggttccagaacttcctttctacagtgactgtttgggtcacaaaacataactagacaaaaaattagctgggcgtggtggcgggtgcctgtagtcccagctactcaggaggctgaggcaggagaatggcatgaacctgggaggcggagcatgcagtgagccgagatggcaccactgcactccagcctggatgacagagcgagactccgtctcaaaaacaaacaaacaaaaaaacaaacaaaacacataactagaaattatgaggtttataagggctggtgtcttaaccgcaagtgcctgtttgaacccccattgagcttgtagcatcgagatgtgctgtgtgtcacattcagccacatttgtacagttggtggcatttaggagtcctgcctggaaggccaagaatatttttccccacagtggcttaggaaatggaactggagccctcattcccctcacttcccactggctaggtggtcacggatgtggaaatatcccaagcttgaaaccactgaagatggagctcctgacttggaacagaggctctggggtaaggcaggcattggggacttgagggaatcccaggaaaagactgggaactagaacccatgtgccctcgtacagatccacagtccccttgccttgggtcccgtgatcctttttttctttttttttttctttttttgagatagagtcttgctttgtcacccagactggagcgcagtggcttgatctcagctcactgcaacctccacctcctgggttcaagcgattctcctgcctcagcctcctaagtagctgagattacaggcgcccgccaccatgcccagctaattttttgtgttttcagtagaaacgtgtttcgccatgttgaccaggctggtctcgaactcctgacctcaggtgatccgcccacctcagcctcccaaagtgctgggattatagacgtgagccactgcgcccagcccccctgatctttagaactgccctgcttgcctccctttgcgccgccctcgtctgctgtaggtcgaattggtttaagagctgggcatccactggggagaaaaatcagagtagggcttcctgggactcttctgggttgttctgactaacattgggttttactcaaattttctctccctgatgtaaacacgcagatattttttaaggttttaagtgtgaccatttagcttacatgcaagtcagaatactttgggttttttcagatccaatagcaggagcatccaggcttttaaagctgtgggatatgatttctgtgtatttgggctaaattaatttgtttattgataacctcagttgttatcatgctaaactgtcagaattggatgtgaagccagtgcttatgtagactttatttatgtctggcttctttctgaaaacaattcctcctcatgccctagtttcatgttgtgattttagcagaattaatctgaaatgactcaaaattatacaattaattgcattcagcttcaattacagtctgctggatgaaccaagcccactgccctctctgggcagtcacttgcatgtggcagctttgtaggtgctaaggccctgtggactccctggtcagtgtgctggcttcctggggaaagcattttggggttgacagtcccaggggcctaatgcctcagttgcagacaaatgcaggctggacctggggctgcaaaaatgccaggtaacagcaaagaccatggaggtgagtgtcatggaatttgggataaatgataaaacattcttttcttttttagtagaaaacccagatttgggtgtttagggttggagaaggcaggatctgggtaggtgtattagtctgttttcatgctactgataaagacatacccgaaactgggcaatttacaaaagaaagaggtttaatggactcacagttccatgtgtctggggaggcctcacaatcatggcggaaggtgaaaggcacatccacatggcagcagacaagagtaagagccaagcgaaacaagtttccctttctaaaaccatcagatctcatgagacttcttcactactacgagaacagtccaccatgattcaattaataactcccactggctccctcccccaatgtgtaggaatttacgggaggtacaattcgagatgagatttgggtggagacacagctaaaccgtatcagtaggtttaaggtttggaaggtggccagccccagggcagagaagcttctactggagattccttcctttctcctttttactctgtgcaattgtgggccctggggtgagccaggtgagggcaggtgcctgaccacaggatggaagggccggcagatggcggacccaggcagcagtggagggaaggtgggggttgaggggatgcagagggctgagagaaactggggatggagggaactgtggtcgacgcagctataggtctggacttatttttcccagatgaggaatatctttaagtccacataagtgagtcagggactgcttgtattcaacttgtgctcctttgaaatgttcttattctccccacgaactgactttcattcacaccgtctatttggcaatacatgaccgaatttggagcctagttctttttggcaagaaaagttcattaattttagtcggctccccacacacttcacaaatgtgcttgaaaaaataaagggcctcttatcgccacacagctgccacgaaattgccaggagtgctgagtgctcacatatagaagacggccatttatgttgatgctgtgagaagaaaaggtcccccgaagcactttgaactggagctgccaggaaaatgatggtaaatgcagaagcatcagcgaagccataggctttatgatcatttatcattccaaatttctaaggattatcttcatctcttttattctgtaaacactgattaacttttaaaggtgatggaagtctggctgagtcaaacttactcatccatcaacttagtggacttggagaaaaggccctgctgtgacattttgattaactgggatcttacctgtgtggggttttctttccacttaatatctaagaacacaagggtgggaagaaacttcagtgcctgcctgccttctgctcttttcctcatctgtaaatgaacatctgagaagggagtgagacgttcatatcagcctgtgcagtaggcctagctacactcatttatttgctctctcttttctgatttctctctgtactgggctgaacaatgttccctcaaaattcatgctcgtccagaacctcacaatgtcaccttatttgcaaatagggtctctgcagatgtaaatagttaaggtggtggtagattagggtagacactaaatccattgactgttgttctcgtaagaaggccaggtgaagacacagagacacacaggaggaaggccacgagatactggaggcagagattggaacgatgcatctacaaaccgaggaatgccaagatttgccaggagccaccaggaactaggagtgaaagatgaggaacagattctttctcagagcttccagaaggaaccagccccatcaatgccttgattccagacttttgtcctccagtagcaattctgagaatagattcctgttctgagttacccagcttgtggtactttgctggggcaaccctaggaaatgaataaactcattgtacttctgaggtgtctttgttctctttttaataccaggtatatactgctgctcattctaaatttcctcttgtccaacccaagtttaagagccgtaagtggcctattctaagttttcttcccatccaaggctctataagaggccattgccccaaaccaagggtttggaatagtcaaagatcctgcccagatgtgatgcccaggtgttctcagccgtgggtttggggatgatagatctctaaaactctcgaacatctagactttaaaattgtcatcccctgtgctggcttccaaccacaggttctgtgctgcttccagctcccttctctgctgttggagattatttggggactgactgcgaggcaagtgaatgaaatagatggcagaaaagacaaaggccaaaaaatccgctgcacctactggcttcccagatggtgtccaagggatgaaatagcttgagccctgggccacaccatatttctgtcctgactgtagctgttttgctaaggagcccgtactagccttggaggaacagctttcgatgctgcaaggaaagcacagagtggggatagctgatgggagttgtttcagtggtttaggctgacttggtgattctaggtatgccttaggccagtggctgctgcttcttctgtacatgaatgtcatgaatgtctgagtagggagtgagaggttcatgtaaaccttttatgttgtaggcccagctgtgtggccatgggagggtgcttggcatgattaggatggaaaacttttttgcctacactgatcatgccagagcgatttaatatttcaataagaatttaagggatagactcatcttggagtcgtcgtcttggcctgttttctcaccagtgttttgggtgtttgtccaagagaacttaagagttcttaactgagtattttgggcctgtgggggtcaggagaacagcatgttttacctctactgaaggtaggagctaccttggcatttggggtgaagagatgtgtggggtttcttagtgtaggggatggtcgtggagcctgggagacctagatggctcagttcttctaatttgttgagccttggtgcatccctctcttggggtgatgataatggtgccacctcagagggctgttgaagatgtgagatgcatatagaacacagcatctggctcgctgtgagctctctggagaggttagccattgagatggtttggctgtgtccccacccaaatctcatcttgaactgtagttcccataatccccatgtggaagggacctggtgggaggtagttgaatcatgggggtagttacctccatgctgttctcgtgatagtgagttctcatgagatttgatggttctataaggggcctttcccaccctttgctctgcacttctccttgctgccagcatgtgaagaaggacatgtttgcttctccttccatcatgattgtaagtttcctgaggcctcctcagccctgcggaactgtgagtcaattaaacctcttcttttataaatgacccagtcttaggtatgtcttttttagcagcatgagaacggactactacagccatgatcactagctgagtgtgctgctggggtcacctgctgtactcctgcagacctcaatctttacagagtagaaaaatgaagcctgatatcctcatgggctctttttgtatatcagaatctccgtcatctcccacccaccaaattggtttggagcaagcaacctgacataaggagtatgaccttcacaaagtcatgttgtgtaagtagcagtttcccaaactaggcagtgtaagtgagagctctaaaccacttagtggatgagggtatactgattttaatttttaaaagttgagttattattggaacatgaaagaaagcctatttcgcagaatcagccagtgaggcattccttcttttgtcaggatcttgtagttgctatgtcaattaatctgctttctatttaggccattgaaataaagttatatctaaaaccttgaagtaaggtacaaaaagtctacagcttcctggaacacagcctagacgctggagttaaacaaaaatggacacaggggtcttaagaccccccagtagaatatgcaacactgctagggtgccttgaagatcctttcaggtttgtcttcttttttatctctttattttcctttttttttttgagacggggtttctattctgtcgcccaggctggagtgtagtggtgcactctcagctcactacaacctccacttcctgggctcaagcaatcctcttgcttcagcctcccaagtagctgagactacaggcatgcaccaccacgcccagctaatttttgtatttttagtagaggtggggtttcaccatgttggccaggttggtctcaaactcctgagctcaggtggtccgcccacctcagcctcctaaactgctgggattacaggcgtgagccaccgtgccctgcccctttcagaatcttctgagaattgtcttactgtaatattccttacacatttggttaccgaccttcccagtacgtcattggagaaagcaaaggcaaaagggggaaggagagaagtaacatttgttaaatgctaactgtgtgccaaccacttgacatggtgcatgttatccccattttacagatgggaacgtagaggctgagggaggtaaagtaacttgattaagtttaccctgctatgaagtaatggagttgggatttgaaccactaaggaacacactcaggtattgttaagtaaaaaaaaaagggataatgattgagcacactggcttacgcctgtaatcctaacactttgggagattgaggtgggtggattgcttcagcccaggagttcaagtccagcctgggccatctggcaaatccctgtctcaaaaaaaaaaaaaaaaatacaaaaattagctggaggtggtggtacacacctgtagtcccagctactcaggaggctgaggcaggaggatcaattgagcctgggaagttgaggctgcacggagccatgatcatgttattgcactccagcctggatgacggaactacgataacaacaacaaaacaaaacacatgatgaatacgcactgaaagatcaaattagattctctacctccgttgaagaaggtaaaaaagtatatagtagaatccctcagaaatatgaatggttagaattatttttaaagttttgtaaatgtggggcaaatttctattttctggaaaattcttctggtggaacaccttgctctctaaaagtgccagataaatgagattccgcttgatttgagagctaagttctatgtccagttcttccttgctgttattaagcagcaaagagagacccatggttgcacactgggaggcttttctctttatcgttactgtgtttatagacccgactccatcgggggtgcttttaagtaagtaattattttggggcattgttgctctttttcgttcagtgcgtaagtatcactctctactgctttctgatctttttacttttatttttatttttattttttagtacttccaagtgagaagggatgtggcctcccagctggtgtttgtcagggttacatggtacatgtgcaggaagggccacatcagcaggccttgagtaatccatccgcagtctcgaaggatgaatcattcatgaaagcagttttccatcccgctcactggatgcaagcctttcttgcaaagttgatttcttttgcaaaattaacctttgctttctgctccttgcccacacagcttttgaaataggaagcccacagagttgtgttgtttttttctaagtaagtctaacggactgggcatttgtaacttcaattattacgcaaggtattgaattccgcctatgaaatctatgaaggtcattgcccgtggacttagaagtgcctagcagagttgaatggtatgtgggctgtgtgtgtatgatccatatggctgaagtcgtggttcttactattactatatgattatgtatattttaaaaatagctccttcagattttaactagttttaaaactcaaagtatgtgaaagggtttgcatttgatagaggggggaaaaggcatacttaatatccagggttgataagcgaaggcgtgccacctcctgtaagtccacccctttcatcctttacccccatttctcacactacttttttggtgttttgtgcgtttttattttttccgaattgcagcagtgcagacagggagaagaactaaaatcactctatagctggcctctgctgctcattacgttttagtgggataaaaccttgtcttgccctcctagttggagaaccagctgaattgcacctttgaatgttgctgggttttgtgccaacctgccagctgatggggcagaccagcagcttagtgtctcctttgctgtggaagcagaactgcgtccccattatttgacaggcaggaaacggtaaggctagcaaagcggggactgaagacttcaggtgtcccagctcctaccccagaggttggtcgcagacacaggtttataaaacatcagtatgtggagccaccttctctgaggttgtcttgttgtgtctgtttcttccttagaaaagcacatcccagatgggcatgatggctcacgcctgtaatcccagcactttgggaggttgaggcgggtggatcatttgagcccaggagttggagaccagcctgggcgacaaggcaaaaccccatctctacaaaaaatacaaagattagccgggtgtgatagtacacgcctgtagttccagctactcaggggaatgaggcaggagaattgcttgagcccaggaattcgaggctgcggtacgctatgttcacgtcactgcactccaggctgggtgaaaaaatgagaccccatctcaaaaaaaaaaaaaaaaaagaaaagaaaatcacatcccaatcctaatacttttaaaagttcatgtgccaaatttaatattcaagttgctaacatgttatctgtatgtaaaaaaacctgttcttctaaccagacttcttccagacttgttttgatcagtctcaaccagcatatgtcattggcacatttaagcacaggtatgtaatttttagcaatagtgagatgttctatagtggagtgcccgtgtcacctgagttgtggtgaacagtttcaaatatccttcattttccagtattcaaaaatgaggaaatgacctcagatttcagtgctatgataattcccctagttatctcctaattctgtgcttattttgtgttgcagcaagtgaagctcagagagctcgcgtgctaggtaggcactaagtggtaaaaatgatgtaacattttctggggaaatgtatccaaagatcaatttgtaatagaaaaacagtattcactgggcacttaggtttatattatgatagcagatacttgagaaccttcttggcatagaggcattctgtgggtttcatggtggcccatgagttaattggcagctggagtgtgaagtaattgaaataattgacccctgagataatgggtgtataggcactggggttcctaactatcgaggaggagactggggttcctaactaccgaggaggagactggggttcctaactaccgaggaggagactggggttcctaactaccgagcatgcttctatgggatgtcattgaggtgtttcctgtttccgtgaacagtgtctagttttttcttttttgaccctctattttcatcacttctaagatgagaccttggttgtgggcagagggtgtgtgatatattcttttaaacgtcgggtctgcttccctctgtttgaactcaagttggacagacaaatcccttcatggatggaagctggctggtgctctgcggtttctgagatcagtgcacaaggccaaacccagtttgtcaataacagcttcttcctcattgttttatgtttctaatgaaacagctcctattttgtagtacacaaaggggaaatgtgaggctggaaagcaacataggattcttcattccagacagcagccagtgggcccgctcatgaaaagttgatggttgtgcttaatgagagaagaaaaaaggcatctaatagctaaagtttgccttaacataataattacttcccatgtagcagttccatttttctaatacttgaatgtcttattgtataagaaagcaaggtacttatttatttttacaaccttacatctagtttctgtgaacgttttcattgtataaatttgtttctttctcaaaatagataaaagacaccaaccatcttttttaatctactgaagcacatgaatagtgcttatgtccattttaggatacttttttgtaagccatgatataggtcttccccaccaatggtggcagcttctttagaggcaatttacaaaaacacgaacacccctacctcccacctatggtttttgctttctataaaaatgttgaatatgtcatagctaagaggaatgaaatgtcctcctgcagagaataagaatctcttattaaaagtagcccagaagtttactgttggtgcttagaaaataattgaaggatgtggaagaagaattacaaagacatgcacacacatgcacgtgcacacatgcaaacacacacacacacacacacacacacacacacacacacacatttatgagtcactgactggcaatcataataaattatttccccagaatcaattgtaagcctgcagactccagagaggttggcttacccggcctggagcagtgctgggtggagttgtttactctcctgtggcagccttagggctcttgaggtatatgtgcgctcttagtcctctgttatcttctgtcaccgggagacaggcaacatgtgcaccagaaactgctgccatgcctgtcgccctgtataatgtgcagtttttgctgacttttctctgaaaccgtaagaaaagatctagtgactagctgagtcacttgaactatgtgagttaagtcacttgaactacacgagttaactgagcaaacttgcagctacccaggaatttgattttgtatggtgaaattcttagccttgattctgtgtttttttttttttaaatttttttatttttttgagacgaagttttgctctgtcgcccaagctggagtgcagtggcatgatctcggctcactgcaacctccgcctcccaagctcaagcgattctcctgcctcagcctcccaagtagctgagattacaggcatgtgccaccatgcccagctaattttttgtatttttagtagagatggggtttcaccatgttagccaggttggtctcgatctcctgacctcatgatctgcctgccttggcctcccaaagtgctgggattgcaggcatgagccactgtgcccagctagtttgtttgttttgtttttttaatttattttttagagcagttttaggttcccagcaaaactgagcagaagatacagagatttcccatgtacctcatttctctgtgcctgcacagcatccccactgtcatcatccctcaccagagtggtccattcattgcagttgattaagctgcattgacattattatcacccaaagtccacagtttatggaagagttcattcttggtgtatcttctgtgagttgtgacaaatgtatcatcatatacagctactattctagtatcatgcaaggtatattttcactgccctaaagatcttctatgctccaccaatagaagatccctttttcttccaacccttagcatccattgatccttctattgtctccatggttttgcctttttcaggatgtcatgtatttggaatcctgcagcatgtaaccttttcagattggcttcttacacttagcaatatgcatttatgttttttctatgtcttttcgtggctggatggctcatttctgtttagtgctaaataagattctatcatctggatgcaccgcagtttatccattcacctactgaagggcgtctgggttgctttcaagtttggggcaattatgaagaaggctgccataaacatccgtgtgcaggttttcatacattttaaactcatttgggtaaatatatgacccactgcaattgtggggtaaaatggaaagaatatgtttagttttttaagaaactgccaaactgtcttccaaagtggctgtaccattttgcttgccctccagcaatgaatgagagatctcattggtccacatccttgtcagcgtttggtgttgtcagtgttttggattttggccattctaataggtgtgtagtggtatctcattgctttaatttgcagatccctaatgacatattatattgagcatcttttcacatgcatatttgccatctgtacatcttctttggtgagatatctggtcttgtgcccatttttaattgggctgtttgttttcctattgctgaattttaagagttatttgtatattttgtataatacttctttatcagatttattttttgcaatattttctcccagcctataatatcttctgattcttttgacagtgtcttttgcagagcagaagtttttaattataatgaaatccagcttaccaattattttttcatggattgctcctttggcctttggtattgtatctaaaacgttattgccaaacccaaggtcatctagatctttctcctttgttattttgtagagttttacaattttgtgttttggtttttttaattaaatacaaagggattggtggtttttgtttcttggtagaaacatagtttgtttctttaccagtgacataagcaataacttaagtaaataaatgaatgactaggaaactctttgactaggccaacccccatagccttaataaccacaacttaacatttgcagaataggaaggactaatcctttaatttatcttttatgtctatccagaactttagtcctatgagctgttttgtaaacgagatttgttttgtgggaaagggaattttgtttcaagacttccctaagaaactgatagcatcgggtaattcttaaatttgacttatcataatggtatatctggaaggaatttgtcaactgatatgttataattattttttaattttttttaatttttgagataggtcttactctcttgcccagactggagtgcagtggtgtgatcatggttcacagcagcctcaaactcctgggctcaagagatcctcccacctcagtctcctgagtagctgggactaaaggcatgtgccaccatgcctggctagttaatttttttttttttttaagtagagatgaagtcttgctgtgttgtccaagctggtctcacactcctgagcttgagcagtcctcccaccttggcccctcaaaagtgttgagattacagaggggagccactgtgcctggcctgatatgttttaattctaacagtagatctgcatagagagaaaagttggtattatgaacaaaggtagctttaattcgaagagacaaccatccccattccacaacctctttccacccaagcaaggaaatttattgaggccagtaacattttaaatgctttttggagttgtttatttgcatgtactttctttcttattgtgtaagatttgacttttttttttaaaggagtttcttcacatggataactcagtttgtatagcctaatgtaatctcagcaataagtcaaaagctgttcttctgtagggctatatagttctctgacataggaaatcattcttagttccattatattgagaagaaacagagaagcattttacatccaagtgcaccagcagctgttttgttacatagctgctgtgtgcagagcccaatactgagaattttaagaagtcactgaaatatgtcgaagcacgaggatgggtctggatctcctcactctagacgcctgtaccttttttctgtagtcggtgaatgaaattttggaacatgaactgcacgtgtggaaagaatttgtgtgtgggtggaggaagcatctaatgggaactgagctgggggaagtagagcttggtcccaggtgtcccagctggaagagtttgaagccagacccagggagccctgcgtttgaggccacctgcactgctcacaagccacgggccttgggaagccctttctgggaacttgcttgtggagctgagatgggggtcagaattattctgcaaagtggttcccactgagcaacaagtgactttctcttcctccacgttttcttctccttacctcaaaatggaagaaacttcttggcaaaataccatttaacataatttggccacactgaacatttaaaaataatcaaagatggagtctgtgctgttaagaattgataagtattccacataaaatctaaacatcgttcttttctttattaaatttttggtgtaatgcacaaaaacttgaaacttcagcttttaataaaattgactttatttctaaagagaagtgggaataacagtggtgctaagattagcagtaaaagcctttaacctgcgaattccttcacgctggggtcaaagaagggaagtccacgtggatgtttgacttgtgacctcttccttcatttaaaaaaaaaaaagacttaaattactcatgccctcagtttaaatttgtgactggcatttgaaactatggaatgattcacttttccttgtagcaagaaaatttgaaaatgaaagcaaaatgatgctcatattcaaactgaacctactatgaaaagatgtttgctgatggcttcgttgccctgcaaacacacacgacagagatggctgttgttcaacacattattttcctcttcctctgagcatcttagagagggatgactgtgcatgttgcctcatgcgcaggaggtggtgtgcaaagatcttttggtttgtatcgtggcttacaggctctcatttaggccatggcatggtacattccaataccatgagtggttaaatctcaggaattccaaagtgtatgaacggagtgatgtcagctgtactctcatttcatgctatgtagccagatgtcgtgtagctaacctcagcagttactatacataatgtgctataactggctgatttaaggtaaactgcctcagtttcctcatctgtaaatgatggcttttgactaaataatagcttagttttcattgtgaacaaaatgcttgtttagctgggcaaacacatttttttttgcagaaaaacagccctatcaccaatagtacctgctctagtgcttttaaaaattagaatgaaattttgtttgtacatttttgtttgtttttgacagtctcactgtgtcacccaggctggagtgcagtggcaccatcttggctcaccacagcctcaaactcctgggctcaagcgatcctcctgcttcaacctcctgagtagctgggaccacaggtgcatgctagtatgcctagctaattttttaattttttgtggagatggggtctcactatgttgctcaggcttgtcttgaacttctgggctcaagcgatccccacgccttggccttccaaagtgctaggattacaggtatgagccactgcgtctggccttggttgtacttaaaaaacaaaaacaaaaaattaaaaaaaaaaacaacagaaaacttttcatggctcccaggagcatttatatgactaacaagttatctttccttgctgatagttccactttcctcgtgtttgacagaaatgactcttagtttaggaactcctcattagctgtttccaggagcagtggggtatcattttgatgcttctttatttcttctatgcaactaaaatacaaagtgaagatacgatgtctctgaaatgataaagctacatttgtcaaaaagcacatattttccattcgacattttggcttaaagaaatgaaaactacagaatgactttttcctttatctgggtctgtgctgtgtatttacctatttaaaaagatatacaggtgaaaaatattttttgaaatgaacttgtctgaatcaagatgcacactcttgcagcaacatcacagggtgtctctgtcactgaggactctgtcctcatttgtgtgggctgactgggtcgctggctgtgggaggcacacatttgctatcttggtgcagcagtttgtagtcagctgactgacttgttcctgcacatgcattttttttcctggcaagtcataattcatgtttttcctaaggtccaaccctattataactgacagatcctatctggctgagaaacatgggcacccttctgtttttgcctcttgttcccaacatatttgtatgcttttcaataggaagctgacctggagtaaatgcccagggttgtctgaggtctctaaatggaaggtgtggtctgaaaccagctaactatggcagcattagggcaagagcgcacaggtaaaggacttctgaaggagggtggagggtgggaaagtgggaggggcgagagctaacatgaatgaaactgaagagaaacagaagttgtggctggcatgcaggagaaacccagattcccattcaccacttcctctcacctccagaaattacccatcattcctctctattttgcaatcctctctatttcccctgaaggttctgctttgaatgctgtcttcccagcagaaatgttgaagggaagtagctcagcccagttcccttctgggccaccactttcaactgtagactttctagtcagagccaagaaggccatggactctgagaatggcatttaaagtctctgccgggctccacttagttccccttcccctacagatgccttattccctcgaaatgcaaacgaggctccatggccacagtttccttcctctttctgtccacattccagtcgttcaccatctcgagaacactggggcaccctcctctacccccagccagagctgtcatttagttgtgatccacaaatctgctaaagagaaaggtgccctgctatcattttgcaaaggcttgcttggaacacattcctgccattcttttttgctgctctgtagcctgagtgattatttgtttagtgtaggagtaaatatgaggggtgctgtgtttcttaaaaacaaaacaaaacaaaacttttagtgacatatgctcattgggggaaataagatagaaataaataatattgaaaacaaacacccgtcaatcacgtgacaaccacaatatagcactttggtgaaaatggtcttaatttaaaaaagaaagtccatctttctaggtatctgagcaattcattactattctatgtaatttttgtgggtttataattaattttgtagattgggatttactagcatgtgataccttgtaaaggacattttacattaaattatcttcctccctagcacattgcctaattctgtcacttgtattattgaggaaacatttgcaagtaggacaaaaagctgtctgcaaatacttaagctttgagttgtttttttctgaagtgcgaacacaatcaattgggttaagtctcccagcccctaagtgggggtatttatgttttttttaggagagaaactttggaagtaaatcagaagtacccagggccaatggccagagtcttagaggaaacataaacctctaggatccagtgagtatccacaaacttagagcactgcgaaggaaacagttgggttagcgttttattaggaaggtcagagatgatttagaaagttaacccttccaaggggtaattacccccaatatgtgtccgttgtggcatgctgtgtacattcactacttttttttttagtgggaaaataacaacatgacttggctgcatgtcccaggaagaggccacagaaatgaaacctcagggtcacatgaaggagattcccctgacatatttcagagctgatgcttaatggacctgaaccagtttgcttttttttttttttttttttttaaaagacagagttttgctctttggcccaggctggagtcaagtggcacaatctcggttcactgtaacctctgccaccccccctccccaacccccacccccgccaacctggttcaagcgattctcctgcctcagcctctcacgtagctgggattacaggcaccccccgccaccatgcccgtctatttttgtatttttagtagaaacggggtttcaccatgttggccaggctggtctcgaactcctgacctcaggtgatccacccgcctcggcctcccaaagtgctgggattacaggcttgagtcaccgcgcccggccccagtttgcattttttacagggcagagactgaagggcacttagagctacctggcccggcctggctttagggacctgatctgtgcagatatggtaattccccacgtgtcaatgcagttcagacttaaagggcacagtcagcccttcgtttcaataccaagaattgcccttttgaaagggtcttgaaggacttgacattctaggatttaattattagggggacgagcagaggcaatgagatgcaactctgaaacaaatgtttaaccacttgagtcaaagaggaaacagagtgaattaaaacttgaaaagtgatcttcaaatcggcttccgcccttgtaggctgattagacgacaactagcatctccaactaagagtgtgtataattagaaagccctctaggttatatctcaagtgagaaaagaaatatgcccttttcttagcctttccttatttttggcctgtatttgggaacttttttttttttttagtttagttttttttttaattgtacttctacaaagtgctctgcaagttgcatgagaatacatacaagagctttagcttcatttaggacatattctctcattcctgaaacttcagattaatttagcatttgatgacctaatattgcatttcctcaattttgttctataagtagcattcatcagagcaaagtttattttatgttggtggcattcagtaagtgatacatcacaaagaaagattggatactcttgcatatcaaatatactttgaactgtgttctctggcaatgccatagattttaactgcaactgacaacttgtacttctaagagagcatttatcattgttggatgtgcgttgtgtctgtctgctaattagcttgtgaagtccctcaggttattcatctcatagaggccagtgtctggcacagaataggtaaccactgaaggtatcctgagtggaattgagttgcaacagtgtgttatagacagtatagtccacaaggaaaagtagtcatcactgagcagaactgcattttgcagccctccatgattttaggggagagcaaatgtaaaacacattttcaaacaggtgagtctgactaatttggaaaattgaatggactgttttctaattttttttttttttttttgcatctgggatataaagcaacagtgaaagttactttttaaaaatgggctgaagagtgagaaatgaatctgacttatcaaatccgcagagggttacctttattactgtgctgcccttcatcccatgcctgcctgctttcatgacaagttgcagtgaagtcgtatttggctgtgagaagtgacttgccttcagggtcactgtgaaccatgtgggtggggccgggcaaatgcatatttaagtactataaaatatttagaagcagaagattcaaaatttgaccaatcagtttgatcaagtttaatttctttttgtttttaaggacatggtttcgctgtgttgcccgggcaggaatgcagtggctccatcatagatcactgcagcctggaactcctgggctcaagcagtcctttcctgcctcagccttcagagtagctaggattacaggcttgcaccactgcacctggctaattttttaaatttctgcaaagatgaagtcttgctatgttgcccaggagtggtcctctggcttcagcctcccaaagtgctgggattacaggcgtggaccatcacacatagcctaagttttactataaccaatgaggcaacctccatggagaccaagaagagggagtggtaccttctagacatcttgacctttgtcttctggttccaggagctgctatcgctaggaaaaggaagtcctgtctgctcacagcccacccgcctctgcacaggtgtccctgggttggctcgttgatggtagtggtggaaattgtctcagtcattacttacagcctgtgaatcctattagcatttctccaattttctctgtttttatcaagggaacagaaatccatcatcaggtatttccacaaaattgacctcatagttccttcctgggtttaatgctcagttgccaaaatagaagtgaagagtcagcagagttgatgtgaagtcacttggagtgaatatcttcaaattaacaagacgtaacatccctttcctgcctttagcccacaaatgcccacctctgctgagccaccttcttgcaaaggaggcttttggaaaagatcttttgggattatgtgaggatcccacatataaagtagcaggagaatctcgagttccatgggaaatgactataggtcatttttccattttcagagaaatcagtgcctttgaaagagaccatagctttttttgcctccgaccgaacttgcctaatttgtggaggtgaatgaggcagcctttgttctctgccagactttagtcagagcccttaagcatggcttgttgtccagagcatggtagagaaatttagagcatcatcgtaactgtagcaccaccaaaaataataaccacaggagctaccattatggaggaattgccccatgccctgcagccacctctcctcctccactcccccactcccccattcccccattcctccttcttctcctgctccagtattgcatatttttacctgactctgcagcgggctgcctcccccggtagctcactcctttgacctagactttgggtctttgtagctctggtgcttgtacctgctccctctgccctgggccaggattctcagtctctgggattggcctcaatctctgtgtttccccagtaccttgcttaccccttcacatgcatgtggattgcacggactcgccctggcttgctcacatgaaacactctcctacccatctcttcctttcagctggagccgctgtgcccatttcagactctgccttcacacctggactccagcccttcccttgtaacagcctcccttcaggaagagggtgtcttgcagcctagaccctcagttaccagagtccctcagaacagcctttcccattctactgttgttcaagtgtgttggtagagaaaatgagagcatcatgataactgcggcaccatccaaaatgataactgcagtagctactattaaggagtatagtgtctagcagctagtgttttggtagaaactcaagccaacacccctgtaatcccagcactttgggaggccgaggtgggtgaatcacctgaggtcaggagttcaagaccagcctgaccaacatggtgaaaccccgtctctactaaaaatacaaaatcagctgggcatggtggcacatgcctgtaatcctagctactcgggaggctgaggcaggagaatcgcttgaaccaggaaggcagaggttgcggtgagccgagatcacgccattgcactccagtctggttctgggcaacaagagtgaaactccatctcaaaaaaaaacaaaaaagctcaagccagaccgtcaggattcaagctcagtctcacacatatgaactgtgtgactttgcaatttactacttcttgccacatcactctttctcatccttaataaataaaatcatttatgaagaagattattaataccatcagtattatgaagactattactcttatcgttgatccttattttctcatgggacctatcaagttcaagtgacctaacattatacaatttaacctattcttctgcagcaacacacccagatggggaggaacccaataacaccgatggtgctattgacatgctcagaactttccagtgacattgtctctgttttcttgtatatgtgcatgcatgaacaagagctttaaaaattgatggggaccctgggctgctggctaaggagctctcctgcctgatgcccagacaatgttgtatctatatacatttgctgggaagaggagtcagcctagctggaaggctgctattgttatgcaaattggaaaagcacacttttaagctacactcttgcaaaatggctgagggtggcagtgtgcttagggctccagaagagtttaatcattgtaatgaatccaatggaaaaggaccaagtttgctgcttcaagatccatattccaccttcagctgtaaaatgtgctgcagatattgcacttgcctgaaataaagcgctctctgtcttttcttcttctgaagaatcctttggctgtgttttattataccggaagcccatttcctcaacttaaagtaattattaacaacaactaaagctttttctcaatgtggttgaattcggtagttttaggattcaggatggatgtagaaaaaggtttgtgtgttgcgcgtaacctcggtcgtgtagagtatgtggatgctttcaccagtattcacatggagcagttatgcaggatctgcagcagcaacagctctggtgaccactcagtcctctcttctccatttccaggtagaccttacatctttctctctgaaagtgagctgaaatctgataccctgtaacctccaccctttgtttctgcaggatttccatccttcagggacaaacagaacaagcttaatccttctggcaaatatcaggtcttcaggtatttgcagacagctaagttgcaagctgtcttccctttcaggtgaatcccctactcctcttaggaagtggtttccagtttcattctcttgttggaaaacttatgccagagagaggctgcaaccacaacagtgagggcttggaaccctgaaccgtgtctcaggaggagtgaataaagatttgttgtatggaactctcacctcctccatcctagataatatacctctgttaatgcagtctcttctcctagtagctcttttggcagccatggcacctcattaatgtgtttgttaaaatgcctcagtcttttcatctgtggtgctgtcgatctgcatttctgtagttttgaagctaggtatggggattttcgaatgatccttattactcagtggagtcttgatcgctattagcttggtccagttttggattttcctgttggtttctaatttagccatgcaggatgtgtactgtctttcccagcttcccatttcccatttgagacatttgccttgtgtgagttcggcatcgaggtatggaaaatgaagcctcatagcagcctgttacctctcctaaaccaatccccctgtcagctcacatttaatgcggataccttttatcttgggtacttgtcagaaggtcttcttgatacctgtgtcttacagatacagctaattgcacattgtaggaactgattaatgcccaggggactgagtgccatcacacataattgtggaacgagagattttgattgcagtcaatgaagattttcctccctaattgtgaggggtcctttttaaatactattatacctgattttcttcttattttttagtttttattttttgagatggagtcttgctctgtcgcccaggctggaacacagtggtgcgatctctgctcacttgcaacctctgcctcccaggttcaagtgattctcatgcttcagcctcccaagtagttgggattacacgtgcctgccaccaggcctggctaatttttttgtatttttagtagaggcagagttttgctatgttggctaggctggtcttgaactcctgacctcaagtgattcgcctgcctcggcctcccacagtgctgggattacaggtgtgagtcaccatgcccagccaattttcttctactcttggactggaaggggctctggtttctgctaccttttctacctttagatgtacgtggtcacactttgagggccttcagttggtgttgaagaggagatggcgggcccaagctctgcaagcctggtgcttgggggcatgttgcctccctgctgcacagcacttcctgccactgtcctggtcaagctgggtttcccgatttacggaagagcttgggctcagagggaggccgtgaggagccccgagagaatgccagccaaggccctgtctggtctaatcctgccagagcctggcctttgggtggaactgggagggccggggaagaaggttatgagaggcacaagctctggttctctgccattacctctcagcctagaagtggccattggatttctttgtatgttttctctttatagtaaataaagaggaaacttctcccctcactggcctgtgtaggctacagttgcctgaggctcaggcttgcctgttcttctaatcattgaccttcttgttagttggattctctttttcttcatttaaaaatacgccacatttcctttccctcagtcttgttgcaagttcccaataattttggagtcctgttaaaagacctgtactttttataaatttgctttcccttcaatctggagaaagagaagaggaattacttgtagagtgggtactgtgtctcagagctaggctgaagcttcacgtacatcatcctgtctgtccttaacaatcctgcaaggctggtgatgctaatttccattttagagtcggaaacagttgagaatgagagcttcacatacccaaggtcatgcagctggagaataggggtgtgcagatgaggacacagggcactgtcccacccaccctaccaggacgaggggcttcatgctaaactctggcccattagaaaccacttgggaaacataaatgcccacggatacagccatttcaaagatccatgcttagaccagaacatttagcacaaagcgaaacccacagaaacttcaaaaggaataaaaatatcatgttaatgttaagaaaaattatttaaaatttggaaataaggcataaacgtaacagcagcatgtagttcttcaaatgttagccaggggcgttgcttaacaagcctacccaagggttatttgtttagggtgtcatacctggctttgtttttaacttttaaaaaataacaactttgtggccgagcgcggtggctcatacctgtaatcccagcactttgggagactgaggcgggcggaccacctgaagtcaggagtttgagacaagcctggccaacacggtgaaaccccgtctctactaaaaatacaaaaattagccgagcgtggtggcgggcacctgtagtcctagctacttgggaggctgaggcaggagaattgcttgaacctgggagacggaggttgtggtgagctgagattgcaccactgcactccagcctgggcaacagagtgagactccgtctcaaaacaaaaaacaaacacagctttgtaatataattcacgtaatgtacaattcacccatttaaagtgtacacttcaggggtttctagtaatttcagagttgtgtaaccatcggcacagtcctttttagaacattctcattgccccagaaagaaacctgttagcagttactccccattctctaactgggcagacttctttcggatgtatttattggtggactctaattcttgtttgacctagctttaccaacttagttgttccctctctaaaccaaaaagtacccgaaacgtgtctcaatcaatttagaagtttattttgccaaggttaaggacgtgcgcccaggagacaggtctgtgcttttcgccaaagatgattttgagtgcttcaatgtttaaaggggaaggaggaagaaattgtaaaaggtgttggtagataagaggcagagagttgcattcttttcagtttttcatcagctgttcacatgtgagagggagtagaggaatagtcacttgtgcattcctctagctccgtgaatctgctttttttgtttgtttattttattttatttttttgagatggagtttcactcttgttgcccagactggagtgcagtggcacaatcgcagctcaccgcaatctccgccttctgggttcaagtgattctcctgcctcagcctcccgagttgctgagattacagccatgtgccaccacacctggctaattttgtatttttagtagagacggggtttcaccatgttggtcaggctggtcttgaactcctgacctcaggtgatccacccaccttggccttctgaagtgttgggattacaggcatggaccaccgcgcccagcccatattcaacttattttttaaatgataattcataaaacactttaggatcttgcattgcaatagcattgttatgaacattgctctaaagttaagatttttagtttcttaagtaatacattaatggttgaaaaaattagagaatatagatgaacaaaaataaaagtaaaattaaattttcccaaacactgccctagagacagccccgtatcacgttggtctgtgtccttatagactttttctcttgcaacaacttacagtatttttaaaacagtaaatagccccacatcatgattattgttaaatataagttttttgaagcactgtgtataagtgtagattaaaaaccattttggtttactgtaaaaactctggaagacaacctaggcaacaccattgaggacataggcatgggcaaagatttcatgacgaagacgccaaaagcaattgcgacaaaagcaaaaattgacaaatggcatctaattaaacttaacagcttcttcacagcaaaagaaactatcaaccgagtaaacaacctacagaatgggagaaaatttttgcaagctatgcattcagcaaagatctaatatccaacatctataaggaacttaaatttacaagaaaaaaacaaccccccaaaaaagtgggcaaagacatgaaaagacacttttcaaaagaagatatacatacaaccaacaatcatgaaaaaacactcaacatcactgatcattagagaaatgcaaatcaaacaaaataccatctcacaccagtcagaatagctattactaaaaagtcaaaaaatattagatgctggtgaggttgtggagaaaaaggaacacttttacacttatggtggaaatgtaaattagttcaaccattgtgcaagacagtatggccattcttcaaagagctaaaagcagaactgccatttgacccagcaatcccatggctaggtatatacccaaaggaatataaattgttctgttataaagacacatgcacacatatgttcattgcaacactattcacaataggaaagacatggaattaacctaaattcccatcaatgatagactggataaagaaaatgtggtacatatacaccatggaatactatgcagccataaaaaggaacgagatcatgtcctttgcagggaaatggatggagctggaggcaattatccttaccaaactaacacaggaacagaaaaccaaatactgcacgttctcacttataagtgacagctaaacaatgagaacacatggacacacagaggggaacaacacacagtgaggcctgtcagaaggtggagggtgagaagagggagaggatcaggaaaaataactcaagggtacatggcttcatatctgggtgttgaaacaatctgtacagcaaacccccatgacacaagtttacccatataacctgcatagatacccctgaacttaaaaaaaaaaaaaaacattttggttttagaattctgaataacaattcatcatatttatttttaaattcattttgtcttatattttctggcatgcagtttggaaaggtaatatatttgttttgtaagatttttctttagtttttaaaatttgtgggtgcttctatgccttcatatccttctttgtatggagactttcctagttcctttgtctcgtgtttttccccagttgctctccactgttacccatgggcattagaatcccttggacgccttcagatttcctttttggaggctcctggccccattcctttgtaattatgtggtgttccacgtccctgatgttttattagttcccaacatacttgatataagagaggtaattagtgtattatggcttctttttgaattgttccccaagataagcagagggaaatgttacatgggtaaaaatttacataataatgtgaccaggctttgtcgcaaaagctcactgtaatcatgagaaaatgaaagcattttatttatggaaagtttccgcatgtatttgtctctaagaattaaaaattgccactgcattatggtggcctcagatttcagaagaaacattgtactgtgtttacttgtaccgtgccctgcctttctaaccaaacttgaataccctcttttctgttctgagactgttctatggccattccaccattgattgaaaccaaagccaaaccagaacattaaatatgaaatgctttttccctcacccacaggagctttgtaattatatggcttaaaaaaaaaaaagcactgaattcttaaatgagagtgtttagtaaaatatttggaacagcttcagcttcctactttccttcagtgaaccatggctgaaggtaacgttttcttggtcaatgtgaattgcgttccttcccccggtgcttgattttcctttgacctactccgtctccatagtttgcatgaggtggcccaagcctctttccataattttacataggtgttaccgcagaacgctgccagatggctgcctgtcttggtggggagaagtccctggatctgctgtcctttttcattctcagcactagcgtcatttctgccacaagtcttccctgaactcaaggctgggctgagggctattccccaggcactcacaccttacattggcaagaccttcctccacttgtatgatcctgaaatgttctcttagtgactcttttccaaactaaaagctccaggggggcccctgagcgaagttgatctttacaaccaccagggcccagcaccatatctgggatgtagctattgctcgataaatatttgttgaccagaaggtaagtgaaccgagtactccctatccactgtgtgtctacattcctgccaacccctgtatatatatgacaacgactcttcagtcccaggcctaatagacttgccccagtcagctccttcctgatttcatgtaagagtgacacgattgaatacttcctccttcctgaaacgtttccccctgttggatgtcggggctcctgctctctgctcgcctctctcctaggcctgtctctgaggtttggccaactcctcttgtcacccctccagcactatgagcaaggaattctggttctccccacaccatcttttttgaaattgcattcgaggtctccagcatctcttctaggcagatacctgaagggactgggcttcatgtagtcctcccaggcctgccagactttctggccttcaactaggagcttcatgcgtgtctgtggaaggagtgaccaatggacaaacatacaactctattttgaaagtgggttggggctgggtgtggtggctcatgcctataatcccagcactttgggaggcagaggtgggtggatcacaaggtcgggagttcaagactagcctggccaacatggtgaaaccccatctctactaaaaatacaaaaattagctgggtgcggtggtgggcacctgtaatcccagctgtgtgggaggctgaggcaggagaatcacttgaacctgggaggcggaggttgcagtgagccaaaatcgcgccattgtactccagcctgggcgacagagcaagactgtctcaaaaaaaaaaaaaaaaaaagaaaaaaagaaaaaaaagaaagtggatcgagtatgaattatgaaattgcaaagactagaaggatacatgtgggtcttgcaaggccttgcccttgagtttgcaatcaactggcttgtttaataaacaaatatgtgctaaggatgatggctcctcatggaacttagggcatgcaatcattgacttcagaataaaactgtagcttaggacccaaagagaagaacagaggtaaggaagaatcatgagctcactcgctgctcaccccttccagtgcccacctagagtccttcagggatcatagcttcaaaacccttccagtggattctttctgaagttcattctcagactctcagtgatctttactaccttttaaattaggaatgttcttcacaaaaaggaatgctacaggttacttcactgagtacgaggtgaagattccaagtgttcattttctgtgtggctgtatattatttgtgtgggaacccacattcttatctcaccactaaagatcaagaaagtactttcaccagccagcaagcatcacttgtatgtggtcattgtatgattacaacggcaggtaccagcaggtgtattaagcagaacacacacatacaaaggcaatgattttaaattggactttggattaaagtaatatatttaacccctcaagagttctgactgtgttaaactcatttataatcatgagcaaatgagtctatactaatgcctcagatgtttttgaatttggcaacttctatttcctaattgtgatttaggtttaaataactttttcacttatgctcacctgtaatctttgtatgcctttatttctccccgtggaagtattcacaggaccctaattcattagtttggtaatagctctttactgctttggacttaaaggtaccctcggtatttttaacagacacagatgtgctgtcccgtagagctgtcggggaagaatgccttgaatcccgaaccacttgctcttgttcatagtacttaattttcacttactgaatcatttgctttccaaaaaccaccttgttgcatgtattagtttgttagggctgtcataacaaattaccacaaaccgggcagcttaaacaacgaaagtgtgttgcctcagttccaaaggctggatgctggcagggtgggttccctcagagagctgcaagagagaatctgttccatgactccccctggcttctggtggtttcccggcaatctttggcattccttggcttgcagaagcagaagcatcaccccagtctttctccatcttcacatgagttctcccagggtgtgtttatgtccaaatttccccttgcctttatttttattttattttattttattttattttttcgagacagagtctctgtcgcccaggctgtggagtgtggtggtgcagtctcagctccctgcaagctccacctcccagttaacaccattctcctgcctcagcctcccaaatagctgggactacaggtgctcaccacctctcccagctaatttttgtatttttagtagagacagggtttcactgtgttatccaggatgttctcaatctcctgacctcgtgatccacccgccttggcctccaaagtgctgggattacaggagtgagccaccgcacccagcccaaatttcccttttttgtaaggatgccagtcatattggattagaggccttaccttatgccagtgtgaccccatcttctctaattatatctgcagcagccctttttccaagtcagatcacattctgaggtactagaagctagaacatcaacatgaattttatggggatagtttgtattagtccgttttcatgctgctgataaagagatacccgagactaggtaatttattaagaaaaaaaaagtttaatgggctcacagttagttctgcatggctggggaggcctcacaatcatggcagaaggtgaaagtctcgccttacatggtgtcaggcaagaaagagaaggagagccaagcgaaaggggaaaccccttgtaaaactgttgaatctcgtgagacttactcactacgacgagaacagtatgggggaaagcactcccatgattcagttgtctcccactgggcccctcccacaacacgtgggaattatttgagctacaattcaagatgagatttgggtggagacacagccaaaccatatcacagttcaacccctaagagtgtagctaatacctgaaataatcagatgacatttttatttgccaattctgtgtaggagagatgggtagaaataatagtaaattgcattgagtgtatgatcagagactattgagaaaggtgattgttgtcagatcctaaattatatgaaataatttgggggattgtttttgacatatgtcatataaaagtaacttatttcccaggtttcttattttttctgaccagctctttgtccatactgattcaataatttcccaatgttcttcagctaatggagaaaaagagtttgaccacatttgtaaaatccaatctaactaatgtatttatgttttagctttttattatgtacattttcatatatctggaaaagcagagagaatagtataataaaaaccatatactcttcttgcaactttaataattgtcaactattaccaatcttgtttcatccatcttctctccacatatttttcttgctggagtcttattaaggaattgcagatatcctgttatttcacttgtataattttttttaagttagagaaatgtaatgtcatactttctcactgttgaaattgaggagaaaggtaaaactacttaatgataagtattaggacatacaccttggcttttacattgtaatgaatttaaagaaggaaaagcaggagataaaggaggagtggggagggtggggttgggaagagagaggatgtgagagacaccagctcctttacatgtttccctccctaccacgtttccctccctaactaaactctgagctccttgagggcagaaactgtgtcttggtcccccagttaccttcataccttatagggaattggtgtatagtaagtgtacatcagtaaacatttgctgaataattgaatgaataaaagaatgaacgatgctcccccaaaaccttgcatagaaagatacagagacatgctcagaaaaatacaccacatttagctctagaggtaagacaaaagaaataaaaagatcctgaaaggtacattgcttctcgcagttttcaggatattttctctcacatttagatcccgtgtagcatttctgcaaccctgccaagaagcaggactgtcctaacgtgctgagtgcttatgcccttagcgagggagagaggtttcatccatgctgtgagagctcattcttcatttgcattacgtgagaatcgaagcctgagttctgagtattttgactaccttccatcctctcagaattctggagccacactttgttttgcctgccatttgggagaagattggggttgctgtgaagcttaaagtgctacacattttgctgaagaaagagattgcagtctcagatgtccatactgccggcagacctacatgcttatagatgtgagtgacattgaagcaggggaaacaagtcctgttccactacactgaggaggccttggactgaaggcaagagagaggagagaaggcagagcatacagtcccaaagccgagtccagcctccttagctccttgcaactcacactcaaaccccagtttaagtaattccagactgaaaaataaaaaccttaaaaatattgcagagagaagtttggtattagagtcatgataaacccttgtatagaacgtgttgcaatgattattttttagggtcaaaatgaggaaacctgacatgcacactgggttttggatgttcagacatgaagcttgtactgccaagtgaggaaggctttatgcccttaagagattaaaggaaagttggactcatcagttgattctgaaatcaacccccaaacactgcttgatctgagttttcaaaagctaacctttgggtttctctttaaatatttttgcgtgatttgtcatatacttatctttaagagttttgttgttgttgttgtttacataaagcagttaccatttaatgctacaggtactcaagatttcattcatgcatattcttagtcaatatgagaaaaatctatttcattgtagttctgagttgaatatgggaataagttgaaataataaaagaaggagactgtttatctgttggcaaacgtgtcgctgtcatcatctgcatccttctaagtgtgtggcttctgggccatcatgggcgagtaatgaccacatcccattcttatcttttctccttggctctggaaggagtcttttatactggtgattgccggactgttcttgagatttttcttccctcaaccctctccagcccccaggctctcttctgactcttcccacccctcagacagcctcgtcctttctaccatcaaccacaacacttgggtgtttccaggactcgccttgcagttctccctcaccatgaagacatctctcatggcttggtccacagtcccccgttgtcttttggcctctaaccttgaatctccacctgcttgtctgacacatctatctgggtggcctaacagtatattatacttttctcaaattgagacccctgtttattgtttcattatgttttattgatatataatagttgtacatattttgggggtacatctgatattttgatgcagatatcaaaataccatccaaagagttctttggcagcgtgtgcacaggtatcagaatatcagatgcacccccaaaatatgtacaactattatgtatctacatacaatgtgtaatgataaaatcagggcaactgaaatattcatcatctcaaacatttatcttttgtgttgggaacattacagatcttttcttctagctattttgaaatatacagtaagttattaactataatttccctgctgtgctatcgattactagaacttattccttctgtctaactgcatttttgagcctgttaactaactggtcttcatccctttctcctcttttttcttcccagcctctactcgttacctctgtgagatctacttttttagctcccacatatgagtgagagcatatgatgtttgtcttcctgtgcctggcttatgtcatgtcacataatgacctccagttcttttcatgttgctgcaaatgataggatttcattcttttttatggttgaataatactccattttgtagacatactacgtcttccttatccattcatctgttgatgggcattaggttgattctgtatcttggttattgtgagtggtgctgcagtgaatatgggattacagatgtctcatcggtagactgatttcccttctttctgatgtatacgcagcagtgggattggcggatcttatggtagctctgtgtttagttgtttgggagagtccatagtgctttctgtagtggctctaccactttacattcccaccagcagcatccctgccttcccttttctctgcatccccaccagtatctgttcttttttgtccttttgataatagccattctaactgtggtgggatgttactgtgattttcgtttgcatttccttcataattagtggtgatgaacattttttctcctacctgttggccatttgtttgtcatcttttgagaaatgtctattcaggtcttttgcccattttaaaattgttgagtgaagagtttgagaatattttttccaattctgtaggttgtttcttcactttgtttcctttgctgcacagaagcttcttagcttgatataatcccatttgtctgtttttgcttttgttgtctgtgcttttgaggtcttaccccaaaattttgtccagaccataatgccctgtagcataaaacccctgtttaaacaacatgaagagtagtttctcctctttgagctcgtataatactcagattgcaagtccccaagtccaagttaattcttaacttgccccttggtcttctctgttcattttctacaacctgccaatttaccctttagtatttagaattctttctgtggaaagtacagaaaactcattcaaactggcgtgaacaataaaagcgtgtatgatatgactttgtggattcaagtgtattaaattatatggtatgtaaatgaagaaaatgacatttttaaagggtatttaatggttcgtgtgactgaacagtctgaaggtgatagccttgctgacgccaagatctggtttctttctttctcctctgagtcttctgtactctcagtttcatcataaggctcacctcttggttgcagagtgctaacaccatttactcagttgctctggccgggagcttggggccgttcttgactcgcctttccttcacatcccacattcaatctcagccctgtcttcaaagtatatctcaggtccaaccaggaaggaatgcacaaaagatgctcagtagtctttgttgaaattagagaaaaagaaggcaagggaagaattaaagatgaatctcctaaagaagggggaaagaggcttgcctgcttagaattgggaatactggatttttgaaagagttcattgggagcacgtgcacagatgctgaaaggaagaatcaaggtgctgtctgaagaatgacattctttataatatgtgatagagtgcatttatttgatttgttttcatacaacttttaatgtgtatcccaggagaagactgttttcattgttacaaatctgaaaccaataattttcttttaacatgcagatataatataagctcactttttcattactttccctacaaagctgaaagcggttgacttgccttagagattttcctttcattatattctgctgtgacgttgcctttcattaatcccttccagctaagcaaaatttaattagaaccatatcacgtgatggcaaccatttttgtatttaaaaaaaagaattcaaggaagctcagctaccagtcttctcttctaagcaaagtctattatatttagtaggttctttccagaattcagaatatgttacataatggctttttcttcattaattttggataatagggaatttctatgcctgtgttccgttttacatgactgtgacctgaatttaaaatgacatggacttgagggtgaaaggaaaggaaattattttttaaaggagaaatggaaaatgacccttagcagtgcatatatatatatatatatatatatatatatatatatatatatatttcccccctcaatgaatatagcaatccgtgttagatgtaaatagggatgaacccattttgcatatagattaagtgaccaaatatctcagtagtttggcaggaaagccaagcctgcagcctgaggggcctcacttccaccatcattattgacaactatgtgctcaagcgagcagggagggtgcaaggaacacgtctccaatccttaaagattatatgagtcctttgctctcaaatctgaattttccctttgtctccactttatgccagcactgattttatttagaattttatagaatggaagcaaattcattctttctttcatcctttcttttctttctttcttttccttccttcctttccctttccctttaattcctttctttccttttttttttctttcttgagacagggtctcactctgtcacccaggctggggtacagtggcgtgatctcagctcactgcaacctccacctcctgagttcaagccgtcctcctgcctcagccacccaagtagctgggattacaggcatgcaacaccacacccagctaatttttgtaattttagtagagacagggtttcaccatgttggccaggctggtctcaaactcttgacctcaagtgatctgcctgtcttggcctcccaaagtgctaggattacaggtgtgagcaaccacacccagcccaaatactctttcttgatgtcataatgaactcaattatgaacacaagtaatcataaaaagtctatataagcaaggttcttactgcctcttcctattcctcttatttataatttcataaatattgctctaggttgataagttaaaaatttttatagtaggttatgtataagatttaccattttaaccattttaaatgtacatgtcagtggcattaagtaccttcccagtgttagacgaccatcactaccatccatttccagaactctttttttttttttttgagatggagttttgctcttgctacccatgctggagtgcaatggcaggatctcagctcactgcaacctccgcctcctgggttcaagcgatttttctgcctcagcctcccaagtagttgggattacaggtgcccaccaccatgcccggctaattttttgtattttttagtagagacggggtttcaccgtgttagccaggatgatctcgatctcctgttttctttttgttttttttgagacggagtcttgctctgtcacccaggctggactggagtgcagtggtgtgatctcagctcactgcaacctctgcctcccagattcaagcaattctcctgcctcagcctcccaggtagctgggattacaggcacaagccactatgccttgctaatttttgtatttttagtagagacgtggttttgccatattggccagggtggttttgaactcctgacctcaagtgatctgcccacctcagactcccaaagtgcagggattacaggtgtgacccaccgctcctggctgtatgaattcttgagccaaacacaggtgactgttatttgttctgtttctgaaatatactttcgacaagtggtgaaaactctccttaatttccatctagtttacttccataagcaagattagcaaggaatatggatcacaagattgggtgttctcagttttaaagccaggcaatgtcaagatttgttatttggccaagtctgtggtctttattatttttttgtcccaccatgtcatttgctcagtgtgatttgtgcatttccagtgtcgtccgtcactgctggggagcagacaaatatcacatagaggattagagaaagtgattttgtgcttagaaaataattgaatgaagatttactttgtgactggaagctgcaggatagcatcctgttttaaaacctctcattgggttatataaccagaggtgaccaaagtctttgaagatgaggcaccatctctgagtgagtttttgttggatagcctatgcttgcttgagcaaagacttgtttaagggccaaggggggcccccacgacaatcatcagatggaatcttccatgacacgtctccacttccttccagctgagtggctgttgtctttaagttgccttccttctaccaaggtcaggcagatgtttgttgaaggtttgctatgtaacaggtaccaccttattacctctttactccaatttcctttgcttcatataccatggtgagatgaattcctttagagccccaaattaaaaaaagacaaaaaacaatagctcctgatttttagccaggggaaaccctatgatgtccatctccaggcaaacctaatgcatccttttgttttattgagccagtcttttcctctttcaacaatgctagcaagacttctcaaatgtcttcattagattatcttacaaaatatgcattacccaatttagtttggaacttggacccaaagatcaaggccagccatctctgatttttggaacctctggctgttgctcagttttctggggcagcctttcccaggcacatgctgcatgcagccagcgtcggccaacctccaagctcctctttcctgttcccctcacggtaagtgggggtgttggggaggagagggggcatctacactttttctccttagtcacccaggattgggcacattctgtttcttcttcctttggagatcatccattctgaatttcgaatcttcaagtaggcttagagggctctttatccctcagataacgtgtctatgagtggctgtctggaaacacatggcctttctgtctgcctctcatagggtgaatccagtccttcaaatgggaagctttcgtgtaaggtaggtggggagggggtagttaaggcaggttgggaggaaattattttgggataggtaaagctttttgctgcctctgcaaattgtgctggataatgagggcccgggtcttcttaggataacattcggcatgagtttttttgaggtgtgcaatagaaatacttccagctgtagatacataattgcattgacctgcaaatcatagacagaaagaacaggtacaaaaagcaaactattcttccatgggatttgataagtgtgagttttcttaacagtgttcactgaatgtggagatggttttttttaaaaagagatgaaaggcccaaatgtttgaacgattaagtagggaataggaatgcttattttccaaccaaaacactacatctgtaataaaccgtgatgaggaagtaatgcccctgtaacctttttcctttggtaatttatctttcttattccagtggatgaaagatgactgtgtgcctggggagagagagcagatcagattaatttgtgccatcacagcacggctttattatccgtccttcgagagttttgcaatcaagatgcttttagcagaaacacagtggagaaaggccacttctctcagggcttgtaggagctaagcactgccctttgagtgtctctgtgctgcctgggcagccaagagggctgttttcttcgattcacactcacctcctcctgcccctgactgtgcagggcagacaggtgtggccagcgtgctgggcagccagcaggatccctcacccagggcacctccccctctaaagggatgcttgctttaagagctctccacttgtcacctttctgtggatggttcctgtttggttatctggctctttgtctgctcaatgccaggcatgcattttcttttttaaaatgtatatttttacagtgacatggtatcatgagtacctttaaaatgtgtatttttacaatcacattatattatgattaccttaaaagaaaaccctttaaaaagaattatccatgattctatttccctaatatactgtatcttcatcctctgagttgtatatatgtgtatatgtgtatgtctatgtaggtatatttgtgtgtgtgtgtgtgtgtgtgtgtgtgtatgtctattttgtcatatacccattttcctgttacccatgtaaaaaatcttggcatcagctctttaccctttctgctctggaaatcctgccagtgcatatgacatgatgaaaggacggggggctgtggtgtccagcaactcttagcatgaatcctgattccatcacatggtgactcagccttgggaaagaccatcctttgtttgttggttcattcatctatccatctgtctgtcctccctgcctcccttcctgtctcccgttcacaagcattcactgtacagcatgctagatttgggggatctgggcagcattttcccatccataaaatatagatattgcagcatattaaggagcattgttaggaggattcaatttgctaataatgcatgtgaagggacccagtacaacaacagcaacagcctggcacgtgataagatgctcagtaaatggtgctgtgtggtcagtcagcaagtctcatcgttcttgtgtaatttccctggcctctgttacttccatttcttagcagcctgcatgatgatggccaattactttcatacctagactatgcaagaggcttctaatgaggcattataggcctcaatctattctattaaattcttcctattaccaccatttgcacttctaaagcattgtttttgtctgtgttactctttgttcagaacctttcagtgatttcctaggctattctgaatttcttactggccactcacagccctctcagtactctgggctcctcttgggatttcagctctgagccatcctgccaccctcttccacctacggaaatgactcaccctctttggtcttctgtatctactgccatatgtgcagggaactgtattatcattggtgagaggagaaaatagcgtatgagccacacatttgggaaactctaaccttccttgtgcagagtcttagttcatttttgctgctataacagaatacctgagactaggtaatttgtaaagaacataaatttgttttcttacagttctagaggccaggaagtcgaagatcaaggtgccagcattgagcaagggcctgtttactgcatgctcccagggggaggaagaccttgtcctcgtgtggcagaaggcagaagggcaaagagacaaaagggggctctactcacctttttgtaatgacattaattctacccctgagggcaaagccctcatggtggagtgaccccccaagggtcccatctcccaaaactgccaccatggcaaccaaatttcaacatgggtttcacagctgacatgaaatcaaaccacagcatgcagtaaagacttatgactaacctagtattcctgagggtatactgttttttaacatgttgttattattcaacaaatgataagagtagtagatgatgcctttttggagctagacttcaagctttcaaggagagactaggtcatttattttttgcgtcctctatcttattaccatcaatacaaacctttcagggggacatgtgcagtagctcaacgcctacaatcccagcactttgggaagccaaggtggacagattgcttgagcttaggagttcgagactagcctggccaacatggtgaaaccgtgtctctacaaaaatgtaaaaatgagcagggtgtggtggcacttgcctgtattcccagctacttgggagtctgaggcaggaggatttcttgaacccaggaggttgaggctgcagtgagccaagatcaccccactgcactccagcctcggtgacaaagtgagacccggtctcaaaaaaaaaaaaaaaactcttaggggattactttctataacagttattttgttgattcatccttaggactatttatcataaccatgttaagctttgaaaatatttactgggtagtagattttgctgaatttgcaggaactctcccaactggtgacagaatctgtagcaaaaagacagatataggaaggtgttaaggtgtttgctaagattgttttgattcatttcaaaggtctgttttctgtagattgcatttgtgtctgaatgagtttattaagttgctgaggaagtcctgcaacccacatttagggatactcacattatttataatcagttattctctttatattttatttcaaccacggaatacaatgtttatatacatttatatgtgtgtgttagtgtgttgctataggatggtgcaaagtattttattttattttattttattttattttattttattttttgagacggagtttcactcttgttgcccagtctggagtgcagtggcatggatcttggctcactgcaacctccacctcccacgttcaagcgattatcctgcctcaacctcctgagtagctgggattacaggcgcccatcactatggccagctaatttgtgtatgtgtgtgtgtgtgtatttttagtagagatggggttttaccatgttggccaggctgctcttgaactcctgacatcaagtgatctacctgcctcggcctcccaaagtgcttggattacaggcatgaaccgctgtgcccggctaggatggtgcaaaatgttctaaattttgtttcccggtttctactttgggaaactgtcttacaatctgattctcctctccctcaacttcagagagtaagagccacagtttgtggccctgtcagtgctggcattttgggactctgttatctatgagtctaatcaataccaaatgttgctgattctagaatgaaatgccttctgattgctgtttataagattctgtctgtagtgaaattaaattgacttctaacagcaagtatctctgtttggaaaataaagctcgtatgttaaatcatgtctattctaattttagtttcctttttctctaccagtttgctgttttgtggtccacaagaggtgccatgaatttgttactttttcttgtccgggtgcggataagggacccgacactgatgtaagtagtcctgaaatcatgatttgatgtcaatgtggatttctgagctttaatttttttaacgcctgtgcaactgttagttttggcacttactgttaatgggaagactcaattctcatagagcgttggcttgtagtaatgagcagatttatagcccatatgagctctggactacatcttagagaatttctcagaggagaatttcttggtagcatgtactgttccactttgggcagctgcattgactaaatccaccaaatttattgtaatagctttcacaaacacaatgcagttgttgacagattttacaatgaacatttatcacccttcagtttatttccgttccctcccctcccctccccacccctcccgtcctcttcgatggagtctcactctgttgcccaggctggagtgcagtggcacgatctcagctcactgcaacctccgccttccaggttcaagcgattttcctgcctcagcctcctgagtagctggcactatagatgtgcaccaccacgcacagctaatttttgtatttttagtagagatggggtttcatcatgttggcaggctgttcttgaactcctgacctcaagcaatccactcgtcttggcctcccaaagtgctgggattacaggtgtgagccactgggccctgccacccttcagtttacttctaagctgaaataaaccaataggagcatcattgctttgggccaatgtaacaaactgctcctggtttactccaggggattcttgctgccttttcggtgtatgttaaaaatgctgctgctgattgaaataatttagcatctgtttcactgaacagtgatctctgaagttgcccatgtgtgaacacataatttcctctctttgtggacaattctgatggtctctgttgcatctcttgtgtacttaaaaatgggatccacaggccgggcacggtggctcacgcctgtaatcccagcactttggaaggctgaggcgggcggatcacctgaggtcgagagttcaagaccagcctgaccaacatggagaaaccctgtctctactaaaaatacaaaattagctgggcgtggtggcgcatcctgagatcctagctcctcaggaggctaaggcaggagactcatttgaacccgcgaggcagaggttgtggtgagctgatatcgcaccactgcactccaacctgggcaacaagagcaaaactccgtctcaaaaaaaaaaaaaggatccacaaaggagtcacggaaaataccaatgtctaaaatatgttggatagagagaaacttcagctgttatatgaaaagtaatattttaactgaataaaaaaaattgtcaggcaggcttagaagggtagacatttctgttctgaattgcttttgcttgatcagtttagtcactcaaattgtgtgcttgaagcgattcccatctttaatgcctgttcccatcaggaaactttaatttgaaagtggctatctcagtgcaggcaagactaaattcttccctttgcgaaagatgacatttttgcagtgtgctctgagggattccgatttgcgttgttgtaacacaagtaagaaggaagttactgtttggtgttcagtgcacgggaacatgcacaatggggttagggtgcttgtggaggcaagatagagtgcctgttgtgggctctgagcccacatacacatacacacgggttccacaaaggctcacaggacatgggagccagaggaagctcaggcgtcaccttgttttataacttcatggacaaggaagcccaagtccatgaacgttgagtgacttgcctgcatacaaacaaaactagttagtgtcattcccctgccctcccccctgctccccgcctcctgccccctgccccggccactttccatacttctcttctggcatattctggaatattgtcttcctttggggcattttagagataaaaatagctggaacgtaaagtactaacttttccaaaaagccaagtcccattgcacttgtttggagttgtctaaaacctcatgtcatagcctttcacttccttgctcatcattcccatctttatcttgctgtatttttctttcctctcttctcttctctctcctcccatttctgccccatcaagaatgggaagggaggatgggcaggcttcaggatgtgagtagtttgtctgactcccttctcttcctttttcttccccctcctactttttcattcttttggttgagtattctttattgagaacccataatgggccaaagtctgtgcttagtcctggggtataacactaagtacagagatatgctccttgccttcctggacattctgctgtgggaaggcagacattaaaatatcactaattcaaataggatacaggtacactgagcaggtttctctaagggacatactgcatttaaactgagcttgacgaatgggtaggagataggcagacaaaaggaagggtgtgtgtgtgcgtgcgtacgcgcatgtgtgcacacatgcatgctgggctgtatggggccctggaaaaggctgtttcagacaaagggaagagcaagtgagaatgccaagatatgggaaggagtttaatcaataacaaacagaaagctgggagttgggtgtctggcaaggattttgggcacaggcttaggagcattgggggcccaggaaagagtttaaccttaagggctcatctcttaatacagtcacattggcggttaagtttcagcatatgaattttcaggacatggaccattagcagacacattcagtgtgagatgcctgacgctgggagtcagttgagtatggaggcaggtgtggcagtcagaagtggggtatgtcctaaagataaagattcctatgatttttttttaatgccttggatgtggatcatttttgcctagggagagggtatagagtggggagagaagggattaggtctcaggagagagctctaaggaactccaacatgttgcatgggagaggaagatcagggtagggaaaccaagaaggggcagccagaaaagtaggaagaaaaccaggggagtgtgatgctgattgaatgatttcctaaggggctataggccaatactgtgatcgtatctctgtgtttgttatgaattctctacgttgctgaaactgcgtataagtaggtaacatacagtttgtaaaggacaatcttatttacatgggaaagtctttgtttatgcccaccatggatcaattgatgcctgttaattatttttggtaactcatttcatgctcagattttttatcttgtttggctgatcattatggggtcatcctactcatagggcctggagccaggtaaaaagctttagaaaagatatgcttggtgcgaaatataacggaaacacacccgtgagctgatgcccagccatgtcctgctcctaatcttgtgttgactttctgtagatgctgagtcttacacttaaaatatccttgaaagtaatgatgattagatgaattttttttaatgtgaaagagaaagaggtatattagatattcaatgcagtcctgcctgcctggttcacaaaagatcatgcattcacccaaaagatcatgcattcacacctgcatccatactcaactgactcccagtgtcagacatctcatgccgaatgtgtctgctaatggtccatgtccccgaaaattcatatgctgaaacttaactgccaacgtgattgtattaagaggtgggccctttaggaggtgattcagccatgaggtggagccttcctgaatgggaccagctcccttattagagaggtacaagggagctgttacctccatttccccttttagcccttctgtcatgtgagtacacagcaaaaaggcaccatccaggaagcagagcccagctggtgccagatacagaatctgctggcaccttgatcttggaagagaaaggagaaaatttgatttttggtctttggagcaagagacctatgactagggctttctgcagccaaggcctgagaagtgttgactggctgtatgcaggatgattttacttactgtgcaaatctgcaagcaaatcttatgaaggtacaaggtggccaaactgtgctgcaccagggagatagttggaaaatcatgaaggcattgggaggtagaactgagctgagatgctagaattttcttattttatccttttctgaataccatttttctgcaaatcccagaagtattgagccagaaggggtgttaaggatttatctgggttaaccttactttgtggatgaggagacaactaaggcaaaaatgatctggggtactgtcatatgttatctcttgagtatccagtgggcttgtggttgattctttcaaggcaattggccatgaagagaaacaagatgttggtggcttgactggattgtgctgccagtggagcacattgacagctattccttggtgcatttgttgaaaattctggtcaggtgtttggaaaactagcagacttattttaccatcttgagaattaacttatcctccagtccttttcagtgtcttagaaatcaatccaataaaaaatgcctgctggcaggctcagtgaggaagaccagtgaaaagaatgggaagtatcagaatttaagagaaaaaaaactgccctaagcatttttcccctgaaaaatttaaaaattttaaattaggattttttttttcgtaccatggagaatggttaagatgtcctgttcatgtgctgcttaatagtaccttcgttgagcttggcagactctaacacattcacagacggggaaaaagaaggtacaatccttgtgaaatcctcaaatattgtacctgctctgccatcttcaagatgaaaggatgggaaaagtactgagaaataaaatagcggtacccaggttacagtagccagatgggaagacattacaaagttcttttgaacagagatgctcttcaagactcaaggagcagtcgtagttgagagtatgcattagtgcagggaatcttggcagagaaaaggctcctgggttcacagaaggaccctccctggagatcctcaggccaatttctcaagggtcctctgccccttctggatgagatggcattctgtaccagcaaatctagagcaaaaagctgagcaattcctagactttaagtccgtccccatacacgctgagtagagaaggaatgaaagcagaagacttaagagaaccaacgttagcggtgagctcattccctggtactgcctgtgtttgcacccggggctcaggcttggatgctgaagtatgtggctcatggaatgagcagcagctgtcttcttacctggtgttgggaaggcactttgaattggtgcaggatttatgtttccaggtgtgtggccctagaatgcagcttggggctctgcccagtaccccattccagcatccgaggtttcatcagacaacataaaataagacaaaagtgctctgtgtttagaaatggcttctcccccttctccaccaaattaagatgcagactcggacatgggcaggtagaagtcgagagtagagccgtggtttttggggcagtgggagtagtgagcctggctttgctctgctgaagggcagcaagtgcccatgcttctttggctgccattgattgcctgcctccgtgggctgctctggccatgatggggtggggcagattcaggaagggctagtggtgtggggtctgcagggctggctctttccagacttcttcctctcacttcttaaaaccttagctcaccagtgtcttcttgatcagtgcggagctccctgttcttagaagagtttctattcattttcgattatgtctgttcatgaagcccaccctgctatgaagaggaagaatggggtctgggggcctcccattatgcatctgtgcatggatgtattgatatgtatttgtgtgtgtatgtttattagcacattaagccctttttaattttttttttttcttgagacagagtctcgctctgtttcccaggctggagtgcagtggcgcgatcttggctcactgcagcctccacctcccggattcaagcgattctcttgtctcagtctcctgagtagctgggactacgggcatgcaccaccacactcggctaatttttgtatttttagtagagacggagtttcaccgtgttggccaggctggtctcgaactcctgaccttaggtgatccactcacctaggcctcccaaagtgctgggattacaggtgtgagccactgtgtctggccctttttaaaattcattttctctgtgtgtcttaagtgagaaagctacaaagcagcactttgacagaataataccaagctcagtcctgctcttagggccacaatgtacaactccccctgccctgcagctttctttttttttgagacgagtctcgctctgttgcccaggttggagtgcagtggtgcgatctcggctcactgcaagctccgcctcctgggttcacgccattctcctgccttagcctcccaagtagctgggattacagttgcattccaccacacctggctaatttttttttttgtatttttagtagagacagggtttcaccatgttagccaggatggcctcgatctctggacctcgtgatccgcctgccttggcctcccaaagtgctgggattacaggcatgagccaccgcgcccagcgtgccccccagctttctcgtcaaaagttgtaagaagagaagctgtttttatgtgtcatccataaaataacacacatgctaagcaactgtttacacataatctttagagtgtttactctgtgcattggatatgtggacatttgagaaagtaaggggtggtgggggagagagtgggagagggatttgttaaaaggcttcaagcgtctggaggtagtaagctttcctcgcgtttttgttgagccattatgtttttatttgccccatgtgtttttaccagtgactctggcttctctggggagaaacttttcccacagtattttgcacgttttatgtttgaaccgtcccgttgaacagaattcaggtgacttcgcaggttattgctctatctcacctggcagacaaccaacatgtataccggtgacgtcacaggttcactgaagcctgccagaatgtttggaaggggaccaaatgaatacattaattaacttgttaaaagatagggaggcttgcttcagacctgggtacaccttcaagtcagtgaagatcataaaactgatctatttgaagaagctgagcgcactgactgtaaacatttaaagctaaaaacggaacctattgcacaaattgctacaaaccaaaagtgatatcccctgtgagactggactccgtggaggactatatgtctagaaagcaaaattgctttcttttctttactacaatcttgagaattctctctttctccagtccttttcagtgtcttagaaaccgatcagataaaaaaggctgctgaaatgttgaaaattcagcatttcaaagattcatttataataaaatttaaagcatttaaaataaacctagaaataaatttaacagtgaatcttctgttttttcgaagtgtacttttaaacattgaatttagaaaaagatgattttgtgagcaaagccagttctacccccaaaacatttttatattcctgaactgacacggtaaagttagatttgcatgaggtacagaagctaaaaagttgcatttaaaattcagcagagtatatcgtgcagagagtcctggagtgggaattgggagtcctgccaggccacattactgaagccctttctagacctttgttttcttacgtataaatatggaggttgaatttagagatctttaaagttgccttcagccccaagtttcattatagtccctctgttattaaacattgattgatagccctgtactgtgaaggttacaaaggtaaagagagttcctgccctcccaaggcagggattatcctctaattgcaagggtaaaccaattaggcaaagagttgtactataagattgcacagggtgggccactagcagtggcccacgcctgtaatcccagcactttgggaggccgaggcaggtggatcacctgaggtcaggagctcaagaccagccaggctgaccaacatggtgaaaccccatctctactaaaaatacaaaattatctggacgtggtggcacacacctgtaatcccagctacttgggagactgaggcaggagaattgcctgaacctgggaggcagaggttgcagtgagccaagattgcaccattgcactccagcctgggcaacaagagtgaaactctgcctcaaaaaagaaaaaaaaaaaaagattgcacagggtaggtgccataagtggggaagaaataaaatgctgctgagtttagcagggagagagccagcctgcatctaatgggagaatgcaggaagagcttcataaagatggtgacatttcaagatgtatttcaattcttttcatcattttcctttgaaaataagtccatcagtgtttttctgttgctcatgttggcccatgggagttacgtctcttgcctaatgctgccatccagcagtgcctacactcaggtgacatatttgccagtggacctgtcataagagtgcaaggagggaagcctgtaatgttctgcatgtcctgtcgggacccccctcccatgagcctctgaggaagcccgagtccatttctgaaaccaccctcggcacttgcccgcagatacccttcttcacttgctgtgatgccacaggaaaccttaaaaagaagttatttcggggaaacacacccaacaaaaaaactccagtgctaattctgctcttcagtgggtggattattttatgtaccagattcacagtaacagaagtatttcctacaagggaagggactcctgctgcacttggaccaaattaatttagccgggagttaaaaatagcctccgagacttctatcctcatccgtagttctgatgagcaaaaggagacagtgggggagtgggtggcatggccattctcttgacccaccaacctctggccacagggaagagggagggatgagtatttgccccgttgtctgcacctgattagctgggaaaaaatgcgcgacgtaattacaaagaaaatgctcccattttcaccagtgtttggaaggcatgttttcaagggagtcacctgggggcttgtcagctgaatccctaggttgtagttcctacctcccatctttggaactccacttttgaatggcctggacgggcagtagtacatccttttcaaaatccttacccttgccgagttgtcagcctctgagagggtggtgagattgtctcgggaggcagacaacaggccagtggaacccagtcagaataagggagccttttgaggtgggtagaattgtttttggtcaaaaaagaggtgagatgatcaattagagtgattttgttgtgaaacttataaaatgcctctgacatcaagtctgggaacagatctttgtgtattaaccatagagagtgtgtttgaatcattgtataatgtctccggggcacttttatttaatatgcttatttatttatttacttattttgaattttagaggtgagacttgctatgttgcccaggctggacttgaactcctggacataagtgatcctcctgcgtagctggggagacaggcgtgagcagcttcacctggggcatgtttggttttttaaaaattatttacttggaggccaggcgctgtggctcatgcctataatcccagcactttgggaggtcaaggcaggtggatcacctgaggtcaggggtttgagaccagcctggccaacatggtgaaactccatctctactaaaattacaaaatttagccaggcatggtggtgtgtgcctgttctcccggttacttgggaggctgaggcaggagaattgctcaaaccctggaggcggaggttgcagtgagccgacatcgtgccactgcattgcagtctgggcgacacggtgagaccccgtctaaaaaaaaaaaaaattatttacttgggatctggcctaggcaacatagcgagaccctatttcttaaattaaaaaaaaaggtcatattacttaatgatcatatttacacagtgaattctttgtgagagggtcctgtgtgttttctctttgaaagccgagtgcctgatacagggcctggcacaaattagatactcaaaaagtattcgttgaaccaaagagaatgagttggtgaaggtctgataacctaacttgatcaccagtcgtatttatccggtcttgaattacttgaatatttacagctgtgcgtgagacttttactgaactcccttaatacccaagagtagccgtctcatcagcatcattattacggctgatgctgggggtgtgggggaacacacctgatgggcttttctgtttttcccagtaactgtttcaaagtgtagtcttcactatttggaatttagtttaagaagtagtgggtgaggcaatagcttttgactggttgggatcaacaattggtatgatggattccttgtttattttttctgaccgatccaagtgactcagtgatactagacatttcgtgatgtacaaacagccaaattacctgaccctgagaactgttgttggaaatggtgtctggagagcctgctgtaggagtgcaaattctcggaagcccagagttggaagatccacggcacaggatgtgacatctttgtgataccatgtatttagcgtctcttatgtgtctggtgtttttcttgcatttattcattgtatgtaaacattaaatgtttcttgagcatttattgtgtgtgaggtattatgggaggcaaaggttaaaaaacacagttcttgtcttcaaacaacttatccttagtgggaagtcatgtatatgaataaatattactattcaaatagtcacttcagcggataacatacataaatgcactaggtatgcattattgttcccattgtacagatgtgcaaattgaggcttgaggtagttaagtgattctcccgagtgcagtagtaagtggagcactaagctttgaactggacctctcaacttccaaacctgttctttttccacagtaccacgtgactgaacagcaaagctaacttaggggcagttttctgtcagtgaaggttccatttttgtgggtggagtctggggtcattgtgactatgagaaatcttaaaatggtaaaagaaatttggaatcatacaatcctgagacattaacagtaaaaaccttcacaaggcagattagcaacgtgaactagtaaagacaggagcatgtagggctgatgggaccgggtgggagctggcagcagtttggagacttggtttaggtccttctgaagagggtacagagtgggacttttcaggacattgggtttctggaaagatccgtttcaagtgtctacaccctaagctgaaagccagcccagagagctttttggctcatgctggggcttattcctggattctgatgagtcatgttttttagaagctgaacttctaaacttctaagccgagtcccattcagttagctggtaccttcctcaccttggctttgttttctgtttttgctgcttaatacatttccagcaggagatttaggaagggtctgtggacagagaagtagatttcccaggatctaagaaaagaaggttggtttactgtgggtattctagctgtcattataactgtgttattttatttatttacaaagggatcatgagccagaaccaatcataacaatcaaatgaacccactcactgtttcagcctctgatggtggctaagagaaaacagcaagtggggagcaccccccctcacagtcgcctctattatgttgtaccagaagctgggatccagcaccctcaaacgtagaggcttgtactagcaagagtcacatggacagtgggaaggtccattctaattattttgttagtaattcagtctgttctatttattcttataatctagcacattccaaaacatatttgttttgagaatgataaaccaaggggaaaagtcaggttttaagaagaatgtcatggccacgaagataacactgccgttgggcgttgccgtggttctgactgggtgaaggtttcccagtgaccatctttgtgtggaaagagcactctgctcctgatgttggggatgtcatgccacccacgtacatcactgtcctcagcattccagcactcttgcctattctccgtgcatctcttccaccctgcaagccattgcttatgtcaccctgattgatcatggtgtaacacccagctgtcctctgcacacaggatcccaagccagaagtctcaggattttcttggttgtctccatcttttttttgtttcacgcacctaataggtttccaagtgctacgagttctgctttcaactctctttcctctccatctccatagccactgtctttgtgaaggccttgttgtgtgctgtgagttggtcttactgactctggactgtttctcctctatgaactgtctttcatattgccaccccgtggtactccagttgttgttgtttttgttttttaatgtgattatgcactctcttgcttatcatcttccaaggttggtacagagtcactcacagcggcctcactggctgttagctgtggctgctggccagggagtcctaaggtctgccccacattagcttgggagggtagtgcaggttttttacaagggagtggcagttttccaagaaggaacacctcagtgtacacacacttaataggcttcccctggcgctgtgtttcccagtgtttcattggccaaagcccagagtcactgtgaaggtttatgaatcagggttctccagagaaaaggaacgtgtgtgtgtgtgtatgtgtgtgtgtgtgtgtgtgtgtgtgtgtgtaaagagatttaatataagatgttgactcaatgcaattatggaggccggcaagtcccaagatttgcagggtgagctggcaagttggagacccaggagagccaatgggatagcaccagtctgattctgaaggtctgggagccaggagagctgatgatgtaagttccagtccaagctcaaaggcaggcaagcttaagacatcagctctgaagtaagagctgatgttttagattgagtccaagagcaagaaaaagctggtgaccaaatctcaaggccttcaggcaagaagaatcctctcttacttggagggagaggcagtctttttgttccattcaggccttcaacagattggatgagatccacctgcactaggaaggacagtctgctttgctcaacctcccgatctaaatgttagtatcatacaaaaacaccattgtgtaaacacccagaataacgtatgaccaaatgtctgggcacctggggcccagtcaagtcggcacataaaattaactatcacagaagggtgtggaacctgggggtatgagtcactggggccgttagtgtaaccatttgccacaggcagacttgtttgggttataattctttcctgtaaatcttattcatctctgtatccccaatgcctagtatgatctctgacttatagtaggtgatcattaatgtttgttgaaagagcgaatgaatggaaaaaaaaaatgaagtctttgattccctaaagaaaatgaaaataatttcatagacttgagtcaagcttgtccaacccaccttattttgttgtcgtggtggttctgttttgttttgtttgagacttttggcaacctgaagccatgttttttagtttctatctctagtgataagcagaaaagagggatgaggaaggggctttactggcccaacaagaaacagaaactaagaacccatgactgtattctctcccttggacactcctaggagtggaatatctgtgaaatgtttcctgcgattctctcagaatcaataccagccacttcctgattacaagttaccatctttagaaagagaattttgttttcggggggaaaaggttttttgtgttgagggactcttcagtgcttgaagtttaagcctaacgaaattatgcaagatgcccactgaactgtgcctgctgtgtgaccagaatctcttaacctcatgagcattttttggttaaatgttggtaggaaaaactgcttattgaaaggcaaaacttgttttgtcacctgcgtattttagggtgatcatccttgaagtgatggcttatcatgtagagaggtttgtaaccaattgcaattcaaaagggagaaatggagagagctaacagcttaaggaatcaatagcctttgatttctttcccatttgatcactgcctttctgggtatattcctgactttacatagcctgcctttgccaggacagagactgtcttcagaaatcttagagtttactattcttgttcatgagaaattgttatgagattgctgtaggaaagtatgtattttactaattttattatttttttttgagatggggtctcactctgtcgcccaagctggagtgcagtggcccaatcatggctcactgcaacatcaacctccctgggctcaggtaattctcctacctcagcttccctagtagctgggactacaggcgtgcaccaccatgcccggctaattttcgtgttttttgtagagacgggattttgccttgttgcccaggctggtctcgaactccggtactccggtgatctgcccacccctgctccccaaataacgtattttaaaacatacagattataactgctttacaataggtgaggcattttttttcgtgtcataaaacatgcctgtgatgaatgcctttaggaaagcagtacgcctattgctagctttctgcacttccaagtcccaagcctattcctcctcatccctttttcaaggcaggaagctttgtagaatgagcatgggatatcagtgtttaaaacataagaatttcatactcgaaaatgatcttctctgtggaggtgggtgattttaggtttctagatattaagcttgtattatgactcatttgttcttaaacaggttgttctccagttactaaaattaatcacaaaagaccaaggaagcttgaaaaagaaggggagttcatacagcaggtcttaaaattagaaaggcagggctgctctcttttgcatttgctcagtttgaatgatgcaccaggatttaggtaattcatcgtaatcgttgttttttccccattaagaattggtaactgggaataacttaatgtgtaaaactagacggggaagaaaaatggtaggctgaatatttaagaaggaatcacattcctaggtattaaaggggcttgggcttgcggatttgctgctcgctgtcagtttggacacgtgtgctcaaatcaggtcattctctcatatagtgaactttttttttttttttgagatggagtctcgctctgtcacccaggctggagtgcagtggtgtgatcttggctcactgcaacctctgcctcccaggctcaagaaattctcctgcctcagcctcctgagtagctgggattacaggtgcacaccaccacactcggcttatttttgtatttttagtggagacagggtttcaccatattggccagggtggtcttgaactcctgatctcgggtgttctacccccctcagccttccaaagtgctgggattacaggcatgagctactgtacccagctgtcagatagtgaacttctgtccatccggcagccagacaatgagagagtccagcacagtagcgcctctgaagaaatacactgcttgccaaatagcttcctagcttggctcctggtttccattcccatcccctacagtttaccctccacagtagctagtctgatgttttgcaagtgttaatatcaggcagatcaaatcattgtgtcactccatctgaacccttcagtgccctcctcttaaccactggaataaaaaatatgtatacccagcctggccaacatggtgaaaccccgtctctactaaaaatataaaaattaactgggcttgttggcagccacctgtaatctcagctactcaggtggctgaggcaggagaattgcttgaacctgggaggcggatgttgcagtgagccaagatcacaccactgcactcagccttgatgacagagtgagaccctgtctccaacaacaacaaaaaaagtgtgtgtgtgtgtgtgtgtgtgtgtgtgtgtgtatttctttctttcccttggtccacaaggcccatcatgattgtgatctggctcctgcacacctcactgaccagaacatcccaagctcattggcaccccagggctgctgccctgggcggttcctctttgtagaactaatcttcatgatgctcattcgtacgatttcagactccgctgaaatactgcctccttcgagagcctttttagatcataccccccttgttattattatttttgagctggcccaggctggagtgcagtgtcatgaacttggctcactgcaacttccacctcccaggttcgagcaattctcctgcctcagcctcttgagtggctgggattataggcgtgcaccaccatgcccggctaatttttgtatttttagtacagacagggtttcaccatgttggccaggctgatctagaactcctggcctcagttgacctgcctgcctctgcctcccaaagttctgggattgcaggcgtgagccgccgcacctggtccccctcattattttctattactttatgcacttcaaaccccctgtcatcatctaaaaccatacaatttatttgttacttgattattgggtatctttccaccaacttgaaagcaccgtgagagcaggatgttatcttactcttctgtttaacctaaaatggtgcctgatgtgtggtaggtgctcagtgaatatttgttggctggatgagtgaatgcattttagttgcacaagggagatgaaagatcttatagggttttttgtttccttctaacaataaaactaaagggaaatgtcctaagatcaatagagactttttcctttctatgactgtgatgccatgccagtgaagcctgagacctgccgtgtgatcggacatcttccaaataaaaggtgtgttcttcttaatcttaatgtttagaatatgcagcctataaaattaattttaaaataaaatgcatacagtcaatcttatttaactagaatacttaaccacttgattctgaatgttgcccattctggataagtgaagtagatgttgaatttaaaaccttgagaataatttgtatctaataggatcctaaccttgaatattatggctgcatatcgacttgggatcagtgtcctctcttagattgtcctctgcagtcattaatttttttctgctaatattcttggtgagcagtagggtgttgttaagtaaattgatgcatcagtgtgataaaatacatgcagccattaagaatgatgcttataaagacatagaaaaatgcttatatgatgctaggtgcaaaagcttaatataaagttattgccatgattgtcactacagcagagttagtgtaggggaacaggaagtagaagggaacctaaaagatggaaatcatttaattgatttttaaggtgatttgacatagggagattttctttttggatttaatcttgttagaacaatacaattttcaacagttataaaattctgtttacagtagtccccacttatgtgtggtttcagttacttttagtatagtacactaagatattttgagagaccacattcacataacttttattacatacagtatattagtataattgttctattttacaattagttattgttattaatctcttactgtgcctgatttataaattaatctttaacatgggtatgtacatataggaaaaacatagtatatatagggtttggtactagccacggtttcaggcatttactggggtttcttgggatgtaggccctacagataaaagggcgactgtacttgtacctttctctagtctaagccatgtaattctcttgaaatatgacagagcactgtcacctcccagaatgctacatgaatgaaacatacccacccatctgagaactctccttcgcccaacagtgtgatgagaaagttgtctgttgcagatatctacactgctgcatgctaagtgtgtcatcctgggattcaaacgtgagtaatagaaaacctgactaagcagcgacttgaactgaataggaggctcgctctcctcatttaacaaaatgtccagaacagggcagtccaaagctgatacagcagctccatgtttctgtgcgggacccggcctcctccagcgtttagtttagctgtcttgtcttgtaggcttctttctttcattctcatctttgttacccggtaggtgtgagatgcctgcttcattagcatcctacccgtgctccaagcaggaggtgagccaaaggtgaactcaaatcacagatgcttgttaaggccgttcccattcaaagaactcctccagaaacaattccattccagcagtttccatttacatcatcttggccagaaccatatcatgtagccactccgatttggaaaatgttaggtttctggtttatctggatggttttgtttgcttgcttttgttgagcatgtttctacctggaacaaagttaacttagttttgtgataaagaagggatgtggccgggtgcggtggctcacatgcataatcccagcactttgggaggccgaggcgagtggatcactaggtcaggagatcaagaccatcctggctaacatggtgaaaccccatctctactaaaaatgcaaaaaaattagctgggcatggtggcctgcgcctctagtcccagctactcgggaggctgaagcaggagaatcacttgaacctgggaggcggaggttgcagtgagccgaggttgcagtgagccaagattgcgccgctgcactccagcctaggtgacagagcaagactctgtctcaaaaaaaaaaaaaaaaaagaagggaatgaatgttggataggtaactaacagtgaactctgtcgtaaagttgctgaggattgccttaccatgtgtgcacacgtgtgtgtaagtcttttcaatgctcctattgctgtgacttcatctctagtacaggaaggattctgtcacatgacgtcatgacaggttttgagatacagtggaattaactgagtttcttgatctgctgatgacagaaaaaggagacaaggatgaggaagtcttgtgtgagtttttctttttttgcggggggtagggtgtctcactccttttgcccaggcttgagtgcagtggggtggtcacagctcactgcggcctcaattctctgggctcaggtgatcctccccccatcagtctcccaagtagctgggactgcaggagtgcatcaccatacccagctaattttttatatttttagtagagatggggcctcgctatgttgccctggctggtcttgaactcctgggctgaagcaatccgcccacctcggctttgcagagtgttgggattacaggtgtgagtcaccatgcccagcaatgagtttttgtttttgttttttgtttttcttaaacaaggcttttcttttatctttaaacactttgttggttctctctgtttggtagttgtactatgtctaagttgtttattttgttaggagcattttgttgtaatcatgaaatattttgagattcaatacttgtgtttattcagtcataatattcttattatataatacttcctgatagtagatattaggattgattgaagcaaagcatgtgtattaataaactcagtattcattaaagcagcttgggttgcctgtagaaacggcagagcatccccaaggctgagggaggcggggctcctctgtgggtagcagacttcatctgcaggacaatgtgcagcacaggctgcgggtattaaaggagggatcaagaaactggtattaccaggggcacttgggaggataggggatcaggtaagccatagcatagagacccagaaaatgagccaggaatgttcagtgtgaaaaaaagaataaggctgggcgtggtggctcacccctgcaatcccagcactttggaaagccgaggcgggtgaatcacttgaggtcaggggttcgagacgagcctggccagcatggtgagaccccgtctctactaaaaatacaaaaattagccaggcgtgatggtgggtgcctgtaatcccagctacttgggaggttgaggctgcagaatcacttgaacctgggaggcagaggttgcagtgagctgagatcataccactgcactccagcctgggcaacagagcaagactctgtctaaaaaaaaaaagaataagttgcaggacttgatatgagagctgcctttctaggaagaagggtggactcaccttgggaactccatgtgctgacccagaccactgacaaggcgttatcaggggacagcattttatacaaccctgagaacaacctccagtgagtagatgtttccagcaacagaacaaggactgcagaacagggaggctgaggtggcttaacaagaaatgctagctctgatctgggccgaagcagcagtgatggttcccctaggccggaatttgatgcgaggctaggatggatattgggttttctctctggaatagctcagctcctcctgtgccacctggctaatttgtactctttcttcaagaatcggaattggccggtggttcacgcctgtaatcccagcactttgggaagccgaggcgggcggatcacgaggtcaagaaatcgagaccatcctggccaacatggtgaaaccctgtctctgctaaaaatacaaaaattagctgggcgtggtggtgcgcacctgtagtcccagctacttgggaggctgaggcaggagaatcacttgaacctgggaggtagaggttgcagtgagctgagattgggccactacactccagcctggcgacagagtgagagtccatctcaaaaaataaaaaattttcagaattagtatctcaggagattttcctgactactccctgtcccccaatggactcctttcttcccctcctcgcccccaattcagttgtttctcttccacctcctgcgtgcctctttgaagactttcataccacttgttgtaattgttcctctgtgtctgcccatgcactgtggcccttgagggcaaaacctatctttcatctccccgtccctgtcctcagtgcttacacagaatctggcatgtatctggctctcaacaaatatttattgaattagcaagtaaatgaatagagatcagattctgcttgagttaaccttgacgttagacagaatttctgttctaacttttttcacgccaaaaccattcttacaggtttttctgagccaatctgttgtggcctcttagcataatggatagttactgagaaaaaagaattaacaccaagttcttggcgcaagtgccatccagttgaggtgtgcaacttccatgcttgtgacaaggttgaaaattactcatcaagctgtttttgcaaagcagtttctgcttatcagtttacgcatgaaaagtccactctgtgtctgtgttgatgaccataacgtggaccatctaacagctaggatatttaggatggttgtgagtacggctgcaggttcccttttgcttattgaaatagaataaccagagaagaacaaggcaagttttaaaaataacttggtacacatgtaggtgaaataaccttacctcccagtagctgagagaaaaaaaaaagatctcaatgctggctgttgttccaggatatttttagtaagatggccctgtcgtctttgatggtcaatgaaggaataatggcagaaaaaaatattaggcgaggagaaggctacgggcattgtttggtgtttcatttaatttccacctcatccaccagagaaaagcaaacataagcagaggttgatgatgagcacagtagaaaggaaaatgtgatgtgtcttttccttgtagttggttgataatatgtgatttgcttataccacattctgatgggaggtattttcagtctgtggctttgtaagttgaagggcctcctaagaaactcctgtttcgtaagatattctctgtcttaacttttttcaggaaaaaatatgattttttggagttgcttaatagtttttagcttttaaataagtatagtttatttaccacagcatttgaactgtcaggattttactgtgaatgctaccagaaaggtttgttctatttttacgagaatcttcttagggaaattgatgaacctggtaacctaattttagacctcctgaaatttgacagatggatggtatttatagtgttctgaatcggtccctattagacatttaaaaatagtcacatcattagagaatacattcaaaaaagaaaagatttttaacccaaaatctaatgcccagaaaatttttagtctcctaaactgggtgtgcattttggtaacagtttctaaaaagcctttttgtactctcctcattctctttcctgtgtgatgctgctgttgtcatggaaacagatcttggagttgctttgttaataccgtgtaagggactccctgaaatggagagttactgcaggtcattatcatcaacacagagctttaatatcaagtgttgtgctatgatgcgtacactacaaagcacagaaatctgtgtttggaggttacactaaagacatttaaccttgacacccataaacactacacaaacatcagggtcttcagtcatagaacctggaaaagtggaggcaatgggctcatgctatttctattgcagatagtgagctatgtcctggtttggggccgtccgttgttaggtgctccattagggctggcttattgagaaaggaggatttggaagattgttgagtgaatccaggaaaggagcaagccgaaagttcacagggattgttggaaatttccaacaacagtttagatggaaattggctcctgggatgaaaaatggctgtgcatattgtgtttgagtgcttggaggcctctagctagaatgtttttattagcaagtttatagcttgtaagatggtccagtcagatattcatgcaaggcattttatgatgtacgtgattttgttgactggggccttaaggtgggaaacagttggaaggtatagtggactcttgctgccctgggactatctcttgcctccccacttatcagcaaattccataaccttcctggccctcggtttcctcacctttcaattggtgattcttttacaagttatactgggaattaaatggggtggatgatgatacaggatcttgaagcgcctggtgcttggtaagcactaattcctccagcccacactttctttaacatttcctatgccagcagttctcaaaggggcttgccagacctcagcatcagtatcacctgggagctcattagcagatattcacacaccacagatcttctgaagcagcaaggcagcggctggggcctggcattctgcatttcccaagctctccaagtaatgcctatgtttgagaatcacaaccctagactatgtttctggggccaagattaccttggatatggttgagtgcagttctccttaccatgtaagattcctggcaattcccagagctcatacacttcactgttaaaataaggtattggagaaggtggcttttggattcctaagctattggaaggccaggataactggtttgttttgtttgtttgtttgtttgtctgttttggctgaaatgcagtgatctgatcatagctcattatagcctcaggtacatgccatccacactaataattttttttttttttttttttagacagagtcttgctctgtcacccaggctggagtgcaatagtgtgatctcagctcgccgcaacctcctgggttcaagcaattctcctgcctcagtcttccaagtagctgggattacgggtgcctaccaccatgcccggctaatttttgtacttttagtagagatgaggtttcgccatgttggccaggctggtctcaaactcctgacctcaggtgatccacccgcctcggcctcccaaagtgctgtgattacaggtgtgagccaccatgcccagcccaccgtgctaatttttaaatcttttatagagtcagggtcttgctatgttgcccaggctggtctcaaaactcctggcctcaagcaatcctgcctcagcctcccagagtgctgggattacaggtgtgagccacttcaaagaacagaataactttgaatgcacagtttgtatttgtcttgctatcaaaaggcacgttaagttcaacttatcaaaggtaatgcagttagcaaccatttttcccctaaatttcaggtatccagatttattatttagaattatactttctccttgggctaaggaaacagttggccacacttttctactctatattcttcattcctattccaatgtgactgctgatttctgacttttaaaacctaaaagatttcttcctaaacttatcaggaaaagtaaaatgactccagtaccacttgccactgctattttagagacagtgaaattctctgaggtctgtcattcctgattttattgctttataaaagcctgctatagaatgttttttaaaaatacaatgatttaaaagtctccatgccagggcagcactggcaaatgaggaggcaggaggtcttcatgtaggagatgcttcggggacagtgtggcttgtggcagcctcaggactctgggcatctgtccactcagtacaaaccaaactgcagctccaactaattttgatttggaaattgcccccttaaaaaaaaaaagtactaaaaatgtttgacatttaccagatttctgcagcagtctgcagtttctcttgcaagtatattcacagacagtgaaaggaagtatttggcaattgctaactcatgtttttatatagtgtagaagtccaaagatggtaataatgtcatattatagtgatggcgatctatagtgtaaagtataatgaccataaaagagttctcatttttatagtttttaaacatgatttcagcatccagaggcaaactcctatgtaaggataatggtcgtgcatggccacagagattttttttctttaattctcaattgcttttcacgcttaactttttctaataagtactatctcccaagattccagaagatggtacaaatgagaaaataaggtttatcttttctctaagaaagactaaactgtgactttttttttcctttctggctaattaggacaacaaaagtaaacatccaattatgcagtgatgaatcaagtcatctggctggagctggattctttagtgtgttaagttacagtaaatattgaaaagaaggactttatgcagtaggactgttttcaagaaaaagaagaccagtctcagccaaattcaaatatcttgtagagaataaatgcctcttgggtttatggatttatgccatatgtgtgagaagagaaaatacggtcaagaattgttgtatttcttgactccttgaaaggcaagaacactggcttgggaaatagggacacctggtttctagtgttagataaatcttcagaatacagaatgctctttgaaataacaaaatacttgagtgaaggaaagaattgaggaatgaacttaaatttagctctgaaagaattctttcttcagtctgtggttcccttagctactattcaatctctcatttccatcttagccatattttagcttccaccctgtatgacagagacaggggtctttctcttggtttggagcacacatccctcaacatgtccagtagggagctcctgggcgacgggtcctgcaggtggatgtggaccaggagccccgtgggaggaacgtgcccctggggagagctggtggataccccgaatggcaggccacctggggcaaagccagtggaacctgactatggcaggatgagaacaccagtgttttataatgcccacttttttttcacttcttgcagtttctatgtttatttcctgttagcatttagtagtatctttatgagtttatctcagttatgctaggcagaaaggagctcttgtcagttggcaggaccgaaaggagagaataggcagggggaagaggggacagtaatcgaagtaggagcaccttgagcgaagtgaaatgtgggatggaaatggaagctcctgtttgtgatctcccagagaggctcagtccagcgccaggtgccgtgtgcttgtggaataaagagaccgaattccttctgtactgggggttcatgctgaaccccacctttgttgaaggggaggaaccagctgcccaaggcaaactagaagcatgcttgcaggagggaaggttaagacacacagtttatgtgcatagcagtgaaaaccatagtgtctgttctgaagtttgggaaaatagtgtgagactgtctagctgggtctgtcattggctgatgtgtagtatgtgtgggtcgctcactaaaaaaaaaaaaaagaagaagccaggccccaaaggaagagggcattattcataatgaaacctactatgaatccagtggggtcttgatttctgcttcttcctgggctgtgccaccaggacttccttgatagacctttggtgtcatcatgaattctgttactgatcccggaataaagatttggtgccctccggtttccaacagtatccagagatggccagggaggatttggatgggaaggattaaagtttgtatacaggagagaagacagtactctctgaagtgtgtgtggcctgagtcacctggtagaggtgggcttgggtcaggttctggtcacactgtcattctggctgcagaagaagaagcaagatgagtcaatcagtgtaggatttcagagtgtggggcactgacttcccaaatttggctgcacatctgaatcacctgggatactttccaaaatgcattcccccagttcctccccgaaattcaggcaggtcattcttaggaaaaactgggagttaaaaagcacaaactttggagtcaaatagcacttgggttgaatctcagcatcaacatcttttattggttgtatgaccttgagcagggcatttaacctctccagaccacagtttgtctgtgggcagaagacaaacaatcctacttatttatagagttttgggatgaattagatgaaataatgcatttaaaatgcctagctctttgcccagcatatagtaatcattcagtaaatattagcttatgtttaaccaaaatgtgtatgtcagatccctgcttagtactgtgggaacatgcaaaagaattagaaaaatcatgctcccttccctgaatatggctgagaaaaagcgaatgcacctgactatttggtgagttccggcaggaggaggggacattgtaatgaagctcagattgccggaagatgctggaaggatgcactttggacctaaggcaggtccagggtggtgcctggtggacatgaagaaggcagcaactttcagagcgagcgtcagaggggcttgtaatgaacagaattgccttctgatgatgtcaacatatctaatacaagactctgactaattactatttatagttgcttatattcaaaagcttgtttatgctgcaagtaaggctgaaaactgtcagcagggtgtagtggaaagagctcagagctgagtctgaactcctcaatttttatcccatctgtgctgctgactagctgggtgacatcagacaagcctcgcaactcccaggcctcagcctctgcaacatatacagggtgtgtgtgagtgggaggagatgggggattagacaactgctagggtcttctggctccaacattcaacaaaaacatttactgcacttctttcccaaaacttactgtgtgccctgattttcaattcctgatactctgtaaggggcattgttcagtggaagactgtgtgttttgctaatttgttgcttgcgattcagattcctttaaagttagcaaagagcatttttgttacattggaacaatataggaagtatccttcattatgctttcatttgtttttgagtcacaagaaactgttactgttgttttgggagactgatgtgggaatgtcttagcacatcatttctctactctaattttaaatacgggtagtccctgacttataaacagttgacttgagatgacccatatgtacagttagtactatcttagatgtgagaatccagttctcatctcctactgcagagctcttctgtaatttttcaatcagaacacctaggagatgtctattcttctcatttcacagatcttcactgcttgccttttatgggccaggttctcttctgtgccctgggtatccagcagtgaactaagcagacaaatctctgtgctcacagagcttaggttacagtgccattggcctggaaggtacgcttgcctattgccccaggtgaggaggagtctgtgacaggtatctgggtctgtcttcctctatccaagatcacttcccccacctcttccctgcaaggagactaaatcataaaaccacaatgcctttttatgtagaaacaatagaatatgtgactgctaggtatatgtagtatattgcaaagaatagccacagatcctcccatcctggttacatgttctcttataacgtgtctttgccatgctttcagtcagatgtctatttctctactcctgtgagtcaagtggctttgtgacttcctttgaccagcagaatgcagtgcagttgacatcatgggagttctgagctgaggtattaagagacctcacatatcccactcctgcttcttcactcagaacttctgcagccacagaagttctgattaccctcctggaggatgagagaccacgtggagcagaaatgagtgtaaaacaaaccagcaccattgagttaggccatcaggcacctgcagctgcatgagctttcaccagcttaaagtctcaagatgctcaccatcagcatcatatttttttgttactaataattgaaagatgtaaatatttatgaacttaatatagatattaatatatttcctatttgtcatgaatgaaataggccctggaaggttggcattggaaaatgcctttcacattttggaccatccacttagagacacatttttggaaaagaaccacttgaaatctggtgcccagctgtacacgtgttttgtggagagagacagattagcgctggcacgtgtgagacagtggttagtgaagggtggaagatcgccagggctcatggacctgcttcagatggatgtaaatagttggagtgtactggaaaggtatgggactaacatgaccctgaccagagtttggacaagtgtggtttcattctgggggactgacacttatttctttcctagaagtgttgatgaaagtcatgactcagtaatatcagaagtgtgggaccaaagtggaaaataaactcctgacttcatgaattaaacagaaacatgtcagggccactccatactcttcttcctgtcttccaaaagtctctttttttttcaattcagaagaaggtctgggaacattctgtgcacataattattttataaacaatattttatttaatgcccttgctaataatacttcctataaataaacaataagagtcgtcatggttccagattgcctttatgataatgatataccatatgtttaaagaaatggtctaaaagacatactgctgtgattgaaacatttttggaaattgtgtatgctaactgtatattgctctacagaaatctgttttgatcagtggataaaagcagctacacataactatgaggaaatcttgagaacatttattagtaattaaatatatagctgaaatatgtgcctatatgtatatccgaaaattattataggagatggttttcagtgaagatgattgggtggctttgaaataaataagtggtttggtttatgattaatggatttattaatttgctatggtcacctaacaatccaccccacaagttggtggctttacaacaacaatcatgttatcgcttccagtcatgttatcacttgcagacataatctgcatgtcacctgagggttggctgatttcacctgtgctcagctaggcatctcggcctctcattgtgaggctgtgaatggactctgcgccgtacctcttctccaattctgacctggggcagctagcttgggtgtgctcttcccagggctaagggggcaaggcaaacccaggaggatgggcagaaacactaagtctggttcattctaggcttggtaggggcatgtcgttacttctgtctcattatgttggccaaagtgagtcacatggctaagctcaaagttaggaagcagggaaatagactgtatctttaggggaggaatttcaaagtcatatgaaaaaaaaggtatggatactacagccagggatgaacatttggagccagtaatgatattcacccctgtgtctgtgtgactcctaagaagagccaagacttgttaaagatgagcagagaggtaaattagtttggagatggtgaagaagcagtttggggatactttggtctgcgtataacattgaagacacctgtctttccttgtataccaggggttgcaaactatagcttattgggccacatcctgcccaaggcttgttttattggaacacagccatgtccagtggtttgtgtgtgtcttgtgtgcagctgctcagccctgccacagacagttgaatacttgaggcagagactgagtggcctgcagagttgaaaacattgactaccgggttctttgcaggtaaagttagctgactcctgtttgatatgatgcaactggatagaatccatttggctataatctccgcctctctacctgcccaccccatacccgccccagttccttttaggattttcctactgtgctttgcattctcattattctgtgtttttataaaataggtaaaataggaggtaaagttatcctggtgcctggctgttggcactgatgaccaatgcaatttgcatccacaggtcataatccttaaagtttataaggcgacaaattgcagattagaggacatacaaatgagggagccagttgctacttttgcctttattattaatgttttgtggctctgcgggtcattcatgatgttagacaatagggtgattatttctgttctgctgaaagacaatctgattgtgttttgtgtagaatgaggcactgatccgctctgcctgcctcccatgagaaatgccgcagacctttgtctgctcaaacctcctcccgtcagctctggtattgtgatggaagtaattgaccaggcctcatgggtcagcatatatctgtactgctgtttattcttctttctactttttaaggactaaaatcactttcttgtaaaatattacaaagacattttaaaagaaaagactgtccattgtatttttccacccccttaaaatatattcataatgatctttttaactgggtgggacttgatttggtttaaaaacaataatcttggtgactgtatggaaatacggaaaatgtttaatacagtattccattaaaaacatgatacaggttgggcgcggtagctcacgcctgaaatcccagcactttgggaggtcaaggcgggcggatcacttgaggtctggagttcgagactagcctggccaacatggtgagatggtgagaccccgtctctactaaaaatacaagaattagccaggcgtggtggctactgtaagcccaggcatctgtaagcccagctactcaggaggctgaggcaggagaattgcttgaacccgggaggcagaggttgcagtgagctgacatggcaccactgcactccagcctgggtgacagagcaaacgaaactctgtctcaaaaaaaaaaaaaaaaaaaaaaagatgcataattgctgcaggtatgtgattgtaaccatagaataagtaggtatgtacatgtggtagatagaatgatgtgccttccccctgaagatatccatgtcctaatatccagaccctgtgagtgtttttcctacatggaaaagagcataatgcagatgtgattaagttaagggtctcgtgagagattaccctgggttatctgggtaggcccagtgtaatcacaaaggaccttctaagagtgagggatgaactcacaaaaggatgcagaagcagagttgggagggttgcccttcaaacatggaggaaggggccatgaaccaaggaatacaggtgacctcttaatactggaaaaggcaaggaagcaggggcccccggaactctgcgagcacctccattgtagccttatgagactcattttggaagtctgaccccaaaactgtgagataataaatttgtgttgctttaagtcactaagtttgtggtattatgttacagcagcaatgaaaaactaatatggcacataagactggaagggaagatattttaaaatgatagttggaagtacagtgtattttagtttgtgtattttgattgggtgcttgtgagtttactttggttggttaagactaagaggcaacagatgacttttaaatgttagaggagggaaaaatggtagagtttcaagttcacattcaagtacaaatgatgaataagcccagccaaattgttctccagtttgggttttgatgtattgggttcaaatggttccagccttaatggagaagccagtttcttttttcttgttgttttattgtttttaagcctctctctggttttcagtagagtttgaccttaaatatcatctttgattactattggtgtccttgtagttaaggtctttgcaaaagtttgagtgcaagttttaagctaaaaacacgtttttaaactttcacaaattttgtaagatgacaatagcattctgtaacatagacattatggtaatagtgattttctctccatccctattttgtccagcgatttccaagttataagacgtgaataagactaaccgctcacttccaccagcagctgacctggtgggcttttgagttcaaagagtcatttcttcatcttacctccagcactgcagggccgtgtgaccttgcagagccttgtttctcattgatgaaaggagctcatgcctcatgaagccactggtaagggccatggagctcacgggccatcaagcttccttcccatcacttgtgggtggaattgacattacccgatgagctcttcctggggtcacctgggagggagtggcccatgggtggtatgacaaaatctcatagtcagtctttgcagttttctccacaggtaaaatgagattttggaaaattttcatttgtttgtatttgtcccaaggtgagtcttacatattttgagcaacaaaacgaagatcattatgaaaatgtccttatggaagcactctagggccattgctcatttttatgagtcctcgtgctaagtccctgagtactgtggctcatgtcttagctggctaaatcacagtcaaaattctcttcttaagcctcaaaataagctgctgattatactgcctgttggccagactaatcaaatacatttgatgtttcagctgactccagatacttttccttcctcctccttggttctttaactgtcatcccagatctgcgacatgcaataaggaaaactgagtcagggaggaagtaggattccttttgctgctaggaaccacgttagctttggattgtccatagaatgcacccttaacagttcttggaaaatggatgatatttggttcctgccccatgttcagtgttctttggcagctgcaaagcatatcctagctagaatccttatcgtcttgaagttcatcaaagattttgaacagtcatggtggagatacaacctaagtacattcatgcccattgagacaatcctttggtttgagcgacggaaggaggaataaacacatgaatgtattttattgaatcccagagaccctgaaacaccaagactcattaatatatgcatacatggatggcagaataataaacctcacctgacctgtcagtgtactctcagtttttaaggttctcccaaaacagggaaactgaaaaatacttgggcagaaagaaaatatcatcaaataacacctatttcttttcagctatagagatggctggatatcaaaagcaccacgggagctttgcaatttgctgcctcttttcagccctcagcttgactctcagttttcaagagggagaaaatgaatgtttcccagcattctctgtcctttgctccaaagaagagagcaggtgttggcttccaaaccttccgtattttcttattgctgttagggggatcaactgcatgtttcctgagggaaaagggtggctcactgacctacttgaaggcattctctcagtggaagctgggcaagagaatccagggatttcttttgcaggtttctgcgcagtgcccctgccatcaagctgcctaaaatgtgaatattgcttccctgcgtttcagaggtggtaatattggggcaagtggtggaggatctaaaaaaaaaatcatctttgtgctccctaccttgcccctggtatggattaaacagccaccaccctccttctcttataccctgggggcctcctgacaatacttccaattgctccattgattacttagattttttgggacacaagggcccacgttgtgtcttcctgacaacacttttagttgctctattgattacttagatttttgttggcaattaggagcttttcagtaacattctttgctccatcggtagtctctgctggctcttgttcactcaggaaacacctgagcacagggcttcaggaaagccttctattaaatgggcagaggccccagcaggactcctgcatgttcatctgcacagccagagacagctggagggcaggaggagccgcgttcacatagggttctgcagccttggagccgccgtttcttccaagtactcttcagatcagtggttcttagccctgcctgaactgcagagtcctccgaggagctttcaaatgaagcatggcagcctgggcaggttgcaggtccattaaatccacatctccggggtgggagccggtggcatccttgctttgccagaactcccccattgaccctaatgtgaaacctgggctgagaggccctgcctaaagctcgattattttcacctgtggatgtaggcgatcgcttccttttgtggctgttgtcaggaggcagaaaatcccctgggttgttggctccctggagtcttatttttacagagtgccctgtttcaggtgcagcaacctgactgatgtttttacaaatcaccttttggtggcctcctgtcactgctgtctcccttcaagggttaaataagcctctctcacccattccttttcacacctgtgtcgtgtattattggcaggcctcagtcctcagggtgtcaaatggaactgatggatgccagacattgtggatatctgcaagtcctggttggtgaccagggacttgaagagtagactttcttctcaaacttatctttgtgctgttttccttccccagacctcatagtctggagcccatgtttccaggggtggaatttgattttcccagagaggagctgtgttcggcttctaggctgaggagctaagctgccgagcctctgccagccctctgtggattcgctcctgcattattcagcgcctttgctgacagagcaccatgttccactgctgagcagatcagggtgaatttccaagagggaacattgcagatggttttgcctttagggatggattttcttactcccaagtgactcacttctggtaaaattaaaaaaaaaaaaaagaacaaccttgagtcccttgagtctgtccccaccatctttgctcagagggaattaaggagccaattcagagctttaaaaaagtcacgtgatgattcattatctttttgctggttgtttcctgccccctccccccccacccccacccactgacttgtagtttttcataagcatttattcatccttgaattttattttatttttttatttttttttgagacagagtcttgctctgtcacccagggtggagtgcagtggtgcgatcttggctcactgcagcttccgcctcccgggtttgagcaattcttgtgcttccacctcctgaggagctgggattacaagcatgcaccaccatgcccgactaatttttgtatttttagtagatacagagttcatagccaggctggtcttgaactcctgacctcaggtgatccgcccacctcggcctcccagaatgctaggattacaggtgtgagccactgcgcccggcccatccttgaagtttaactgcaaccccatctccttccctctttgcatggggtaaaaccctactgcaaggactcactagaattccttccactcacatcccctctgatgatctggccttgctgtcaattgctgtgaccatggacaagttgccttgctgcctctcctgaacatgggaggtacacaaggcctttcttcaggggtttattcccagcagctgatctgctgctgtcggtggaattagtttgcacacacagcatcccggggagtggaacagtgctttcttagcacaaaacagacacgtttgcttcccttctttcagtgaaggggaacccacggctggaaaatactggaaggcaattgtaaccttaggcagccaacaacacttcagtcctttggaagtggattttaaggaagaggagacttcaaacggtagagctctttgtgatgtacctcttagagaatacctttttgattcctacacttattctcctctcaccaagtgatacttaaagggatgccctaaaacagcagtaaagtcataggcccctttttataaatttcatgaattcactacttttttcccatcacgtcttctcttaaccaatgtatctgcatttggtttgcgtaaaagaagaaatgtttcctctgctcctgggctcaccattaattctgatgagataggcctttctcctctaaaggcaacagggcattggccaaatcccctgttttactgcatccctttttggagctcagtattggcctgtcctgacccccctggtttgcctcagaataattattaagggcatgtgtcttgaaacaagtcgcacccaaggctgctagcctgtgtattgactgcttgatttataacgaatgctgaatttggctaggcaaatgagaaacgtggtagggtcagccttctgcctcctcctggtttacagactcatcttgcccattcatttttcccatctaaggctttaatttgatacccagtgggttggtcttaagcaaccaggcaagatccagaggagactgtccaggctgccgcccccactggccaggcagaccccgttccttttgcgagtttcctgcaaggctgttgttgactcgggggagcggcttttagttgctcaggcttctttctgctgctgcagaggaatgtgttcccctgtagaggctgttggaaagggcagtgcagacaagccggcttctcaggcatttaaacaagttgtctggaggttgtcagactctgcagcgcatcagcccctccttttgttcgttcgtaatgccacagtgtttatggagccctgccttttggaggagtgggaagtggagcttccaactgttagcctatgtgtttctgtcatttagaggcaataagaagaacatgaccttttctggaactgctgccccccgcaccccccccaaaaaaattagaaaatggttagttttgattacattcaccttgaccactttcttcccaagtgaagctgaccacgattctttgttggagccaagtttttgtatttgcatattcccctcgggtaggaactgggtcagttattattgttctaactagcaggcggaattggggtctctgaggcatgagggagattccattgtcttctgtgtattctgctggtatttcatatctgatgaaggtcgattcttatccctaattgacttcctcttgggttttgtagtctgagtatttgaaatcacatgttgattgggctgggtgtggtagcacaagcttgtaatcccagcactttgggaggccgaggtgggcggatcacgaggtcaagagatcaagaccatcctggctaacatggtgaaaccccatctctactaaaaatacaaaaaattagccgggcgtggtggcgggcgcctgtagtcccagctactcgggaggctgaggcaggagaatggcgtgaacccgggaggcggagcttgcagtgagccgagatcacgccactgcactccagcctgggtgacagagcaagactctgtctcaaaaaagaaaagaaaaagaaatcacaagttgatctttctgaatgttggggcccaatgtatttgagtaataaacttgtaacatgagggaaatggacaagtgaaccttcttaaggactcatggtaatttgactctctcctgtatgattctttactgacagtgacatgaaggggaattgcctggggtagacttaggctgtctagtgtcatatgctgcttttattaatccggagatttctgattggaatatatttccatttcaatgggattagagtataaagaatgctttgttacaattatttacttacaccgccaccaccgtaagtaataatagtagttagcatttaccctgtgtgtgttacctataaggtgctgttctcagcacttcatgtgaattattcctcaaattatccccaaactctctgagactgcgctgttaccattttgctttgtagctaaagaaacagcttagagaggttgagtaactcctccaaggcatactcagcagtaggcaggacttgaacctgcgttgtgatttgtgaattcccacttttaaccacccttcactgcccatctacactgcctcttgcacatctcatattttgccagatgggaaaactcaccaaggatgaagcttccttaagatctttttgagtataaataggccatctgttgatctgtgtgtccatcaggttaggggctcttacctcaagccaacatatggcagaaaagatatgtattgatgtcttgtgggatagttaataaaacacaaatgtgcagtgcagcttctttaacctgctccatcttggacccaaattcccccacccctgctgccaaacaggcctctaactgatggggtgggtgtccccatcagctctgtgctggcccagcttccttggggttggccctcaccagagtaagggcacaaaacacagctctcgaggggttctgcagacgaccagagcctgagaccttttcttggcagctggtgtcagttccctgttggatctgtccttcccttctgaatcctagtgggatctcctcactacctggtcactatctctgttctcacaacaagatttaaacaattataggatatcagtgcactgtgagaccacaaactcttctagtccattcccctccttctaatgaggggcccccacagctgtggggttgtatcatctaagccagacctccagtttccttttcactaaaatacctacctttgaaataaaagtgaaaacttacatcaaaacagcatcatgcctggaacatactgaatggacagcatttcctttctttcccctccttattctcctgattattaattatttgcctgactttggatagctattggcttctgtcctctgatattaatgtactcataatttctgtttcttacctggttttggactaattgctctatttttatttttattttttggcacatgctctgcctctccaattctgacatttcttgcagtcctctcagcatatttctgatcacagtcccaaatgacattgagaagccctgataggaaaatgctgtgtaagaaatatgagttatttgtctgtgtgactagaactttcctggtgtaagttcagaactttccagaacttccctgaactttactctgtccggttcagaccatctgaatgcagatgtctgacttggggatagatcctccactgatcaatcattcagagaaaagccacagaaaacacacaagattagaaaaataaaacccacatggaaaggctttagtgaggttacagcatagattatgcagtctgggaaaagaaggataatgcagattaaaatatctgaaatattagaatagcataaatgtagttaacttcggagccggaagaccagggttgaatcttggcttcttcccttactggccatgtaaccttgggcttcttgcttaacccctctgagctgcagaaggggggatgctgctgttgatgtcatcatcaccaatggcagcagtagaagctatcaatgatggtggttatcacttttattaccattgtttttagtaaggagagctaacgagacaggctccaactgctcttctcccgtgggaattgcagttttctgcagtggatcctgtgacagattcctgtggattcctgggacagacttagccacctgtcctttcttctatcctcctgtactcatcagattgagcaccatgtgggtccagtccctgagatgagtgcttgatagatagaggtgaacgatgggggcttggtcttacagagctgacctgtaaaatcctctccaccatatccagtgcatacagctgggcattctttgtgtagatcaccccagttattagaacctctatttcagtaattcactctctgggctctagttcttccttgtgaattttactctcagggaagccccgactgtgctcctgaagctgtttttatttgtagtaatttagcatgcgtccaggaattgaggactcttgcctacccaaaatcagaggtggggaggaaaaccacggtatttcagtccttttgttctttttgaggtctgtaattcaccaaagccaggtccaccaaagtaaattattaccataatttatggtgagaattatttggggccacagatgtcaagtggaagcttgcaggtaagtatgattgagaaagtacaaaattttgaaatgaactctaaccttatgagtctgttgctctaaggatctaaggatattaggaggtagtgttaagaatcacaactgcattgttaaacgccaagtgttctttgtgatttgattgaaactgtagttgggattcttcaggttccatatgtggggcaacatttaaatattaacattcttgggaagattttgtatagacagctttctctgtcatccgaatgccgtgtggtcttcagagcatgtcataagaaaagtcatgagacacaaatctgatggaactttctttagcatatgtttaagacttgtcatcttcccatctcatctttgcagtagaaaaataccaacgtttccctgaacaaaatagaagtattttccacttccccatttctgaagctcctagacgttttatatttcttttgagtaagagattgctttgtatccaggagcctttgcatggtgccttttcttttactggtttgtttatttgggagatggagtcttgctctgtcacccaggctggagtgcattggcatgatctcggctcactgcaatctccacctcctgggtttaaggggttctcgtgcctcagcttcccgagtggctgggattacaggttcacgccaccatgcccagctaattttttgtatttttagtagagacagggttttaccatgttgcctaagctggtctcctgagctcaggcaatctgcccgcctctgcctcccaaactgctagaattacaggcgtgagccaccaccacgcctgactccttttctttttcttgatgttactgaagactttattttggaagtagtgagggcccagagctgatcccttctggagatgtgtcacagggtaaagaatgtggctttgaaactccaactctgtcacttaaagctgtgcctctttcagagttacttaaccactctgaaccttagtttcctcttctgcaaaatgggagactagcaacctgccacccaactgactgctctgggctatttatgagacagtctctgctctcgggagacatccctctttggcttattcatcctcactcatctgcgttggagagatgcacttggtgcctctcctgcagaaggggtgttaggaggctgttgcgtttgtcaccagggaggtgatgttttccccattgggaaccctaggccagcaaacttcgagaagtgtctgtggcagcttgaatgctgctatttaagagttgataaagaggcagcttggagaaaacctcaagcttatttggttgagtggggtggctgtgtgagaattaagtaatgagtagacctgaagcatctggtgggatctccagcagttagtaaatggcagctgtttttattctcatcccttgtgggcagtactgtccagttccagtgatgggcattagtggcatttgggatttgaggataaccttcataggttggaatgagtaccgtagcaaaacagaattctgctcttagccagaaagcattccagttagcaaactacctgacagtgtaatgtgcccagaggacccaggagggccatcccagggagaacagcatcgccatttctgctgaccacatgctgtctcctgagccccggtatctgaggccctcatcgaaggcataggcatattaacagttatgctgccagacttttatcagcagtctgtacttctccttttatcttcggaactgtgatgaaaagaacagtccactcccttctgatctcaacacttaccaaagctcatctgttcacaggcaaatgtactaaaacattttttattggagactgagtttcatgtgtagacatcattgtatttctgtgtggtgtcctcagattttcactcttgttttttccccagctgccttttttaaaaactcctttgcactcttaaacgtcaggctgagtgtatgtgtgtaaataaacgctttgggtggaggatattgttctgctgtgacaagccatcaagcagcacagcaagaaacaatacttttctaatttgtgagttattcttacgtttcccttttgcaaggctagttatttcattaaattcatttaatttaagctttgaaatcttttttttttttttgagatggagtcttgctctgtcctccaggctggattgcagtggcgtgatctcggctcactgcaagctccgcctctcaggttcacgccattctcctgcctcagcctcctgagtagctgggactacaggcgcccgccaccacatccagctaatttttttttatttttagtagagatggggtttcactgtgttagccaggatagtctcgatcacctgatttgtgatctgcccgccttggcctcccaaagttctgggattacaggcgtaagcaccgcgcccggcctaaggtttcaatcttaataagaatggctaacttttagatgagagttttacatcagaaaacctcatcgtacccagagagatgcttctttaattcagatttgaagggatgagtttccttgttctggattaaacagctcactcagacacaccaaatgaatgcagtgtgcagtcctaggtggcaccaatcacagaagagtgaaaagcataaaacagttttagaaaaggtcaccacacttagaaatagaaatccacccttgctcacgcaacccgagggatttgaaaataatttcgaaaatcaatttaaacatgtaggccacccgtcttttggagagatgcagttggtgcctctcctgcagaaggggtgttaggaggctgttgtgtttgttgccagggaggtgatgttttccccattgggaaccctaggccagcaaacttcgggaagtgtctgtggcagcttgaatgctgctatttcagagctgatgaagaggcagcttggagaaaacctcaaaaataaatactctgattcatcattgttgttcaggctttccagccgtcagagccagcccagggttctgagacaaagggtaacattcagcacagagcccagcggagagtctggagccctgactgtctctaaaagagggggcggagagggaggcagctgcctgcaaaccctggagtggggcttgacgctggggggacggcgtgtgctggttttgctgctttgggggtgaggagaggatgaataatccaaagagggacgtctcccgagagcagggaccatctcataaatagcccagagcagtcagttgggtggcgggctgccgtgcgggggctgcagttagaagcagcactcggagtggagtggggcctcccagcggggccctgctgcactttgtgagtgctctgtggtcgaaggccagctgggcctgaaggcaaaacatctggattttgcagagggttcctaggctgagacggaattcaggctgtaggctctgtgagaccttgtgtgaaacccccggttctgtctctgtcacttgtttgagtctcccatttctctgtctatcaaaagattgaatatggtggcttacaacagaggcagtcgagggtaattattagtatcatggtttgacctcgagatctggcacttcctggacctattccgttgtatatttctctgtgcactccctgagcctcccttttctcagctgagaaaatggtcacacctatggtatcccacactgtggaaaatgaccaaataagacaaggtatgtgcaagtatttggtagaaccctacagaggtaggaagtggctgttactagctgtttccactggtattctctggccatctcagagctgtttagggaccattccagctacaggggagggcaagatttagagtagactctcaaatgagtctatctgattctttggaagcacgagctctagtaagatagtttgaacaaagatgtgaccatgaggggttttgttttattttttaactagattttgatatgttgtgtgccgcttctccactgcacagattgaccaagagttagctgcagattgtggctcagtaagaaggtcttgtggtacgtgctcctgcggcccccacctcaaactcttgcctctggtgttcttgaaagaaatgaggggacctttgcccgagccaagggaaaatgcaagattttggaggcttagcccctttattgtttttttcctctgttgcttatattgatttctgcggcaaagagcagttgactgggattgaaagctactctgctggtcttggatgtggaagaaaaaataattcccactttccaaatagaggctcatccagaggcagcagatgccagaggcagcagatgctagctgcagttctgcaggcaggaattgcacgtgcaaagcagagctgacgtccagtccacgcctcatggcactttggaagtgcatctgacaccgtttgcctgccatacacaagccacaaagactttttgaggcgacaggttatgccaaaaattaagtaaaaatgacacagcttcagatgacatttacatatctatttttgaggtttcagaacatgtgccctataaaaatgtacaactgcattgtttaaaactcttctgagtctctgaggattttctatcagtgcatgcctctcagttatcacttaaatgtcaaggccctaagcttgtatgagcccctaaaatgtttttgagccccacagtaaatttttggctgaccacatttgttctatgtaaggctgataacaagccaccacgtggaatctcacagtgggactttagtatcaggcaattgcagagtcctgaagctcgtgttgcggttattatggttctatataaagccccaggggagaaagtcatttcatgcttttaaaattactagttaatgtttaaggagtttatacggagtggactgagccaagcattttccccttaactttaaaattattacagagaggccttaagaaactgttctgtattagatggtgattaaaatatgacctttttctttctttatgcttaggattttcacgatgtggtttgcaattaatttgtatgtgcacagtctttgtgctagtttctgtggacatacagtggtgctacttggccttaagagcttcctgtgtgtggttgggagataggcagttagtaagccatgtgtgctgtgagaaaacccagagcatagaagtcgcacatgagagtaccaggtgctgagtaccatgggggtgagagcaaggagggattatttctgccccaagaaggcttcttgggaaatagagcagttatgaaggacctggaaagatgttccaataagacttgggtgaggagacacaatagtcccaagtagggagggcagagcaccctgagtagaggtgtggtgtcaggaagtgtgagaattcttcagagactgatagtcggaagggattcctctgcaaaggcctgtggaaggatatgaaggttggaaagacaagtgggagccattggggagtctcaacaaatgtgtattgtattgtgtgtgtttcacttggaaaattatcttgctattaatgagaaagtacagattaatgctttttttgttttactggattcaaattatatttgacaagtcatttcattctagtgtatgcatgtgattttcttggaacgagggtaacattttaaagataggatttgatgagtcaatgaggtatttttcaagtagattacttagaaaatgttatagtcataaaatatcttggagttacagttaagagtcaattattgtttcatctataggcatccaattaaagttgaattatgctgttattttcactcaatttccaaagctatgcacttccgtaatttctatccttgtttatagtcagtataatgtttaatgcaatgtgcctgatttagcactttgtgttataaattttgcctgataaataatcaacttattttcttccgtatgacgacagttttcttcacagtgaatggagcttagtgtatttatataaaatgtaagtctgggagagtttccattatagttcaagtatatttaatgttcaaaagaatgcagtatttgtggtttcctggcattctttgaataccatgtggctcttctctcttccttctcaccaaaaccctagtcattttattatttatataatgagatactgtaagatactaaaacataagttattgtgaggtctggcttttgatgctatgaagtaccctttgttatttgagactaatgaaatgaaatcagtgagttccagcttgtctactagtatgttgcttgaaacaattacattcttttgaacattaaatttatatatttgaactataaggaaactctcccagacttgtattttatatactctaagctccattgaccatgcagaaatctgtcagcatatgagaggaacaagcggattatttatcaggcagattttataatgcagaaatacgaagcaacatagtgctgtggtgaagacagaattgaacattgttagacacttagcaatcccaagaggcatcatgaagtccatgtaccctacaccatagaaaaggctacaccccaaagttctggaacaagcctggtttgctggctttctggtgtcaaatgtcagaagcagaaaatgggaggatggtaaaacagtagactcagtgagagcaggactgaacttcagcaggccccataattgtacagaaacaagattgctaggctgggtgctgtggctcacgcctgtaatcccagcactttgggaggccaaggcaggcagatcacttgaggtcaggagttcgagaccagcctggccgacttggtgaaaccctgactgtactaaaaaaaatacaaaaattagccacgtgtggtggtgcacacctgtagtccctgctactggggtggtggggggagctgaggcaggagaatcgctggaacccgggaggtggagactgcagtgagccaagatcagaccactgcactgcagcctgggcgacacagcgagaccccatctcaaacaacaactacaaaagatttctcatggccacttagtttaggaagaagacccccatgtagttcatgaacccaatgctgtgaaccaaaatactataaacactagtattctaggtcaccactgtgatcattgagaaaatgttgaagtatattgacatattttgtttaacaaaacaagggacttaaagtgcgttttagaaatatttgtatacatgctggtttaaaaaagaaaagactaaaaacaagccttagtacataaaaagaaaatattcagttttccagaaaatgaggttactcccttacattgagagttacatgaagccttgttacagtacttttagtcttctttattcaaagaaagaattaccaatatcattttttttttaagatggagtgagtcttgctttgtcacccaggctggagtactgtggcatgatctcagctcactgcaacctccacctcccaggttcaagccattctactgtctcaccctcccaagtagctgggattacaggcatgcgccaccatgcccagctaatttttgtatttttagtagagatgggatttcaccatgttggtcaggcaggtttcaaactcttgacctcaggtgatccacccgcctcggcctcccaaagtgctgggattacaggcatgagccaccatgtccgaccaccaatatcattttttaaaagtaaattattacgatttccttaggtggttaataaattaccattattttctctattttacagatcacgaaatgataagtaacttaccgaaagttacattatttaagttaatcaaatgtttattgattgccagacttttttctaggcttaagcaaatgttggaaaatacttctctgagctttcaaaaatgttatttctacttgtcagtgctgcaggagtttaatacagataatttaggctgggcgcagtgaatcacgcctgtaatcccagcactttgggaggccaaggcgggcagatcacgaggtcaggagatcgagaccatcctggctaacacggtgaaaccccgcctctactaaaaaatacaaaaaattagccaggcgtggtggcgggtgcctgtagtcccagctactcaggaggctgaggtaggagaatggcgtgaacccaaaaggcggagcttgcagtgagccaagattgtgccactgcactccagcctgggcgacagagcgagactctgtctcaaaaaaacagataatttatctacatactgtatgactttactttaaaaaatgtttgtatccttgtagtaagactgttattttttttaatcctacatcacatcatgcattcctgagtgtgagctaccagtgtttttgtctagggctagattactagagctaaaatatcgggagaattaatgagaaaaaaaggcttaaccactgaggctctgtcaatatcagtttttgtggcaggctatgtttactttcttcaaggaaaaatgtcaggcaaaattttatcactacaaatacaaaagagaagaacattaaaaaaatctgatcattatagaaatcatagtcagtgcagaatgtttcctgcagaatccaagtgtttagtgaatgttggtggaaaatatgaagtgtgtcatgtgattggaaagtcatttaccatattcatttttcttttaggaaaaaaagtaaattagattttgtatgagaataaaccttactgagacttgttaattttgctctgaaatttactgtttgatattaatctggccagtctagctttcttttagattaatgttaccatgatacttcgttttttatccttttacttttcatatatctgtgtctttaagtctaaaacgagtttcatatagacagtatcagtatgtagtctggtccttttttatctgctgtgacaatctttgccatttaattgcagtctttacaccatttatatgtaatggaattatcattaatttacatgggattataatttacatttaatgaccactatccttttatttgcattcagttcatcctcttgttccctttttccttctgttgggatgagtatttttaattacttcattttattatgtttggttgtattagtttctaatatgattagctgtattagtttctaaggctgccataacagattaacatagagtgtctcaaaacaacagaaatgtattcatacacagttctgaaagctagaagtccacaattaaggccttggcagggtcatgcttcctttgaaggctcttggcaagaatctttccttgcattttcctacgttgtgttagttgccgctaatcctctatgttcattggcttgtggctgcatctctccagtttccgcctctgtgttcacatggccatcttccctctgtgtgtgcctgccatttccaaatctttctttccttataaaaatagcaatcattggatttaggggctaccctaatccaatattggcctcatgttacttcattacatttgcaaagaccttatttccaaataacgtcacattcacgtagacctggagtaaaggcttcgagatattgttttggggaacacaatacgacccgcagcattagttttacctcttcgtgttttgttttgttttgtttgtggttgatctagggcttgtaatgtaaatctttaatcaatcagtctactttccaacaatattataccacatcacatatggtgtaagaaccttacaacagtttacttgtatttcccctcattttgccaagcataaaatactattgctttaagctactgtagcatctcccatatctgtcccctcctctgtattcctactactactgactaaggtgagctccttgttatttcttgccttttgtcttgagtagtctggagtttcaccagtttaccttagcgatcttgcccttacctatctaccttcctttctcacttaggtatcgtgtttatgtctccagatatgcctgtgtatgttacatctctgtactttgctcacactgaacttgaacaccctcccctccacttatctttcaaacagttatttccctttcaaaaccaagacaagtcttgccttctttgaatcactcaatgcagtcagctgtggtctccctctgtgccctgctatggatgacacacaatctcagtcccaatcccaggtcctgttacgttttactggataatttgtctatcctcttcctcccaaggggataggaaccttgtgagagtcatctcctagcatctaggatgtcaccagactgataatcactgttccatgaatgtacactaaatgaagttatcaatgaatcagtaagttgagtgctggtttcactagtccttactgtttactgagagttgtttataaatgactaaatgttcccttggtaggtgttgtgatgaatcctacctaccctgggtaagttccttgactattcattgttaacttcatcgaaagttacttgagaatcaagagtcattttgacagcttcaaatattgacagaaggctgtggacatattttccagatgccttaaaaaaataggatgatttcctcattgaagtagaaaataacccttgataccaccagttcaactcaaatatttacttgggcaaataattatttgcaagcaaagaaaccatcttacggctttttattctgacacattaaagcacttaccatgagaaaaccatacaaacatcttttagataattttgaccagaaacattggaaggacattcatgacatatcctggctgcttagaggtttgcaaaacatgctgctccactctttttttcttaggcctgtacacagatcccaagtcattttttaaatgtggaaatgtttaaagggttgtagtgttttctgattacagaaaccatacgaattgtagctgtaattgtggggctagagcctgagggagcttttcgctgattcttgttcggggggatttccttgaagtcgacagtggaagaacattataaagcaaaaactacagctccttacacttctccttagctgtgaaaataaagaccaaaaaatttactgagatgatggtgaaggccaccaaacctcacagggctgagtcagctggtgcctatgagggcgcccctccttgacacttccttccttttggcaggaaggagaggggcagaaagtcatctcctgccgcctccctcccctcagaaaatgatttataatgtttgagagatctactgtgagcaaagttcaacacacatgcctaaaggacacgtcctctaacaaatgaggacttagcaagctgcctaccaggcaccaagctgtgtgtaccacacaggtatttctcacttaatctttacaacaacccattaagataggtgatctggtgtcctgagtggtggccctctctcatgcatatctgtatcccaatccctggaacctgtaaatattgccttatttggaaaaaaagggtcttgaggtgaccctatcctggactatctgcatgggccctaaatgccatctcatggactttcgaaaaggtgaggttgagatgggagtgatgctgacaaggcagggcggctggaggaggtgggagctggattccctcctagcgcctaccgaatacgtttcggcaagtttttttttttttgaagcaggctctctctctgttgcccaggctggagtgtagtggcgcaatcacagctcagtcactgcagcctccgcctcccgggctcaagcaatcttcctgcctcagcctcctgagtagctgggaccacaagtgcactaccacacccagctaatttttgtattttttggtagagatggggttttgccatgttgacaggctggtttcaaactcctgggctcaagtgacccgcctgtcttgacctcccagagtgctgggattacaggcatgagccaccgtgccgggccactttctgtaattttaagctaccaagtttatggcagttttttttttttttttttacaataaccacaggaagtccatgcaggtgccattattgcctcattttacagagggggaaactgaggcttagagagatggattaaggtgctcaagtttgtaaattgggtgtgggtggagctcggatgcatgctcagtccttcgtccagagcctgggctctcaacttctttccagtgaggaaatgcaaatttgcttctgtgactgataacagggtgggtggataccagccagggtctggtgtagctcagcaggttgctcccttctgccatgcaataataagaatcacctgtggcccaggcctctctaaagagattgaagtcttagaggaggttggtacctctccaggccacgggacgggaatgacagtgcatttgcctgtgtcgtagccacctgcttttaatcagcactttaaagggggcagaaaccacagatttcacataaattgatattgagcagttgtgtgaattccatttggacctcctctggtggtggttctaacccaaattatttaaagtatttggtaggaacacaagccacttgctgatgagagagaggagtaaaaaaagacactgatttttccattctagaaattttatttcttaaagcaagaaatccttaattgcctcctatgttgctgttcttatttgcccctttttagtggtcagtggggtgtgtttcttaattgtgatggcacagaattcaccttggtcccaaacaagaagtgaagggggttaagaaatctaaaaggaatgaagtttatggaaatgtgagtcacctctcgtcacacaccactacctcctcccccagtcaaggaattcctctgaaattccctgcatgtttctctttagactcttaagacccctgggtacttgcatctccatttagaacaacttgagagaatccctggcctgttgtatttcatatacttcccagtgtctcacacacacgcagacttgcttttctgacacgtgcagagttttactcttttttctcgggtgaagagacgtaaccatgatggaaaatgagatcccaagactaaaaccagttagatgatgttcatctgcttctaagccagcattctctcacaaaggcttccctttgaggtcttcctgggtgtaggtccttggggaaaacgtgccaagtttctgcacagactgtcccttgtctcttgacaattgaaagttccacggcaggttaaagaaggctctgggtccgggtgcagtggtccatgtctgtaatcccaacactttgggaggccgaggcaggtagatcacctgagttcaggagctcaagaccagcctggccaacatagtgaaaccatgtctactaaaaatacaaaaattagctgggtgtggtggcggacatctgtagtctcagctactcgggaggctgaggcaggagaatggcttgaacccgggaggcagaggtagcagtgaaccgagatcgtgccactgcactccagcctgggtgacagagtgagactctgtctcaaaatcaatcaatcaatcaataaggctctgggaatagaaatgggaaagattctccagtgcgggcaaaggaaagcacagtcctgattaaagcttcctgccagcattaaatgtccgttcattcactgcctcctccatggtgcgatgcgggtggaaaggaagcgacacattcgtctttcttgcaaagagcttgcaatgctgtattctgttgagcatgtaagagtggggagctgtgtgtgttttatgaaaatgtcttttgttaccaagcatagctcttattaaacggcttcttttcttttaaagcctatataacatgagttacatgggcgtttacatcaattttgtgttggtatatagtaaattaccccaaaacacagtggcttaaaacaattgatgtttattatttcacagcatcttttttaattgttgttttttgagacaaggtctcactctgtcacccaggctggagtgcagtggcacagtcatgactcactgtagccttgatctcctggcctcaagtgatcctcccaccttagccctgtgagtagctgggaccacaggcatgcactgccacacctggctaattttttatacttttccgtagagacagggttttgccatgttgccttggcttcatagcatctttgggtcagaaattggtacccagctgagcaaggtgtctgcctcagggactcacataaggctgcaatcaaggtatgggctggggctgcggccatctcaagacttgagtaggggaggacccattcccaagcctgcttttcgcagggtttagttccttgcaagctgttggcggaagcctgccttgattctcgccatagggcagctcgcagcatggtagctggcttccatcagagtgagtaagagagggcgagccagacgaaatcagtcttataacctaatccaggagtgacaccccatcacttttgctatattccatatacttgaagtgagtcactaggtccagcccatactcaagggggggatattgtttgaacacttaagtaccaggacaggggacaggggcaaattagaggggaactcagaggctgcctaccatagcagaacagtaagtttcacttgaagcaaacatatttatgagaatcctaatttatatatatatatgagagagagaggggggaattatctttctcttctttcctttaatgaagtataattcacatattacaaaatgcatagatctgaagtgcatagtttaatgaattctgaaaaatgtgtaggattttgttattttataaaaccctgggccatgaggtttctttaaatgccaaatactatagatttatttacagtgtatatatttatgtacagtgtaaacaataggtgtatttggccaggcacaatgactcatgcccgtaatcccagcacttgtggaggccaaggtgggcagatcacttgagcccaggagtttgagaccagtctgggcaacatgacaaaatcccatctctaggaaaaaatacaaaattagctgggcatggtggtacatgcctatactcccaatgagtcgggaggttgaggcaggagaatcaacagagcctgggagttagagggtgcagtgagccatgattgcaccactgcactccagtctgggtaatagctaagaccctgtctccaaaacaaaacaaaaagatgtatttgttatgtattgcatataacaaatgtccctaaaatgtcgtggcttaaagcaacaccatttattttctcgcagtttctgtgggtcacagttcagctgcgtgcttgtgattgagggtttctcccgggctgcagcccagaagtctaatcatctgaggctcgactggggaaggatctgcttctaagcctgctcatgtgatggcaggattcagttcctcgttgacgttagactggacccttagttccttatggctgttggctggactttgccctcagttccttgccccatgggctccttgcttcctaaaagcacccaagccaagattgcactgtcaggagagaactaccagcaagatcgcagtcatggtcttttatactctaatcacataagtgacaacctgacattttcaccatagtctgttcatttgaagtgagccactaggtccagcccacactcaaggagagactacacaagggcatgagcaccaggaggcagggacgcactgagagccatgtcagatgccgcctcccgccatgtatgatgaaatacactatagacacaactgttttaagagcctaccagttttatgaacccaagtatgtctttttagtagaacatctaaatctagacagctagaagaactacattttataaaaatctgaatattttcttttttttttttgagacagagtctcactctgttgctggtgccagagtgcagtggtgtgatcttggctcactgcaacctctgccccctgggttcaagcgattcttctgcctcagcctcccaggtagctgggactacaggcttgtaccagcatgcctggctaatttttgcatttttagtagaggtggggttttgccgtgttgcccaggctggtctcaaactcctgagctcaagcgatccacccgcctcagcctcccaaagttctgggattatagcgtgagccaccctgcacctggcctgatgaatgatttttaaattgtgactcccctatgctcaaatgagattggatcaaatgtcttctctagcaaataaataattccatagctagaaagatctttggtaggtagtttccttcctcttgtgtgttccctgagctctcctactgacgttttggaatattttcacagattcttgaatactcctccctgccagaggtaaagagcttaactcttatcctcttaagtgtggactagatttcgcgacttgcttctaatggatagaatatggtagcagtgacagtgtgtgacttctgagaatagctgtaaaaggcatcgtagcttcctcattgctgtttttcttggatcacttgctctggggaagcccagcagccatgccgtgaggacactcaagcagcctttgaaggagctgctggtgaggaactgagtcttcctgctgacattgacatgagcgaagcatcttggaagtggatcctttcatttttcaggtaccgtgccagggcctgtgagggaaccaagacgtgtaagacatggcctctcattagtgtttaagcagtagagaaagctggtgccatctcattgttcaggagatgaagtgtgtggccggggtgatccagagagtctccttgaaagtacagtgttgaaccttggactttggggtagaattcagacagggtgatggacagctaaagtggttcagaggctggggtacagcatgaggttattaaaatgatggggctgagaagtacaagacctgtaagtgaagaactgggcaccagacattggcatgaagagaaagaagacacctgtgttcagaagtgagcctgccagggcagagttaagactttttgctggccaggtatggtggctcacgcctgtcatcccaacactttgggaggccaaggtgggagaattgctctagaccagcttgggcaacatcgtgtgaccccgtctctatgaaaaaaaaaaaaaacgagagaaaaaaagttatttctcaaaaaatagccttggacttgttcaaatttggatcaggtgtgaacttgtcccagtggagccatggagcccaggctgtgtgtcagaaagcctgcaataggcttccttgacccagaagatttttagagcctccattaccaatcacgctatgacacgtttcttgttcccattggggcctgtgtttcaaactttgggctggaagagaacattcccgtgactactcacatcatttctattacctacagctcttctcccctgtattgctagtctgcctctaccttttgagatcctactcactctccgaaggtaaggtgggtgacctgttaattttaaaggacttttttttggtggggggcactagcaaataaattaaatctatggatgtgaagggagtttggttatgacatccactgccccattaacagccttgtccttcctcttggcttcccaagctgtgtgttctgttgaagaggaggcctctccttgccccaggaatggatcagccagttgggattatctgttgcctctaaacacttgtagtactgtgttgatgccatcccattgtacttgtgattccacgttgtcaccttaagtagattgtaaattcttttttttttttttttaaagacagggtctcactctgtcgcccaggctggagagcagtggcacgatctcagctcactgcaacctctgcctcaggttctggcaattctcctgcctcaacctcccgagtagctgagactacaggcgcacgctgccatgcccggccaagtttttgtattttagtagagatggggtttcaccctgttgcccaggctcgtctcgaactcctgagctcaggcaatccacctgcctcggcctcccaaagtggtgggattacaggcgtgagccaccacgcccagccagtagattgtaaattctttgaaggcaggtatcgtatctttctgtgcagtcagcacagcattttaaatgcaatgcttgcttatgaagggctgtttttctttctggattgttgcgtgtggcagatggagtgccacgcaaccagacttcttggctacaacacacatgtggcttcttttatggaagttgccacctgcagatccttcaccaccaagaacatgcttttctgtcatattgcagaatctttgtggaggatcctcgttcttccttaacttcctttgtgccacacgcttccccacttcacttgggcacctttgaacagagaagcaggattgctgcctccccaccagtgtaataaatgctctttacaaatgtccctccttggaagtatatcttgtagaaatcctagtttctaacttcatccaagaaatttctagacaacttgtagcctagattatcctttaagagccacttacactactggaaaacaactccacccaggttcttatttgagttacagggacaagaagcctttggattgcaggtttaaaaaaaaattttttttttattgctgagacttctattatgaactaccacagttgacaaactgttagtttccatagcaattttagactgtccttaggtgaagggtttcccttccagttgctatttaagatgtgtggaatccaagaagtcacaaaaggtatttcatgtgtcataccttggcaatgcgtgctactaattatttttttgttcctgtcgttaaatatagagccttctcatttattttgtcaaatgcattttcctctactacttttttttttctttttaaagaaagatgctctgtgaaaaggaagccattcatccatccaggtgagctctggatgggcgagccagccatggggactcctccctgggactggagctctttttgactgagctgcacctttgagcatcgagtttctgtttaccacctggatgctttccattttgaacacatttgggcctttcactgaaaggcactttaaaaattcaaggttttagcatcatcaccaaaaacatctactaaaatatgcatttgtacctggagtcatttaaaacaaatgagttaacctcctgtgctctgagaataatcttttctttcttcttcttttttttttttttttttggtcaagacaatagtcttcatgggcattaggtgacaacagctatgcaatttcattttagtccataatacattatttaaagaggttattgaaaatgttgattcctggagctaaagaaatggaaatatttaaccaaaagaagagaacatttgaagacctcaaagctttcatgagatgtttgaaaggcagttgaatgtggagagggtatgctatctgctatggtctggctctgtttccccacccaaatctcaccttgatttgtatcaagagcaagaacagttggagacaactaaatcatggggggcagtgtttttcccatgctgttctcatgatagtgagttctcagagatctgacagttttataaggggcttccccctttgctcagctctcattcttctctctcctgccgccttgtgaaggacatgtttgcatccccttccaccatgattttaagtttcctgaggcctccccaggcctgtggatctgtgagtcaattaaatctctttcccttataaattaccccatctcgggtatgtccttataacagcatgagaatggactaatacactactacctgatactccccggggaagaaccccacagcatcaggataggggataaggaaagcaatttgggtcaatggaggagcaaatttgccagcagtttggagctgttgatagttggattagatggtttcatgaagttttgagcctctagattcagagaccaagtgaccaccttccccttgcgctgagagggaatttcttcaactggttggaaatggaatgataggtaggatccagaagggctatctaacttgataatttatgtgattgttttctcatttaagggagagaatattatctacagtgtttctgatttttttaagggccttggggaaggacataatgaattattcagagacttctctctgtgaagcaagttgcacagagacagacaacttgatacaaattacgattctaaatttgttagtaatatattttattcatgcactctacttacaatagatttcctgcttgacatttcttagacatatcactcatgatcccacagttgctctttgaatgggtgcgaaacctgtgcaaaaaaaaaaaaagatgtacacagtctaatgaattatgcaagtcttaaaatgtctcaagaaaaagattactcattaggattttcgaatgaataaattcaacataattgttggtgcaactgctctctcatgtaataggtaccaaaatctgattcatgttttatattggagggacgggtacttttctgaagaattttaataaaggcaaataaatgccttttctaggatgctttatagtagagcccacaaaggttttcttcagcaatactatcagtgctgcttttctctccatacttccaaaacctagaattttttgccagtactttttccctgttttcttctgagtggtaaaatccatctgggcagattttctacaggcctgtgagggggtgttagccagagagcagtgttttgagctcatatacagaataggtgcctctggatagaagttccgatcccagtatcctctcccaggccccagttctgcacaggcagaggacaccatccccatgcagtccagacacctgccagcaaatgtactcgtttgctgacatctagggagccttgtgatgcttctgaatactgcccaccgttcccaattgctgaaatgtttaagaactttatagctctagccaatacgggaatagctgtacattcaggaatgctcgtgaaatgtggcagggccttgccctcctaggcttgaggcccaggctcctgatggtcggtttgattggtggcttatccatgcacctgatagttatttatggctacgtgctaggtactgtgcagacaccgaagcataaacatttcccctcctggggcttctggtcttgttgaagagacggacagtcaacatgtatgccaataaatacattatttgtttaaagtcacagtaggtgctatgtaggcgaaaaacaaggagtactggtaaggaataggagaagagggctttgctgggatgggacctttagcagagacttgggggatgtgtgggatcagtgtagggagaggagaggggagcaagccagggagaaaggagcttggccgagggcctagagcacccggggcaaagggggacctggtgcaggctgaggcaggtgagctgagcagaggcagacagggcccagtgcagtgaggaatctgattctcatccagctgcaaaggtaagagttataaggttttaggctaagagtgagatcatcataaagatggccctgactactgcctaggaggagtggagagtaagggggggagggaggacagactgtaagtggaaaagagagaatgtgagaagagtagtggttggcaattgcagttgttttagtccaagatgatgatacccgcagctggggtggtggcagcgaaagcagccgacggtgaaggtctgcatggaggttcggccatggacctgaggggtaatctgccatgcagttcagaatgatgaccctcggaccgggcatgcttctcagttaacatctgatgctgccctactaaaggcaaaacggatggtctaatgcaggcaaactggaaatagtgctggtaagaactgagagcacctgtgcttgccatccccatgcattcgaacaggctgtggcttccctctgggctcaagtggaactgtttggacagtacacatttgaatctgtgacagctcttgcactggactgggaaagttttgggcaaaaggagtccttgaatcagagactcttaatgcagggacagaccttaaaagccctccaagccctccaggccgggcacggtggctcatgcctgtaatcctagcactttgggaggttgaggtggatgggtcacgaggtcaggagttcaagaccagcctggccaagatggtgaaaccctgtctctcctaaaaatacaaaaaaaaaatgagctgggcgtggtggtgggcgcctgtaatcccagctactcaggaggctgaggcagagaattgcttgaactcaggaggtggaggttgcagtgagccaagatcacgccactgcactccagcctgggcgcaacagagtgagtctctgtctcaccaaaaaaaaaaaaaaaaaaaaaaaaaaagctctccagtaccctcatcttagagtttagggaactcaggctcagagaggtttgagttattcatacaaagacacgcagccggtgagtgacagagagaaactgtccaataaggcaaattttttttttaagaattttgaatgatggacttataagtcttcattaagtccttataggatctaatttttataaatcctttcagaactaatttatttaaggattaagccagtcaaaatcccagaacggtttcaagtcaacagcttaaaagtggaatctgaatgttaaccaagatgattttccttgtatgtggacggctgtaattgggccccagtctctcatgtgaaaagccaaacagattcagatctaatgagttctggccgctggggcagatggattttggaatttgctatttatagtgttttcaagtgtcaccttccccttttaataagcactgagctgtgatctggccccaggagcctggagcacattggtaggtgtgctgagggcctcacagccgaatgacttctggtccaggtttggaattgaaggtttaagttgggatgttggctattcctcagaagtgaggatgtgttcttccaaataaatggtgatcaatccctgtgcattggagagctgatgggggtgtgcttggcggagagaggcatacccccagaggcttgaggagggcagttgtatttcacgtgctgaggagagtagtggtgtggttaaatcaggaataaaaaaaaaatatgaagaaattgtcagggagagcttcagctgggcccaaaggaaatcaagaaaagagcaaatgagaatgcaatttaaaatgtaaatacaaactgaaatcaaagccatttctatgaaacatttaagaacattctgtaagtattgctggtcaggaaagcacaaaaaattgtctgtgttttgagcccattgtcagtgtattatttagagggaagttctgatttttgctaaggggttattccgagttgcgaagtggtgtggtgttgggggaagaataccaccaactccaggccagctgctgcatctcctggaatctctgttttctcttctgtaagatgggagtcagggtggcctccatctgatcacactgaattgttgagtgactcaaaggagataatgtaccaaacactttgtaagccctatgacaccgttcaaagtctatttcctcccagctctgttttctaaaatcaggctgtatgttcgaatcacctgaggaacttaagactattaccagcgccaccactggcatttttcattctcttggacagcagaggttttccaaagccctggatgtcattctgctgggcaagtctggctgacggggctctgaggagttggagggcctgtccacccttgcctttgggaaaccagccagccagtggtccaaggagattgtcggctgtcttcccaagtcagcgccatcttccttcctgctcatttcctgtctcccagtttttccctggaacctttccatttaaatatgaattcagctgcagcctgcggggatctgaagtactagcgagttgactgcctgaggaggtgggcctgtggagaaccagagctacagttttccacaaaacatatcattttaaatgattctgaagcctgttaaattacactgatgggattaatctgataaagtggtaacagggtagatgcaccgaaatgatcgctttcacatgctttttaattcagtcaaaattaatgaaagatcttgtgtttacggatggaactggagtttaaaattctgaattcattagcctgttttaatgcataaatctaacttccttgtccgtgtgtgaaactcaactagagtgcagctcgatgctactctgccaagagaacaggcagaaggaagccacattttacccttgaagccgggttagccccgtgccttgatcatgccactgagaatgtatgtttctagtctgaatccttttggctttatgttgtcattcagcgtgtgtcatgtccacacccagggataattcctgtcttagaaataaggtgtatgatccagcaattacacttctggatatagacccagaagagggtctcgaagagatacttgtatgcccatgttcgtagcagcagcaacattcacaatagataagaggtagaagcaacccaagtgcctattgaacagatgaatggataaacaaaatgtggtaactacatatgatagagtgttgttcagtcttcaagaagaaagaaatgctgacacctgctacagtgtggatgaaccctgaagactttctgctaaatgaaaaagccattcaaaaaaggacagatattaaacgattatatgaggtacttggaatagtcagaaatcatggcaagtataatgatggctgctagaggctacagggaaggaggaatgttaatgggtatagagtttcagttgtggaagatgaaagagttgttgaggtggatggtggtgatggttgcagaatagtgtgaatgtacttactgccatacaactgtacacttaaaaatggttaaagtggtcaatttaattatatatataattaaatatatataattaaattatatatataattaaatatatataattaaattatatatataattaaatatatataattaaattatatatataattaaattatatatataattaaatatatataattaagttatatataaaattaaatatatataattaaattatatataattatatatatatatatctcaccacaataaaaaaaaaagtaaaacataacaaaagaatagaggtatctgtaggagctctctgccctaattcagatgagtaccaccctataaatgctggtgaagtctacaggatttttgccagcatggcaaccactgtgctgtccattcttggtcagacctgtagaagggaaacagcagttgtggaagtatgtctcaggcaccctggaggacacctaaggggaaactcatctgacaaggacacagacatttttctaggttccctgagtcttctgtgtggtccatcctaccagctggggttatctgatattccagtgtatgtgaaaataatagctaagttttgtttttttttgttgttgttgttgttgttttttggcagagtctcactgagtcacccaggctggagtgcactggcactatcttggctcactgcaacctccatctcctgggttcaagcgattcttctgcctcagccttctgagtagctgggattacaggtgcgcgccaccacgcccagctaatttttgtatttttagtagagacagggtttcaccatgttggccaggctagtctcaaactcctgacctcagattatctgcccacctcggcctcccgaagtgctgggattacaggcatgaacactgtgcctggccagcttgataaatttttatgcagaatggttttattttattattatttggaagggaatagtggcccttctctctgatttctggttatatacctataactgtagcagctatttcatcctgttagctttttttttaaaaagatattttttagagccattgttttagggttataggaaaatggagtggaaagtacagtgttcccttatacctgcccctctcctcaacagtctcccctcttattaacatcttgcattaattagtgtggtacatttcttacaactgatgcaatattattaacaaaagtccatggtctacattagggttcggtcttggtagtgtatagtctgtgggtttggacaaatgtgtcatggcccgtatccacctttatagtatcatacagaggatcttcactgccctaaaaatcctctgtgctccatcttgttcttccctccctcccatcagcccctgatccttctattgcctccatagtttttccttttctggaatgtcatatagttgaagtcatgcagtatgtagcctgttcagattggcttctttcacttagtaatatgcactttagtttcctccatgccttttcttgacttgatagttcatttctttttagtgctaaatcatattccatcatctgggtataccatggtttatccattcacctattcaagggtatcttggttgcttccaagtcctgtgctcttttaagatttcagtttttgacccttgatgtgacaagatgggaagggccacaaaatatctcattctttttctcctgttgacttagtctgaatactccagactgtgctgacctgtgtggttcagtctaggagccataggctctgtgaggctgttgaacagttgaaatgcggctggtccaaatggagatgtttgtactgtctgtgcagaggtacgttggatttcagacttagtataaacaaaagagtttaaagtatcattaatttcttacatcagttatgtatagaaatgataatttatatcttggattatataaaacatttaaaaattgttgtacttgtttcttctttccttccttccttccttccttccttccttccttccttccttccttccttcctcctttctttctctctctctttctttcttcctctcttccttcctttcttccttttcttcctttcttccttctttctttctctttctttctttcgagacagagtctcgctctgttgcccaggttggagtgcagtggggccatctcggctctgtgcaggctctgcctcccgggttcaagggattctcctgcctcagcctcccgagtagctagaattacatttgcccaccactacacctggctaatttctgtatttttagtaaagatgaggtttcaccatgttggtcaggctggtctcaaactcctgacctcaggtgatccacctgcctcgaactcccagagtgctgggattataggtatgagccactgtgcccagcctctttttaattgtttaatgagactactagaaaactgtaaattacctacagctcacataatgtttctgttgggtggtgcttctgggaaaaagaggaatgcgtggcttttgtccatggtgcctctttaaggatgttattcagctgatgtttctcaggtacctgctatgtgccaagcactgttgaagcacttcagataattcagtgattgaaagaaacaaaacccatgactttgtgggttttagtacattagatttggatattatcaaattattttggcactttttctccacagtagcactactgtttttaaaagaccagtgccagccgggtgcagtggctcatgcctgtaatcccagcattttgggaggctgaggtgggtggatcacgaggtcgggagttcaagaccagcctggccaagatggtgaaaccccatctctactaaaaatacaaaaattagccggacgcagtggcaggcacctgtagtcccagctactcaggaggctgaggcaggagaatcgcttgaacccggttggcagaggttgcactgagccaagatcacgccactgcactccagcctgggtgatagagtaagactccgtgtcaaaacaacaatcaccaccaccaccaccacaacaagaaacacacaccagtggcccaggaaagacaaaggaggctttaggatatgtcccggttctcattctggtcccaacacttattatggatgtaacttttggcagttccttacccgttaagccttggtttcctaaccgtaaaatgggactaagtaattcctctcatagagtgctgcttgtgcaacatggggtcagaatgagtactcaggaagtgattcccactcagcccgcatcccttcctggagcactgcagttttgggattcttgtctccagcccagctcttacagcccctgagagcatgctgagcaggggaaagctgctctaaagttcaatttgcattgtaccttctccatttacatttcttgaccttttgctttctcatccagcaatccccagcagggtgtctgtgttctaaggcacccacctagcctctttctgaattttaatcccagctctggctaaaagcctgaaagcaaaatatgaatcgtagctccacaattataacgtgggactttctttataaaatgaagttgctctagcagaaagccagggctacaaatcagtagcggcttcaggatgcatggcctctttctggcataggaggcccctttttcttctcagtcgcggtgtttcttccaacatctatgcatgttgaagtctggagaaggctgatgctgagagatatgtactaatgaaatgcacaggtgttatctttttctgttccaagtccctgtgtgccctcctgtcttggtgggtggcatggcaggacatagaaacacttggaacctgtttactattttccaaaaaggccttgcctgtagcccattgatctacccactatgtatattcattttaatgctgtttttgagtccgttgactaccccgggaaatcaaagttgactaccacagccctagtcctcaagtgtcttgcctgcaatgaggttacctggcctattagaattaaggactaaaatgcaggagctggggtcacacctgccagctgtttgtgagccctgaagatgttggggatttaaattttagatagatcattgtagctgcaaggggtaggacggataggtggggtatccagagtccttggataccttgtcttcctggaccctctctcagcacccttgggctaagatgcactcttgaacacatttcctctatggcccctttcagatctgctgatgatacctggattccttctttcagagtgacccagccccatcccagggaacgggcagatgggctctgttgcccatctcaaagttcccttactttttttcttttgaggttttatcagtccagaagtggaaagaagatggatgccattagctttagaaatattttttatgttttagggagaaagaagcagagaatatacttttagatgagcacactttaaaataccagtaagacagacttgttggaagacaggcattgtgaagaactgttgttgttttttggttttttttttttttttttttttgcaacagctttccccactttgggaaatgagaacttatgccctcctgaatgttgtatttgatgggacttagatccatgggggaattttattttattttttaggaaaaggtaacctactaagtatagttatatccttctagcatgaaatataatcatttattagaccagaactgtttgttaattcagcagtgtgtcttgaaaaagagccaccctcaaatttaaagtagaaatagattcttcattctacacctttttgacatcagatttgctttcctggtctcagtgcaggtgcccctactgtttggtgtttgggacacagcctccgagtaagtccaaggagagcttggggttaggcagtataggccatgagccccttgccagcctcccagggactttgagaggagctgtttggggcaagatgcttaatgaaaggatgttttgtaatttagagagaaaaaagaaatttatcccatagataactaaaccctcaatgggaatattagaaaatacaattgtcacattatgtaatatttgtacattttccactgcaagtaagaatgcgtcctttccttaattttaaaatatggaaaaggtcgacctttctgctaccgtaaggaaaatcaagggaaagggaggttttatacatgatatggggaacttggtataattatttagctcagtatgaaattctgccacaggaatataaggtaattaatttctctaagtatgaaatgcaatcttgaaaaactaggaaacaggtgccgaggtgacaagataggaagagaagctgagtgttgtgcagtggcaccgaacaacttctggaacattccagagcgtggctttgtagctggagagagcctcctggcttctgtgtggcgaccgagactgacccctgctggcagattgttgctaagccgtggctgttaatgaagcagggcaataaggcccttaagcaggagatcctgccaggccacaggcaggtctgtctccgaggctatgccttgtaccagcccttgatgctgttgcctgaattcccagtgggaagaaaaatggacccagcagtttttagtgttttggtctcagtttccaccatctctcccctttcccagtctgggatgtcagtgtttgctctctcctccctaccctctgttacctcaagatttcatggaaataaaaagccctgctaacatcacaaagaggctgaaaattccagatccacctcggagccagacacttgagaaatttgatgccaaggtaacctgcgtttgggaaaacatccttattaggtttatttaagaacgatttgaaaaattcctataagtgaaaatcagatgggaagaagtccaaaaatctgattcatgccatgactgtgatacaaccaagatcttcgtgagccagtggatggggaagagagataatgtacaatatttctatgtgtttcctggaaaaattcttaaacggattataaaaagcactaagtgtaaaggaaaatgttaatacattggactgcattaaataatagaccagcagaggtctggcgtggtgactcatgcctgtaatcccagaactttgggaggctgaggcaggcagatcacttgaggtcagtagttcgagactggcctggccaacacgatgaaaccccatctctagtaaaattataaaattagctgggcatggtggcacacacctgtaatcccagctgctagggaggctgaagcatgagaatcacttgaaccccaaaggcagaggttgcagtgagctgagatggcaccactgcactccagcctagacgacagaataagactctgtctcaaaaaacccccaaaaaatagatgtgcagagtctttatttgtggtagaggttagtgttttccccactacattttccaccagcttgttctgggagctgcttttgggtgctggtgaggagtaattcgtggtttaggaagcttgagtgcgggtgctgggtcctctgcttgttgctcagcagggtactggaggccaggaaggctggcgctgcagaaatctgtcttcagtgcacttactgctgttgccatggacagctcattcgtatagctggtgtggagctaatgaagtagggatgtttttaaaatgaaattttaaaaatggggtttgagaagtacataaacagttcattgtggcataaaatgacattataatcatttaattttgagatgatttaaaaatcatttcctcatgttccatgttctacagcttaccagtcaggaaaaaggataattttgtgggactcaatgaagtgatgaaattgagaacaaagcctttcatctttggacttacacttccatgttcctaaaagagttaggcagggatatgtaggtaaatcaaagactggaaacgtagggtctttggaaacttttttctgggtcatctttttagtcttaaagctaagccttcagttgccaagcagtggtttttttaatgaatgaggctggtcaataggatatctatattttaaaaacctcaaccacaagtaacaccctacacaaaaaccaattacagatagatagtagacctaattgtaaaacaataaatgttctagaaaatgacagagaacatgtttatgaagttgaggtacaaaataattttgtaaacaggatctaaatagaactaaccctaaaggaaaagattaatcaggcatttttgttaattgaaacatcaaagaatgaaaggtagactggtattgggggaagatatttgctacacttatacctgttaaagggcttgtgtcctgaatttaaaaaaaaggtcaggtgcggtggctcacacctgtaatcccagcactttggaggccgaggcaggcggggatcgcctgaggtcaggcgttcaagacagcctggccaacatggtgaaactctgtctctactaaaaatacaaaaattagccaggcatggtggcaggcacctgtaatcccagctacctgggaggctgagacaggagaatcgcttgaacccaggaggtggaggttgcagtgagctgagaccatgccactgcactccagcctgagcaagaagagtgaaactccatctcaaaaaaaaagaaaacctcctcctacagatcagtaagaaagacaatccagtagaaaaatggggaggagatttgtaaacttcatgaaagaggatataaaaatggacaataaacataaagtgttcaacctgggtcatcaggggaatgcaaattaaaactgcaatgggatgtcaccagcagtcgtaagaaagaataaaatgaaaaagaccacagtactaagtgttggtgaggacatgctcctggtatgcaaattgctataaccactttagaaaactgtcagtattgactaaagctgaatacacactcctgtcagacagcaattcttctcgtaggtggatccccaaaagaaacatgcatgtgtaccccaaaagtcatgcccaaaatgttcacagaagtattattcataattgccttaacctggaaacaactcagatgttcctcacatgtagaatggatttttttgtataatcctatcatggggtactgtgcagccctgaatgaaaaacctgttatgtgcaacaaaagtgtgatgtcttgcagacataacactgagagaaagaacccaggcacagaattgttttctgtatataaaactcaaaaagaggcaacactcatctctagtgcctaggggtcaaggtaaccacatcttgctggggagaagagtgactagaacaggcacaaggggacttctggggctctcgttccattctgacgatggacgggtttgtggatacacaggcgagattatgttgtgagaatccatcaggctgcatattatgacttgtgcatgtaaaacatgtatgctacacctattaaaacgtgtttgttttagaaatgccttcagtatgtacagctatgatagatcaacagaaaaaataaaacactttaaaatttctttaaaaatttttaaaaagcagtgccttcaaacacccaggctattgtgcagcgtgttgctactgtctgtgatgcctgcgaggcatgggtgagaggaggaggcggtgccagtgagtagagtgagatcgtgatattgctaaatcactttcttagggtgtgaaagactctgctttagctctttttcgggcttttctgccatgccttactagttttggcagttttcctattaaaattatatgtaatgtcttgatataactgtgctcgtctggagctgtgtatttaaatagctgtaaacttctcaacccaaattgtgggaattaaatttccattagcagattggcagcataatctggtgggatgttctctgggcccaaagccaagagccctgggttctagttacagcttctagtcctgacctggagcatgtcactcagccatcctccgtgggtacctcctcctgaaaataatattaaatctacatatggaaatcacatccacccacctctaaggttgctgtgaaggtaagggaaggtaatatctgtgagcactgtttgcaaattgcaactgcagagtcataaatctgtttgcataaaccacacattccagaggggttctaatcgtgtttacatatacttcttaaatttcgtactaaatgtctgtagatatgaagatgtgaaaacaaaagctcagtgagaaagtaaccaacagaatggaggaattctggagaagtcctaacatgtagtgttttcccattcctaatccctatcatcttgtggcattgcgtgtacttatttctgtgttttcacattattaactgaccattttggatggttgaatatacaggagaggtgctggttcaggaaataattgtttttttttaatccatatttcaaaagtaattcttgtcggtatatacaaatatgtttaagttttattatttgccttttaacaaattacaacatgccacattaggaataagtttgacacaccttaatcattttaagtcttattatcactaaaatttgcagcattctccttcatggaagaaaaagttaatttggtggaacctttagtcaaattaattggtcagaagaaatactgtatacttaactgaaagagggaaaaaaaccccatgttttaatgaacttaaatttaattgaacaaccttcctcaatcaatgttttagaaattgtttttctcaggaaacaaactattgacctaggcaagtggtttaaaaacttttgtttgacggtagacatatacttttgcaaataaaaccttccacggaacctgagtccgtagagcagataaaagaccactctgaagcaggggtaggagtggagaaggtagaaaaatgggtggtagatcttaccactgagtgttttgcttttgaaatacgaagcctgttggatgccatggaaagccagataactattactctgtatgatagtgcagggaacgttctgtgtgtggttgtgttatgttgacattccatccagtgtgccactccgtataattccgtctgacgtgccactccatataattgggatgctgtctgttcacttagctgatagaggtgggattcagagactgtggtgtctgtgatgctgtgatcctagacatggtaagtgcgtaatacctctagatgctgatagattaagctatgattgaatttatagtttccagaatgaatattgtactttgagaggctataaagaatatcaggctgggcatggtggcgcacgcctgtaatcccagcactttgggagacagaggtgggcggatcacctgaggtcaggagttcgagaccagcctgcccaacatggcaaaaccccatctctactaaaagtacaaaaattagccaggcgtggtggtgggcacctgtaatcccagctactcaggaggctgaggcaggagaatagcttgaacccgggagcaagaggttacagtgaaccaagattgcaccatgacactccagtctgggccacagagcaaggctccatctcagggggaggaaaaaaaaaagaatatcagtaactgagaaaatacgcaagatgaaccacctttccagaaatgttccagttagtcaaattatcctggtaacccacagctcactgcagccttaatctcctgggctcaaaagatcctcccacctcagcctcccaactaactgggaccataggtgcacaacaccatgcctggctttttgatttttttgtagagatgggctcttgccacattacccaggctggtctcaaacttctgggctcaagcagtcctcctgccttggcctcctaaagtcctgggtcatgagccaccccacctggccctgaggcttttctgactaaaatattttaaaatgttatatatttttaaaactagtttttgctatagtatgagatgaatatctgtccccttttgagtaaatttcaattaaaaaatacagagtcctgtaattcagtgataagggagctggggaggcccttactttcaaacctgaagaattacatctgcttcccaagaactgctttcttgggaacttttaaaagtatgtatttgtttttgtgagtttgtaagagctgcgttctgtctacagaggaacttgttaatgaatccctcctcttatgatattttatatagaaatgcttggtttgtgggttgcgcccatgacatacactctgggaaataagaaaattatagacaaaccaaaatagaaagcagctcctctctcaaggtgagttcagcagttgtcagtggataaaaggaccttgtaatgagcagctaagcccacactcctgaaatgccttttcattgcaagagtgaaaacgagagataaaggaggttttttcctgagtaattctagcttgcctagcacgctatgagcaacagatagaggccaactttaaaatctccatgactgaattataccaccaaaacttgtgatcagttcgttttctgctgaaatcaggaatacatgggtcattaatatcaagtagaatagaaaagagaaaagcagtacctaaacgcaaccatcttttttatcctcagttggaaaagtgtctgttttcttctaattataaagatgctgcatgctcattacaggaagttctaagagtatcaaaaagtgtgaagaattaaagattaaccaaaattctgggaaaagattgttataacaatgttgacaggcatttacaacaaagcataacattattctttgacattatgctttgttgttgtttttaacaagctatatctagcttcctattattttcattttgaagtgcgacattcacccatcagaatatacactgaactcataaaaatattccatgtttcaaaagatgaaatacaacctttaaataaacacctagaaaaatggcctccctgggcacaggggtgcatgcctgtagtcccagctcctcgggaggctgagactggaggatcacttgaggccaaagagtttgaaaccagcctgggtttaacacagacccccatctctaaaaaatgaatttattttaaaattttttatatggcccgaagggtattaaagacaacaatgtaaaacaagatcctgcttattaagttaatgaaatcacaacacccagggttgacaagggagccaaaaatggcagtctttttctgtcttatggcctatacgttgatatggtatatttggaaatgaatttggtgatatgtatcaataagctttactgtttataatcttgatctgagaacttcatttttatatttatttgcctaaagaaagactatatttataagggtgtttgtgttgaaatggtcattccagtggaaatggcctacatggaatgggctgtacctcagctggacttcaattcaaatggctgtctgccagctccgagccttggacaagtcacttaacctctaaccctcagtcagtctctatatttttaaatggggacgacaataatccctgtctcagagtgtttttatgaagattacaatgtaatttaatatgcaaagcacttagaaccctgtctagcacggagaaacagcgcagttgtcaccccttctctgcaggggatacattccagggacccccgtggaagcctaaaactccaatagtgtcaactctgtataagcaggttgattatccctaatctgaaaatttgaaatgttctaaaaaccaaaactcagcggtgaaaggaaatccccactggagcatttcggattttcagattgaggcatttaaccagttagcatgaaacagatattccaaaatcaaaaaaaaaaaaaaaatcctaaattccaagcacttctggtcccaagcattttggctaagggatacccaacctgtactatgtttcttatgcattaatatgtctgatccatttataaattaggcacagtaagagattaacaacaataataaaatagaacaattctaacaatatactgtagtaaaagttatgtgaatggggtctctccctctctgaaaatatcatactgttgatgttagcaatctgggcatatgaaatttcacttatcgggaattttcaccttttcacttaaagtaatttccagcttctctttgacatatctgaattgccggtgtcaccactctggtactttagggccattatgaagtaaaataaggattccttcagttcaagccctgtgatacctcaacagtttatctataaccgatggctacgaagagactaagaggcggtagcagcatctacagaaggggtctgctggacaaagggatgattcgcatcccagatgatatagtgggatggtatgagatttcatcacactattcaggattgtgtgtaatttaaaacttacaaattgggccaggtgtggtagctcatgcctgtgatcccagcattttgggaggccgcggtgggcggatcacctgaggtcaagagttctagaccagcatggccaacatgggtgaaaccccatctctactaaaaatacaaaaattagctgagcatggtggcgcacacctgtaatcccagctactcgggaggctgaggcaggagaatcacttgaacccgggaggcggaggttgcagtgagccgagatcgcatccttgcactccagcctgggtgacaagagcgaaactgtcttaaaaaaataaagttgtttatttctggaattttccttttaatatattcagactgaggctgaccacaggtaattgaaactggaaaacaaaaccacacatacagggattacttggaaacattgcctgttaccaccttatgcattggtgtgaggcttgaatggagtaacacctgagggcagtgtctggatagagtaaaccagcattccatgttagatgatattcttagtgttagtattagtacataaaacttagaaacaggaccgggcacgtggctcatgcctgtaatcccagcactttgggaggccaaggtgggtggatcatgaggtcaggagtttgagaccagcctaaccaacatggtgaaaccccatctctactaaaaatacaaaaattagccaggtgtggtgatgcatgcctgtaatcccagctactccggaggctgaggcaggagaagtgcttgaacctgggaggtggaggttgcagtgagccgagattgtgccactgcactccagcctgggcgacacacccagactccatctcaaacaaaaacttagaaacaaatattcatctaataactggaggaaaagcaaaataaatttcagatggaggctgtgctatgaagactgtcacagttggttacaacacagtgttcattgtaaggataccaaatttcatgtgcgcggttgctctaccaaaggatatgtgcatgggaagatgaagtaaaaggagatgtattccacaggtatagtaccagcttccatggtgcctggcaaagcataaagaagcttgggttttggcctcttgaaattaatttaaagcatgagatgggcttaagcccatactatagagaccattaagatgcaggaagagcttgataattctggaccagtctataatttgaaataaatgtattttgaagggccaaagccagtggctctttactgcagcatgtaatttgattcctattggtttttgcaaggtgcttgaggacttttttcatgctgaaatttcatttctgctgttcgcaggacaagagaaatttgatacccatgtacgacttgaccaggcttgaaatttcactttatttgatggttcggctagtcatatataaattagtgggttcaggcttcagtagggaacacacacagagccagcagctgtggcctgttcctgtctcctgagtgaggagcattcacgatgttcttttcacttagagagggcttagggaagatttatgtgttcgctgtctctcatttctgttctcaaacccttgttttctccgtggaaaatggtgatgtactttttttttttttttttttgagacagggtcttgctctttaacccaggctggagtccagtggtgcgatcttggctcactgcagcctccacctcccgggctcaggtgatcctcccaccccagcctcccaagtagctggcactgcagacgatgcaccaccagctaagttttgtatttttggtagagacggggtttggccatgttgcccaggctggtcttgaacttctgggctgaagcgatctgcctgcctctgcctctcagagtgctgggattacaggtatgagccaccgtgcctggccctgtgatgcacttttaatcacagcggtatttggtcaaaggatggcagaataactaggcttgtgggctagggagcatccaggagggacacctggtcttccgtgagagtccggcgatggggatctttgcatccctctctcacattggtcaaggcctcatttctactcctgatgtctactcctgatttgggcctgagaggtgcgagctccctttccagagtagaataagcagatggtgattctgagcaatgtgggatgtggactgcagcctgggcaagggagtcccttgagatgagtcctccatagcagccaggatgccaccctgacttctggctctcctgactcagtccacttttagtctctttttctgcaggccatgaaatagctcagcccctggcctgcttcagacctagagctcagccagcctgcacttcggctctggttacgtcttggagatctgctctgtttctagcccagggaggtgcgtagtttatatggaagtgaactatatctttttaaaaatacatttccttcttttcttttttattgcgtccatgtatttagagctaaaggagaggtccacagcatgagtttatacttcaccttagccagaagtccctgccacatttatccttagatcagagaatgacactggagtgaggacggggtagtggggggtagggagtggggtgctgccctagcctgttcccagatgctgcataagtcatcgttttcaatcctgcatgcttagcttccgacccctgtcaccctgccaccccctcagaagctgccgcacacctgctctgtgccatggaccagccagagtgcagggtttgtgtcatgcgccccctccaccccgtgagctctttctttaacctttctcctgcaactcctcctcagccccctttgaaatgccaaattcagaagctgtgtttcccttcctcagccagctaacgagagactgaatttaaaacaaaacaaaacaaaacaaaacagccctcattgtctccctttgatatttgcctttcatctcgtctgtcccagggtcggggcatccacctaggccagcactctggaaagacgcctcacctgcagcaggtagagcccagcaagtcggtccaggcttccgcacatggtcatgtccccatgggtttgtccacatgggtttgtttgtccttggaaacccttcagctccagggagcctgaagtccttggcgaaggataaagtggaaggggaatgcagcatgagggagtctttctgttcatattcaccacctgaaaattacaatggttcaagcagtgcaccttctagacgaggtggtctcagcaagccttaaaaccatctggtcaacaagagcaaaacatgtataaggccatgaatgtacctggggctggtttggtttggtttgcacaaaccaccccctcctctgagtgatgtataaataagaaagtaaacccatctccctgccaagtcattctaaagaagtagccctgtcttggatgcccatgtttgtcttccacaccctttagtgtagaagacatcagggcccacctctgcatcctgggcctgtggttcctgtcctcttcatccagatctgtgactgtcgtgatagtgtcctaactgaccgcctgtctctctggtcttgtgcctcctcccagccgtcctcgggcccccttgcactgtggatcacgtccccatgccgacactcatctgtttcgacctgtgggtggctccccgcgcagctcgccaggcaggcctctgtgaactgactctgagagtgctctctggccccaccgttgcttctcacctctgcacttgcaagaggctacttgtgcttctgtgcaggctgtggcctcttggggctccctgcatctgtggtggctgctgctttctgctcggagcatgtgcacatgtgcgttccctagtcagtacacagtcagcccctgctgtggcgctggcacacagcagagagcaagagaagtggctttgccccccattgaacagacagagtagtagggaagacagacatcaagctagtcatcacgaccataattacgtaattaccctttgtgacaagagctgtgaagtggcaggaaggaagcagaccagggtcaaggatggccttcctgtggtgtgatgtgtaagctggaatttgggtaggaaataggtggagaaagagcctgaagaaagatgtttccggaacctgcgatcaagatgtgtgaaagtcgtgatgggaaaatgaggatgacggtagcagtgggtaggggtcagaggtcacgcttaccaagggtttaccgtgtcaggcacgggtctgtgttacctcatcacgtcctcatacgacactgcaagaaaggtgcttttaccatccccactgcacacatgtgaaaactgaggcacagagaggccagtgggcatgcctgagctcacgtggctggtagggtggtgggatttggacccaggtagtctgggtcccgggatcaagctgcagtcactgcagcatcttgctgggaccttgaaagaggcctttgtgactggaactgaaaccagggagctaaggctggaaggcagaggcagggccatggagatggtttaggaagtgagtgatgaaatttggatttttatgtgatcagacttggttgggaggacagtggattgaaggagaggcaagggaaggaggcagagagaggaattatacaccgaaggttaaaaaaaaaatcgggggttggacttccctccttctttcacttggtgctttctccttgcccttcaagacctggtgcaggtgtcactctctctcctcggctcactctctttctctgcgccggagatcctcaagatcaggggagatgtctcggcatctctcagggttcctcatgcacaggcggctttccacaaataaatgaaaggaatggagggaaaatagttacaaagctaagaagcaagatgtttcattgggtaatttaacttttcaagttcataactctgatgtgactttcacagtgtaagctgcctgtggctgatactttactcatggagtactagtggtctgttattcaagctaaaatttccatttccttattagcctgagtgaccagcattactcccctagctccacattcttagggagtcaagaggtcgctttcagcaggccaatctgtgcacgacctgctggtgctgcagcattccttactcagatctcagagaccctgggattttgcagtgctttggaaagctgacagggctggcactgggggctggctgggatgggaacaggctgcccctcttggctctccatataggcctgagagccacgtggtcccacatgagacactgagccatgtttgggctccgcctccagggttccacgcattcttagcatctcagcaatccaaggacaaacacatcagcttccccgtagctaaacataagaaagttgtccgtgtttttatataaactttactgacatttaaacatgcatacttcatgaaaagtgcaatattgtcagtgtgcggtaaagtgggttttcgccaactaaacacacttatgatcaaaacatgcccggatttgcacccagatcaggaaacagaacatgacgccaccctgcgcccttcttgcttcccttctgtttactgcactcctcgtgaaggtaacctttgtcatcgcttctaacagcctggattaattttgcctgttttttgggctttctaccaatgggatcatacaatgtgtagagaggatgtaggtttaagatgagatttgttgcccccccccatgctcgatttatcccatgttcctagaaattatagagataacacaagtggaaagacagtctcacagtctcatgacaggaaggttacccatccggggtcaaaccatgcttggcacagagccacttgttaggattcagcagtaattaaaatgactgtgttgtttataaattgttttatgagtgcattagtgccttgtttattttttatcaccagagaaagagtgatcctcctaagtaaatgttctagatcagttgagaaagcaaactttctcagccaagggccagctagtaaatatttttggctttgcaggcgcatatggtcttcgttgcaaccactcaattctgctcttgggatgcaaaagctgtcttggacaatatatgcacaaatgaggctggctgtgctccaaaaaagctccatttgtggacattcaaataggaagttcacataattttcacttgtcacaaaatattattcttccaactttttaaacttgaaccatatttgagagggaatctttctgaagtgttttgttttttcttttttgttttttgtttttgagacagagtctctctctgtcccccaggctggagtgcagtggcacaatcttggctcactgcaccctctgcctcctgggttcatgccattctcctgcctcagcctcccatgtagctgggactacaggcacccgccaccacgcctggctaattttttgtatttttaatagagatagggtttcaccgttttagccaggatggtctcaatctcctaacctcgtgatctgcccgcctcagcctcccaaagtgctgggattacaggcatgagccaccgtgcccggccatctttctgaagtttttaaacactgatctaaattctcaggatgagctgagaacattttcttagtaaatatgggcaacatggtttaataaaacatggaaaccctggcactgtccttttgccgtgtctctttgggcaagttttaacttctctgggtctgtttcatcttctatgggatggggataaaaggaaggacatttagccattagccccaggagagccatgctagttatttgtgaacagaaccccatctgaagagtcacggaggatcctagttggtcagtgtccaggctgtggcagttgttaaatattttgaatatcactctttgtcatgacatcctctctactgaggtcttgtatacactatggccagcatttgcgtcgtgtatagtaattgctgtttctcctcttcccatggaaatggctgtaggcattcttggctaagagggatacttctgtattaactaccgcaactcaaggacttctgtgctacaggtggaatatccttatccaaaatgcctggaaccagatgtgttttagattcagatttttggatttgggatttgatatagtgtggctgtgtccccacccaaatctcaccttgaattgtaataatccccatgtgtcaagggtggtgccaggtggagataatggaatcatgggggcggttccccccatgctgttctcatggtagtggataagtctcatgagaactgatggttttataaatgggagttcccctgcacaagctctcttgcctgccgccatgtaagatgtgactttgctcctcatttgccttccaccatgattgtgaggcctccccagccttgtggaactgtgagtccattaaacctctttcctttatacattgccccatcttgggtatgtctttattagcagcgtgagagcagactaacacaggattctaggcctgtagtttgtgtagttttccattcccctagtggccaccaggatgtgagctgtaccttcacctagcctgcccttaagtcagctcctctaccaactctaccttgctgtttcagattggtaggctgattaaaactctctaaagccagaggaggcctgcattccaccctcagctgagtgtgagccccgtgtgacctaggaagtcagcagcacagactttggggccagatagtctggtggaaccccagcccctgccattgatgttatgtacatcctgggacgtgttacttaccctctctgttcttcagttttctcctctgtgaaatggggagaaatagcacctactgcatagtggctgtgaggattaggtgaattagtatgtgagaacatttcaaacagtccaggaagcactatgtaaatattagctgtcattattttttttgttttcactcaaaacacattacttggttctgatgcttgctagagatagttgaggttcccgggtatatgatctccagattagagaagttacatattaagtgacagatttggtgttgggaggaatctcatgggcatttttttaggatttgattattttctgttgtatctcattgtcgtctttttaatagctgtagacatctaatcctgagctagtgttttactgttctgttactcataaaaattctgaaatgcaggggttaagaatagacaatcaagtcttaagtgctttgcaaaatgaatttattcctttgagaattaaagtgatgtcctgaaggaagtcacagttaatggtcagtttcctttagggaaatattcttgaagaattagagtgctgctctcacatatctttgatggaaaccaaacaactcctgggttaatgtttagttaaatgaaccaaaaaaaaaaaaagtatcactttgcttagttagaagcaaaggaaaatattaattattcgaatggagaaatgtttgaaaatgagaaataattatgttacggtggtgggattacagatgataagtatttttctttttttgaagttgggtaagtatttttctttttttgaagatggatttgccttttaaaaggaaagggggaaaaagcctgaagctgttacagtctgtctctaaactaaattatcttcactgcaatccaacattgtgcagctaagtatcataaaattaagactcacagcctaaaccctctaataggtaagactattctaagacactggtaacacgtctctgaaaagtgctggcgttttgtgctgttagtttcctgggttgattttggtttgagttcacagcagaagtctgttgggtagccagaaaggaagaatcatcacgttgggacacaaatccgagtcctgtctgtcctttgcattcttccttcccccacgtcgtcctggcttggcttcaagcaagtctgtgaggtaaaggttggtggcttagcttcctagggcttctgtaacaaattatcaccatctggtagtttttattgttttggtttttgtttgtttgtttttggcttttgtttttgttttttcgatggaatctcgctctgtcgcccaggctggagtgcagtggcttgatctcggctcactgcaacctccgcctcctggtttcaagcagttctcctgcctcagcctcccaagtagctgggactagaggtgcccgccaccatgcccagctgatttttgtatttttttttagtagagacagggtttcaccgtattgatcaggctggttttgacctccagacctcaggtgatctgcctgccttggcctcccaaagtgctgggattacaggcatgagccaccgtgcccggccaatctggtagttttaaaacaaaagaaatttattatattacagttcaggagcccagaagtcccaaatcaacatgtcaggagggccacactccctccaaagtctcaggggaagatccttcctggcctcttcccactcctggtggcttctgttgttcctcaccctgtgactgcattactccattctctgccaatgtcttcacacggccttcttccctttggctctgtcaaatccccttcgtctttctgaggacaccagtcattggacttgaggcctaccctaaatccaggatgatcttatctcgaggtctttatttaattacacctgcaaaaaccttacttctacatgaagtggcattgttcgtctgggttaatacctgaggttcattgcctcatgccaaggaaatcaaggacactgacacacaaggagtgagtttaagagcaggagtttaataggcaagagaaagaggaaagctctctctctccttcagagagagaggggctcctgagtgagtcttccagttccatggtgaaatgcatggggaggggggggtggtggttaatagatgagcgtggagaggcggtgtctgatttacatagggcccaaatgattggttagataggtgtgccatttacatagtgtaggaagaagatggctgccccaccctaatcttttgttaggcaggtgggttctctacctggccagcgccatgttgcctgcttctttattgcacacctggttgacagaagggaagatggaccctccatgttgaacacgcctgacccccaggtagccatttcctatccgcagagctgccggcattcacccgtgcaagcttccagcttgcttatctatgtctgcagctcgattttacaggctgctctgctagaaaagaaatgatctgggggctgctttttgttaaaacagaaaccttgctgaggactctcttaccctcgctaactgcctaaataatttctttctagttcctgtagcacaaataagattacattctcaggtattggggattaagacttgggaccactccttaagccactgtagctgacctcacagatgtctcagctgaccaccaggcaggtgtttccacccaaggacgcacttccccattccccatggcaccagcaatgtggagtggggagccgcggagcagggagccagcagcttaagtttgaaatccagctcactgttcttgagactggaacctggagggcattattaaatgtctcccagccttggttcctgtcttgtgtaaagtgaaggtgacggtgtctacccctctgggtcacaagaagcatgtgggagaatatgggaaagtagctgacagggtgcacaagttacagcaggaactcaatatgtgtccttgagtctgaatgcagtcatttagggtcctcagtattaactgccttgctctcaggtggatgatgtttgaggattaacaaatctgttgggtgaatccagataaatggggagttgacctttctggatgacacaggttgttgaccatggtttaacatattcaataagttaatataaagagtcttggcagtgcctggtgcggcaaagggacctatatctgtggttgtcattgtcgttgctatggttgccattgctatggcaccataaccttgttgatctgaaccagtagagatgaggctttgaggtggcccctggagatcacagctgaggagccctaagcccacccccagaaatgttgtgaaagtggctgccttctttcctttacctaacttgtgacatccttcagcccaggactcagtacacagtgggccctcaaaaaataggattaactattaactgaaagatcttattccaggtgttcagggaatcagcagaattagcgtgactttctgctaataatatcttcaactgatgtgataagagtagagttctaccagtggccactgcaaaagacacagagcatgcaaaatcctctctccttttatcagaaggaagagcttctccatcctttcaaccttggaccagtaattggtccctttaggagttagtttaagaaaagctatgcatgccttagccagcctgaagtcagacccttaatgggaagctggtgctttattgatgctcagtaacagaacactgctttgagctcaaaataacttctactaagctccttcaacagcttgctccctaggtggctcagtgttttgctgctgtctgaagttgtatatactccagtgaagcttgagtttcttcatggtcatcatccactatcaccagttaatatgggctgaatatccataacatgtcagactcagtcgggatacataaagaagaccctgtacctgcactggggttgtgggtctgagggccattagaactctagatggctgcacagacacaggtgaggctgtggagcaaaggcagagttggtggtgaagggcctatttttaacttttattgccgccatgttgctcctacgatgccattatgaatggtctctgtgagtccaggcagtggttagtgtctactcagaaacctcacaatgtctgtcctcctgggatagaatatgaacagaatccaggtctggggccatggatgttgaacgtgatagtatgtttcctggtatcactaaggtctgatctcttcccgttttcctacagttctatgaacatttctttctaacacaatgttttcttagggctaattttaagttattttttggggactatcatcccttatatccttctccttccaaggtatcccaaagttgatgtgcagtgttactgtacactttttcagcatgtgcaaatctgtctagcttataatctagcatcattttgtgttgttttacattttatataaattgtattacactctacagattcgtttgaaacttgttttctgtccaacctgatagatttgagatttatccatattgatttatgtagatctagttcattcattttacttgttatatatgatgacagtaattggttcgttttcctaatggaggacagctagattgcttccacatttctgctcttttaaacagatatatatatagatagatagacagatagatagatagattgattgattagatagatatagatatatagatatatataacatatatgtgtgtgtatatatacatatatacgtatatgtgtgtgtatatgtatacatatatacgtatatgtgtgtatatgtatacatatatacgtatatgtgtgtatatgtatacatatatacgtatatgtgtgtatatgtatacatatatacgtatatgtgtgtgtatatgtatacatatatacgtatatgtgtgtatctacatatacatatatacatatgtatgtgtgtgtgtgtgtgtgtgtgtgtgtatatatatatatatatatatatatatatatatatatcctgcagtagctcttcttgtgagattctcctatgtgagaattcccctaggtctggggtgtactcagaaggggaactgccagtcatatgtatctttaactttactagctttggcaacttgctctgcaaagtgtctgaaccaatttacattccaccagcagtgttggaggattctacttcctcaaattcttaccaataaatgcttttatcaggttgaccaaaaagattccatgtggctggggtgaaagagcaggtgtttgcctctctgtgattgctgggaaggttaaacaccttttcataggttgattagccatcagtgttgcttcttctgtgaattgtttgtttatatctctagcacctttttcctccttcctgttttggggcatgaggaagagaggtgatgctttactcactgattggtagaaattccttacatattctggatactaattttttgttgatataagttgcaaattatcttctgctgggatttgacattttcataaaatattttgatgaaagaaaaatgagaaatagggaagagcattcaacctttaatagaagcatctgtaaaagggtctatttgttctgctcctgagacaagttggtggtgtgttaaactaatgaatcattacagttcccatatatgcagttatcattacatgagccttttttatttctttctgaggttttattttgctttgctttttttttttttttttttttttttttgagagtttcgctttgttgcccaggctggagtgcagtggcaccatgtcagctcactgcaacctctgcctcccaggttcaagcaattctagtgccctagcctcctgagtaactgggattacaggcacccaccaccatgctcggctgattttttgcatttttgtagagacagggtatcaccatgttgcccaggctgatctcgaactactgatctcaggtaatccacctgtctcagtctcccaaagtgctaggattacagacatgagccactgcactggtcttgctttgcctttttaaggcatcacctttagggacttgcctttgttcttgatggttctccagggtcacttgtttgagactttagtaacaagttgctgataccttaggtaatgatacttacaattacctaagtcccagatgaacgtgaagtctgcccacttccaggtcatgggatcttaagttcttatgacccataaaagacttagactagcttcttgacacctaccagctcatgggtgagtagctcccatcctcccaaactagaagcaattcatttcattacaaacccaccaaaaagcacaattctgtccaccaagagataacggctgttagtaccctgaaatatatcctgttaaactttttctaatacatatgagtatgtgaatatcatataactaaagtgatcataaaatacttattttagattgtaggtttttttacacaatacgtgtctcagaagtcttcctaggttaatgcatacactcctacagtggcagctttaatggctgtgtagtattccattgttatcttgaagattttaaaacatcttttttgttggatatgtggctgatttccatttttttactataaggagcaatctttaagtgaaccttcttgtacatggatgtttgtgaacatccaaaatctaagacctggaattgcagggtgaaagttacactgatctctgcgacttttgttgtataccctacaggtgtttagcataatggggaggggcagttgtctggggctctcatttggaggaaacttactgagcatgaattggggatacgaagatgataagatgatctcactcccttgtgtcaggggctcatggtctagggcagcagtcttcaacctttttggtgcagggactggtttcatggaagacaatttttccatggacccggttgtggtgtggtttcaggatgaaactttccacctcagatcattaggcattagattctcagaaggagggcatagcctagatctctcaatgtgcagttcacaatagggtttgtgctcctatgagaatctcatgccgccggtgatctgacggtaggcagagctcaggcggtaatgcttgcttgcccgccgctcacctcctgctgtgcaccccagttcctaacaggccatggacaggcaccggtccatggcctgggggttgggggccatacactggcagctgggcaggaggcagcaggctcaggacatgaggaaactgaccctaggagggaggaggttggtctccagtttcaggaggtagatgtcaactgcctgaaattctctggagacaatacccctggctcccctctccacacatcagccctctgtctgaatgatataacatgattcccttgactaaaagcacagcccttgctgtatctgaggtgagccacaaaacctcttgcacttcagtctccacccctgttagttgtggagaataatacctgtagcttgctctgcttcacagccatgagatgcaaggcacataatggatggaagagtgctcggccactgtgaagctctgtgtaaatgttatatacacagtactcccaatgccgtcctcagagcgtgcacgagggcgtctgatgaataccagctctcagaagatgttaaagaggatgctggtctggacgtagtggctcacgcctgtaatcccagcactttgggaggccaaggtgtgtggatcacctgaggtctggagttctgagaccagactggccaatgtggtgaaactccatctctactaaaaatacaaaaattagctggacatgatggcgggtgcctataatcccagctacgtgggaggctgaggcaggagaatcacttgaacccgggaggcggagattgcagtgagccgagatcacgctactgcactccagcctgggcaacggagcaagactccgtctcaaaaaaaaaaaagtggatgccggtcctgaaatgagacctcccttctgaaccggagtgtggacagcccaggaacccaccgccgcagcttaaaatcctcagctgaacatcactgggggagcacatgggctctgcttgcttatggcctgggttcaaatcccaggcctgccatttccagctctgtaacctcagacaagtgactcaaccccctgtaccgcattttccacatctgtgacatctgtgacttggtgtggtcaatgctcaatacatgtaagcttttattattgttgttgttgtttacaactttttgttgttgttgttttaaagacagggtcttgccctgttacccaggctggaatgtagcggcatgatcagggctcgctgtagccttgacttcccagcctcaagcaattgtccttcctcagccccacaagtacctaggactacaggcgtgcaccaccatgcccagctaattttttttttttttattttagtagggatgaggtcttgccgtgttgcccaggctggtcttgaactcccgggctcaaatgatcctcccactttggtctcccagggtgttaggattacaggtgtgagccactgtgcctggccatatttgcagcttgttaatacttacaaggaaactgttagaacagaaaaagaatcattccctcagccatttaaaagcatcctaaaatcaagttcttgttttaagatagttttcattcattgttctggtacttcctaaatagtttcttcccagtaaaagtgcccccactttggtggtttaattataggccatgaggatttgctttttccgtgtaaggttggaagaaaaagttggtttgctgctataggaaatgagtagaagctctgttgccctcgacagccttgtggagttgtcctggaagcctatgtccagagctgtctcccaggtcatcctattgctgcactatggccgactcccatgcagagagggtccttttataaaaacctaaacataaccatgttgagagagcagtcatccctgccgaacctttgctgaagccagttgcctttgctcttagatgatctttgtgcatccaggggttctagaacgttagacccaagagtgtctggtcctagctttgggggtttcttggcctaggatgcaatattttaatggataggatcaacatcagagtaaattttaatttttctaaataaagacattattaaaagttaccagctgagctctgtggttcatgcctgtaattccagtactttgagaggccgaggcaggcagatcacctgaggtcaggagtttgagaccagcctggttaacatggcaaaaccccgtctctactacaaatacaaaaattagccgggcatggtgctacatgcctgtagtcccagctacttgggaggctgaggcaggagaatcgcttgaacccaagaggtagaggttgccatgagccaagattgcaccactgcactccagtctgggtgatccgtctcaaaaaaaaaaaaaaaaaagttaccattggccaaatcaccattttatcaaagaaaagtttatttttacacccaccctcctcaaaaaatagaaaaagaaaggaagcaaagacataagcctggtacatttccaaagactatataaattaatttcatgtaaaacttcctcctttgttcttgtttttcgccggtgcgtccaaggaatcacagacttcatgtacacaaagaaaaggagataagatgacttggtctgagtggcgtggtagatcacactcaggcaagactggagcatgaacggttctcctgaaaattccttctaggctgctagtcagtgagttgtttaaactgactccaatccttttgttgtgcagatgcaaactgtgatgcagttgaattatgtgatttgttttctaaattgttcataaccaaaaaacatcgattcatttttatttatttattttttattttttgagacaaagtctcgctctgtcgcccaggctggagtgcagtggcgcaatctcggctcactgcaacttccatctcctgggttcaagcgattctcctgcctcagcctcccgagtagctgggattacaggcatgtgccaccacactcagataattttgtatttttagtagagacagggtttcaccacattggtcaggctggtctcgaactcccgacctcatgatccacccgcctcagcctaccaaagtgctgggattataggcatgagccaccgtgcccggcccaattcattttattaaataaagaaacatttatttagagtttaaatgtctgatcttgaggttgcgtcagggtgaagactaagctgctgtaataaagacatatgaaattagtggctaaggaaagagagaagtcggtgtttcctcccatgtagcagtccttggtggggtggcatggctccatgtggtcattcagggacctgagctgcttccatcctgatgctctgttgtttttcctgagtgctttcctggtttgcttggtggaagctggattgctactgtgtgtgcatggaagtggaggaagaggatgaggcaccaaagctctgtgtcttgaggccaagacccataagcatcacagcactctgtgcacagcccactagcccaagcccagtaaagcagttgcatataactgcaagagaggcaggcaaatggagtccccagctggaggccacatgcacagctgaaacttgggggtggagggaggaggggttcctatcactaaaagaagaggagaatgactacttggggacaaagagcagattctttgtcatggacatgaagatgtttttaatccattctttctgtctagcagaatgggaaaaggaaacccctgcttctagaactgttccaatgttctgcccatcttgccagactctccctatatttggagggcaaagattcaggcagacatctcttggtgtaaaagtaaatttatctggctgggtgtgggggcccacgcctgtaatcccagcactttgggaggccgaggcagatggatcacctgaggtcaggagttcatgaccagcctggccaacatggaaaaaccccgtctctactaaaaatacaaaaaattagccaggcatggtggcggctgcctgtaatcccagctgctcgggaggctgaggtaggagaatcacttgaacctgggaagcagaggttgcagtgagctgagatcgcaccattgcactccagcctaggcaacaagaatgaaactccgtctcagaaaaaaagagtaaatctatcccacattggtggtttccctgaaggtctggtacaatggaggattccaagcctttctctttttcccaaccatggctcttccactggagtatttcacagggagatccaaggacactgtgggaagaagatcttggatccccaaagcccaaatctgatcgcgttgcccagtgttagtgatgacagctcttcctggcatatgttggttgggtggggtggtctaaggactgcaggatgttttagagcctaaatttaccaactttcggcccctgcttgatgatgctcaacagaacgaacaaagctgtagattacttgtccagatggcctctttatttttagattggtgatcagtttccagcgtctctttatttcttcaccatgatggtctgaatgatgacttcaatgaagggcaaactcaggcactctaggaaagatacattactcagcgtgttattgcctgacacgttctgggaaatcacaggacaatcatcttcatgtgcaacatgtgggtttttttttaatttatttgtttgtttttggcacatttacagttaaattccccagatccaagaaaatgacttcccagttcctggggaaaataaattacgaatggagatggaacccagctcctctctaccacacggggcccagaacatcgtgttctctgctgcaaaactgcatagatcaggttggccacagaactgcaggtgcctcactgatccacattcctcagttaaggaccaagatagaaacctttatatatactctcactgagggaattaattaatgtctgtgttagtttcctagggctgccataacaaattgccacatttcggtggctgaaaacaatagacatgtattctctcacagttcagggaaccagaagtccaaaatcaagagactggcagaaaacaaggtggttccttccatcccatgactccctcctagtttctgctggtgttcagcagtctttgccagtctttgctttgacgatgcattattctaatgtctgcccctgtcttcacatgaccctcttccctgttcctccaattttcaaatctccttcttcttttttaaaaaattatagataagatctcactctgttgcccaggctggagtatggtggtgtgatcttagctcgctgtatcctcaaactcctgggctcaagcaagcctttcaccttggccccccaaaatgctaggattacaggtgtgagccactgcacctggccttccctcacttttctttcgcaagtacatcagtcgttgaatttagggcccatcctaaattctagatcaccttatctcaagatcctcaacttaggtatatttgcaaaaactctattttattttcttttccttcttttttttttttttttgagacagtcttgctctgtcacccaggctggagtgcagtggcgcaatctcggctcactgcaagctccgcctcccaggttcacgctattctcctgcctcagcctcccaagtagctgggactacaggtgcccgccatcaagcccagccaattttttttgtatctttggtagagacagggtttcaccatgttagctaggatggtttcaatctcctgacctcgtgatccgcccgcctcggcctcctggattataggcgtgagccaccacgccctgccaaatttatttattttcaaataaagtcacattcacagataccagggattaggacttgggcatgtcttttcaagggatgcaattccacccactacaatatcatagcaaacgtgcatcaaaaaggttaaatctattaccaccgatcccatgttgtgttgactgcaaaggcgtacggcatcaagccttggaaatgtaacaggcccatttttcgcagttggaaaatcagaagtgctagaaagagagctggctcatcctgtagggatgggtggtgggtcgcctcaggccctcctttcattcccagggaccccgtttgcacagctgcgtgtggagccggctagcacgttgtcagcaacacttctttccgtgtgcttgctcccttagtctctgtaactagcaggtggttgtggtgcctgtcattcatctcccagggctggcttgataaacgttattatacttcttgatgggtaccttctggcgtatttaccgctttgtaactttgctgtttattgtggttccttggagcccaataaaagcaagataagaaaaagcaagcaagaacagggcaggaaaagtcagaactgtaatttagtcatgtaaggttcaattggatgcgtttttcctttgcccccctgccttcaccgctgggctgttcagagccaggctctgctccacttcatccccatcccagtgacattacaccctccacatccccatcctttctggagtgatcagtatcttcttcagtgcatgatggaaaggggaagattttagttcatatcagatgttcagaatctttgtaggaaattgaaaaaatattaaacctttttttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgtatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaagtttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtagggaagggatccagtttcagctttctacatatggctagccagttttcccagcaccatttattaaatagggaatcctttccccattgcttgtttttctcaggtttgtcaaagatcagatagttgtagatacgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggctttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattttggtatgtggtgtctttgttctcgttggtttcaaagaacatctttatttctgtcttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaagtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaacctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagtggctggtaccggttgttcctttccaggtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggccctcactctcttctggcttgtagggtttctgccgagagatccactgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcattcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacccactgacctgcgcccactgtctggcactccctagtgagatgaacccggtacctcagatggaaatgcagaaatcacccgtcttctgcgtcgctcacgctgggagctgtagaccggagctgttcctattcggccatcttggctcctcctccaaaaatattaaacttaaaacaatttcttcttttaaaatatgtattatgagggatgttgtagtatagccactgtagaatgagagaaaatattatacagatctgaacatgtagcaggcgtggagcgctcaggtttcacgggtggccttggaggttctggctctgatgctacagagacagccaagtataaaggggtccctgagaacctccaacctggcctgtgcactgggaggagtgtgcgctgtgggggagccatggaattttgtgctgtctgcagtgggaaggagcttggcctctcctcttccggggcggtaaccggggattcagtctgtgaggcgggaagcccactaggaggactctcactttgctgagtctctctttcccttctttcttcttcacccaataaaccctgtccttctcacccttcaaagtgtctgtgagcctaatctttcatggtcatgtgacaagagcccggcttttagctgaactaaagagaaagccttacagcactaccatccagcgtcctcctccttcctgccctggattctttagaaatgactggaaactctctccagaaggtgttttctgtgatggcataaatggatcactggaggcccagggccagtgctctctctctgctgtgcttccttggaattctggcccccagccctttcctgaacgcgtcatctccttgagggtaaaaggagccagagaacactatcatcgcagatgcttcatgtgaattgttccatttttaagacaaaggacgacagttggccttaaaaataaatctcatttgtgtttcttttggttgtggagaagtaaagaattttcaaaacgggtcctttttatatacaaacgtttgtctaaatagagcatctttagatcttaaaatgaacagcaaagcgagcactcggagatgcttctgttgtgggctttggtagacagagagagaggtgaaggtcccttctatgcctttttctctttcaaatagttgtttttattgtggtgaaatatccatagcataaaatttaccacttttaactgtggaatgtacagtgtagtcaggtttagcaccttcataatgtcatgtgctcatcaccaccatccatctccagagcttccttgtcctccctgaatgaagctctgtactcatgaaacaccagctcctcattttccctcccctccagcccctggtaaccaccattctaccttctgtctctatgaatctgactgctccagacacctcacataagcagaatcattcagtatttgtcattttgtgactggcttattatttcacttagtatgaagtcctcagggttcattcatgtagtcacatgtgtcagaattttattcagttttaagactgaatagtatctcgctgtatggatataccgccctttgtcgattcactcatcaatggacacttgagttgtttgcaccttcccccgcttcccactgaagccttcctctccatcagttcccggctgtcgctccctgcctctccttggtgatcgcctctggaacagaattttgctgttaggagccactcctgtcaacaggatttcccagagtgtgttaaaagaaaaagcaaatggataatagctctaaataagaacttgctttgggtaagctttggtgacatctgcaagaaaaaaaaaagtggcctgggaaacagggagggttcctggcataataaacattttcttaaacctttatgcaaatcccagattagtagatattgcgggagtcagtttctaaaagaaaacttgatttccgaaggccatgcacagttattctgtttctccatgtgttttgtttgtaagaggaaaacagtggaatagagaatgtttgccacagccaaggttttctctagtccctttggtaggtggaaaccaagtgctggatgaaattgtgtctggatgctgaataaagacatggtttgctgaattcattttggcagcatacactgaggacaaagcaccagtgtacaaccacactacttaattaggattctctgaagacatgccaatagcatctgctcagaagtagtgctgcaaaaagattagtcttgattttgagtatgacttgatttagccagatgcataggcccacttctttaaaagaaagtccaaatttatcttctgtgttctttgagggagtgacaacctagaatcagcttgaaacataaaatgtgcaaagtaaaatttttacaattatgattgcacttctaggatttagtaaacctttaaccaccaagagactggacttgggggtgcgttgcctgtgataggatgccaagttgtttcttggcagaaacatggagattgttaaaccaggatggtaaagagtgactttgtctgtgtcagctactctgaagctatccctgagtcccctggaagacataagcatcccttcctccatgaccccaaggctccttgtgaataataccacattagagcacttgtcacgtcatggtggaattttcatgtgtacatggggtttcatgtacacacgtgtgtatgtaaagggcacagactgcattgttttattccaagcatggggccaatgtattgcagtaacaaggacaaccttttattagatggctactgatcacagtgagaaaggcattagcaccatttcacaactgaggaccaagtagtttagaattccctctggtcactcaactcataagtggacccatgagacctgtgggactccaaagctggtgcttttctcattagaacatgatttccatgttggtgggaatacaccatatgtctcataaaagagttaattatcaaaatcacaatgacattcttcacactcactgggatggccatgatcaaaaaagataatagtaagtgttgatgaggatgtggaaaaattgaaaaccttgtaacttctggaatgtacattggtacagctcctttggaagagtatttggcagtcactcaaaaagttaaagttgccataagacccaacaattcctcttctaggtatataccgaagagaatgaaaacatatgttcttacaaaaattaatacaagaagggtcatagcagcatcattcatagtagccaaatgtccatcagctgatgaatggctaagtaagtgtgatatattcgtgcagttgaacatgattaggcaacaaaaaggaatgaaatacaacacatgctgcaacatagatggacctcagagacatcctgctccgtaaaagaagccagacgcagaaagtcacatattgtatgattccatttatgtgaaacatccagaataagcaaatctgtatagacagaaagtaggttagtggttacctagggctggggatggggagcatttgaaggggattgaggaggaactgctaatgactttgaggttcctttttgagatgacaaattgtgataatgggagcacactgtattaaaaaccatcgaactgtatactttaagtagatgaattgtctggtatgtgaattgtatctcaaagctgtatataaaaaataattaatgaggccagatgtggctgctcatgcctgtaatcccagcactttgggaggctgaggtgggcggatcacgaggtcaggagatccagaccatcctggccaacatggtgaaaccccgtctttactaaaaatacaaaaattagctgggtgtggtggcacgtgcctgtaatcccagctactcgggaggctgaggcaggagaatcgcttgaacccgtgaagcagagattgcatgcagtgagctaaaattgcaccactgcacttcagtctggtaacagagtgagactccgtctcaaaaaaaataataaaatgaagttaaaccaaagaaataccaggagacagtaacattaaagaagtctgaaagagctcatacgaatgtataaggaccccagtagataaactggcaaaataattctaaaagagagcttacagtagagggaatataattaccacacagacaaatggaaaacattctggttctttaacaaagatattaaaattagaaaaataaagtactgtaatatttctcacatatttaattagcaaagcattttaaaaatgattatcaattgctgggaaagagagcaatatttttctatgtttcaggttatatcgtaaattgatactactcttagaaatcagtggccatatatatcaagagttgtaaaacatttgtggctattctatttttagaaatctcttctaaaacatacaaaaatataaaaatgaaagactaatgatgcaaattatgactcatttatgtggtcatttaaaaattagaaaaataaaaattcagttactaagattttaaagttatatgtactgtaagtataacttacagtaaaaaacaggcaagtttaaaattactgaaaggaaataattaaaatgacccagcgatggagttgtggtggagttctgggaaattttttcatttcttattttgtaatgcaattacttttaagttttaaaacatttttataaatagaccttatatttctaagagttatgcttcctagaatattaagtttttgcagattatttcaatcggtaaaaatcaaaagatgccggctctcttggctgacctttaaattaaaatactaatgaagcatttattaccataagagaaaaatatgcttaaaacacctttcattaattgtacttttgccaaaccactctagagttgaatgattctctttctttcccaatttacatagttctgtgggaaaaaatcggacatacagtgagttaagtggagaattgttgcaagcaagccatgaactgccttttaaaagcttgtccttttgaggggaagagacatggattctccacttcatcccctcagttaaacaaaaatctgagccttgcatatttaaagataaaaatatacttaatttttaaagttattgttttggtccagtttagaaaataccacctcattttctcctcccttatgtcttgatattgatcccaaagaatgtgcgtcaaactaagaaagttaattttcatgtagcaacatctggttccttagccaattcagggaactcttgagtgcttatgctcagagcttttgctgctgtttctagattccaccctctgttagcttctcacaagcagtccggtatttggtagagtgtggggggccgggggctcatgaagtcagattccaacgtgcagggtttgtttgagatgcctgtaggatcaaccaggtttcacctctggatgtatgtttaattcagtggacgttgtcattttgatggcacatacccttcagtaaaaagaggttaaaagtattctaaaatgaggtggtggattatctgtttgggtagctacatggtctctgaagtctcttccattttaagataaaattgccaaagacagtttttacaagtttggaactttctgagtgggtgatacgcattagggttttggtggtgctgattattgcatccagaggttggccctgacttctgtcgtctgctggtcttggaatacattgaagcacaccgattggagcacaccgactgaagcacaccgattggagcacaccgattggagcacactgactgaagcacactgattggagcacaccgattggagcacaccaattggcttttgcttttggagcttggttattgtgcagtgttcccacttacctaatcatcactttgttggtggtggagtggagggcctcactctggttccaagcaagtcattagaatgatctacaatttgcagttctaaaatcaggaaaacttggggtttctccaaagcctgcattaaacagaactttttctttcttgaaggtccagatccatacttaaattttacttaaattttaatgagtaatattttcccatcagtggcctaacgcactataaattatgtatgctgcacattaaattcatttttattttttcacaaactggacttaatggcatttgttgttttgtataccctatacgatagaaatttgttgctgaaaaggaattcaggggtcctccagatcactggtttccaaacctgactctttaggaagaaaacaaacaaaaatcctccagtttcgttatggacgtgatgaatgagacacccacggagtatggcccaggaatctgttctcataaaggtctccaggaaggttgggaaggaggagggaagagcgtagagctattctccctgaaaagaaataggccaagagttgattgttgtgttagctggtaatgggtacttagggatccattattctctctgctctttgcatgtatttgaaattttccataatgaaaagacttttaaaaaagattaaataacagcttcccaggtgatcctgaaaatcagccaggtttgggcagcacaatcaatccgcctctcccccttaacaggtgagaacaggaaggcgaacgaggccatgcagtttgcgtgaatgaagaactcatataggatctagaactcctgtttctgccccataggcctaagcccttaactcctcatggcctcctcagactaatcattttgctgaccttcttagcattttaaaagagaattaataaatctgacttgtatgattcacttacttttttttaaacacagaggagtgttgagtgtttttgagatgtttttctttcttcacacatttttctaagatccttttaaacccattccattggacttcaaggtagctattggcttttcaaacataggttacggggctactactttgccgctagttagtgtgtgaggccactggtaaatgaatgaatgaatgagcagtaaaggtgctgaaaagtgtaatgcgtgtctatatgaagcagtgtctattgagcaaaccggagagaccagctccatcctggaaaattaaaacaatggtactgtgactttgcctattgccaatcatcgatcagtcctgtcggtctgacttaaccttctaaagctctttaccacagtgtatagataagttgcctgtcatgtaaatatatcttattgattttgtcaggcagctggccagttttcttaaaaatgtgtcaaattgtctgaatgatttgaccagaaaccccgagagtcaacgtgaggaggaaagaaagaggaagggaacggggaaaaaaagggaaggaaaaagacaaataccacctaattgagactaaaggaatgatcactggggctaccatggcttttgtttggttttggcaaggctttattttattttttttttactgtcagtgaaaacaagaatttgtattgcaggaaaaacaaactaacaagtgttttttcctactgtactctcaacacaaagtgcttctggtcaccaaaatgtggagagatgttgccccccacccacacacaaagcaactctccagcagacaccaaccgggtgtcctatagttcagtgtaattctgagattatctacctggagatagcatcaggtccgacaagataagggttcagtcccacaacactgccccccaccatccctgcttcagacactactcataagtacaggttacccatagctgatgtccaatttagctacaaattgacccccttttagggttctcttgtttgctaggacagctcgcagaactcaggaatgcacgttacttacatttaccagtttattatcaaggatattacaaaggatacaaatgaacagccaggtggaggagatgcacagggcaagggatgtgaggaggggcccagagcttccatggcctccccggacccaccatcaacagagctttctgaaccctgaagtccagagacttttatggaggccttctcacacaggcatgactgatgattcactccatctccagaccctcaccccttcctggagactggggagcagtagagctaaaagtttcaagcttctagtcatggcttggtctttccagtgaccagcctgtatccaggaacccacccagagtcaccccatgataacaaaagacactcccatcacccaggaaattccaagggattagctctgtttcaggatgttggaaatgagtgcttgagtcgcaaaggaaataacactcgaacagaaaatatctcagcaaagcaaatttacttctgcagaagggtgcttcctgtttcagtcacgatcgcaagagcacaccgaacaagggaaggaaggggtttttaaccctaactcagttcctgtctctgtgtccttcccctattgattggggttggactgcacaacctaagatctaagctgacccgactggctactgtttgaaattgcggagggctagttgggtgggaaaggagagactgtccattacagtacaaggcatgtcagggtgcagcaagagcaggaagggtggtttaaatactagaaacgagagtacaaggaagttgggcttcagaacaaagaacaaggacattacaagttaaaccctttgaagaggaattttatcatccctgacaaggaactggggtcaaagaccaaatattagaacaaaaaagtctcctaacatccctgttgctcaggaattacaaagattttagaatctctgggccacgaactgggggaggagtccaagtgaatatttcttattatatcccagtattgctttatttttgttatagatttatcaagatacaattcatgtacccataagcttcacccatttaaagtgtatagctcagtgattttttgtgtatgcctagagttgtacaaatgctaccataatctaattttaggatatattcatcacccctaaaagaaactctatacttactagtagtcatctcccttttccccattatcccgacccttggcaaccactaatctactttttgtctctatggatttgtctattctggacacttcacataaatggaataatacagtaaatggccttttgtaactggcttcttgtattgtgttttcagggttcatccatgttgtagcatgtcatagtgcttcattgttttaatggcctaataatactccattgtatgggtgtaccacattttggttatccatcatcagttgatggacatttaggttgtctctacattttggctattgtgaataattctgccatgaacattacaggtttcatgtggacacatgttttttgttttcttgggtctgtacctaggggtagaattgcagggtcacatgtattaagcattttgaagaactggcagttttctgaagtggttacaccattttatggttcctctagcaatgagttgagggttctgatttctccacatcattgccaacattcatagttacagatcttcttgattctagccatcctcatggatgcaaagtggtacctcattgtggttttgatttgcgtttccctatggctaatgatgttgaacatgtttttatgtgtttattggtcattatatatcttctttggagagcatgtattcaaatccttggtgcatttttataatggatttatttatcttaccattgatgggaaaaacacttgttttattttacacatatctcactttgtgagtaaaaaaaaaaaaaaagattggaggccagattcagtggctcatgcctgtaatcccagcactttgagaggtcacagtaggcagatcacctgaggtcaagagtttgaaaccagcctggtcaacatggtaaaaccctgtctctactaaaaatacaaaaattagctgggcatggtggcaggcgcctgtaatcccagctatttgggaggctgaggcaggagaattgcttgaacccaggagatggaggttgcagtgagccaagaccacaccattgcgctccagcctgggcaacaagagcgaaaatctgtctcaaaaaaaaaaaaaaaaaaaagactggaaaaaataacaaatattttaaacacccaagagacattattaacagtttgattgacttatagttccatgtaacctaattttagggctcattctggtagtggaagaaacctgacattggtaatatataaatagagtgcacacacagaatcctgaatccttttaatgcctattaggatgggtgctaagcctgctgggagaatactgagttagtggagataactgatttacattgagaacgttctgatatttgtgattttctcatactatataaattagagattcatatgtgcaattgagaatatttcactgattctgttggaggtttttttttttttgtctttagctaagttgtatggaaactcaagagataagtacctcatttgtggtattgtgaatttttccaggggaagaaaaccttttttctcttacaaacagttgaagaaaattatcttttctgtttttaaattatcataattgggtttctccatcacagatttgtcaaactatagagtatgtataaagtcatgtttattcatttgatattctcaacataagtattctaaacttgattatgttaattcagaagaatagaacattaagcttagaattaggcaaatatatacaagttgcaattgtgtacagggattgcttatatttccaggataaaatcaaatcttatccccaaatctaattagcagctgttcattggtgtatttgacatacagcagccgacttttctcacctcaataaaccactacatcatcaacagatgcagcggagccttgaccgctaattagagttctctgccagaatcctagagcctgatgttggctctgtgaagagttgagtcaaggacatcccagcagtggtttttggaggaaggaaaattagaggttaaatgcatagccgtctacacaagagagatggttatttttttagatgcacagaagtggatctcagcattataaatacttttattaatcagtgctctttgctactttaaatctgtttccagactccactagtttcctaaagctgctgcagccaattaccaaactcgttttcttaaaacaacggaaatttattccctcacaattctgaggctagaagtccaaaagacacccatcaaggtgtctccaggccatgctttgtgcgaggctctagggaagaatccttccttgcctcttcctggcttctggggcctcccagcaacccctgtgttccccagcttgcagctacatcactccaatctctgcctccgattcacatggccatctcctctctgtgtatctttgtgtgtgtgtccttttccttcttgtaaggacaccagtcattggatttagggcccaccttaatccagtatgacttcatccttttttttttttttttttttttttttgagacagagtcttgctctgtcacccaagctgtagtggcacgatctctgctcactgtaaccttcacctcccagattgaagggattcttgtgcctcagcctccctagtagctaggactacaggtgtgcaccatcacacccagctaatttttgtatttttgtattttcagtagagatggggtttcaccaagatggccaggcttgtcttgaactcctggcttcaagtgatctgtgtgccttggcctccccgagtgctgggattacaggcatgagccaccatgcccagctgacctcatcttaacttaactaaattgcacctgcagagaccctatttccaaataatatcactctctccgattccagctggacgtgaagtggaggggcagggggttgggaggatgggacacagaaacctggccactccatttttgaggtacatttttaatgattgtagattttcatgtatgctacctatcaaacaagataacgacatctcacagatttgggggcgtatgtttgtatatttccggaaggactctaaaaatccagatggaaattgatatttttgaggcatctaccacacgtgaggcagttttgcatcaattatctcctttaattctgtgaagttactttctatttattctggttcctcatataattgcaatttgctgaatttgttggtgagttcttaaaaatgttaccgtttcctacctgttaccatatctgtgtttatctcatgccaaatatataaataactcttcctcagccacttaacagctaaatttgggagagattctgaaactacatgggcctcagtttcctcatctgtaaaagggggccagcaattcatcattaaccttgtgacattgtggtggctggcaaataccgtgtcaaacaggaagtgttccacaagtggcagttcctcgttatgcttttcttaaagctcttttggaggtgtgcacaaattcttattctttttgtgcttactgccaaaaagggtttagggatacatgtgtcgtaccatcccattttccagtagagacattgtaattcatgggcatatcagttaagaattggatgcagctgtatacagtacaaaaattccaaataacagcagactgaatgagaatgtttatttttccctcatgtgaaaggagtagggagggggtgggccagggcttcagagcagttccacagtcatcaggaaccaggcttctgtgtctctgttgtaccatacaagcccagggcttccatgcacagtcccctctgaccccaaatggctgtgtagctccagccctcgcgtttgtgatgcatgctaccaacatgtaaaaggacaaccaggatgcctctcccagctgagtggcctccctctaggcagcttttcaggaagtttccacataacacttccactaatatctcatttgttcagtgaccatgtttagctgcaaagaaggggaaaaatgttttcttctgtttcaggcctcggtgtgcccagctcaaatgagggttctcttatgaaggagggaggggagtggatgtcggggtgggtagccagcattctgtgctgtaatgggattgtattctgtagggctctgaagatagcacttggggattgaggagtctggtctgggaagtgaaccttgtatgtagctctggatctagggttctaaacatcctgctttagaactacagccttgtaagtgatttttgaaacaactcattcataggcagagaactgtctatccttcaagcctgagagaaaatgaataatttacctctccattttgatcacctgccactgtagcattggtccttccaggcctgcgtgtgccctgggagggtgaaacaaagctttgccagaggtgcctccactgtaaagcaaacccacagatagtaactgttgaaaccagcacatccctgtgcagtgaaaagggcattccgtcggcagtcaccaccttgggcctggtcagggtttcagtgaaatccctttccttatgttctgctggcattgaacataagggaagggatttcactgaaatgttgaatgttcaaatccaagcagcttcaaggaatccccccagctcccttgctgtcaggacaggaggtggatctctgggacctcttgaaactgcttggaattggaacattcattgcttttctctagacccagaactaaggcagctttgctcaatgccttgctcagccatttcgccaagtgaggttttatgcaatgttactcgtcactactctgaatcccagtttcagattgcaggacaaacagacgcctttttaatcattgatgccccttcctaagggcccaatcagaaagtctgactgggccctagcaaatcattccttgccaaatgtacatgaatgccagttctaggaagaatgaaatagtaaaaatttgtagaaatcaacatgtcatgtggaattagcttagcacattccagtggctctaggggtccttgtcccccactctcgccttataataaatatagaaagaacattgtccattcaaccctaagacttggattctggctgtgccatgacacctggtagctgaatgtctttgagctcatctttcctcacgtagatgatgagtgaggtgcaatggtgaaggccctctgtggctttgtgatttgtttacttgattatttattgattccattcatgttgcagatgtctgtcgagtatctgctgtgcccaggcaccgtgctaggcactgggggcacacagagtgagtaaggcacgagggcaagttccatccatctctaagagccatgcagactgaggttggagctgcgtgcacagggttatctgcccccagctaccagagcccatttccaagatggtggaaaccacttagtggagtctacactgcagtgagacagatttgctctcagccattgtcacactattaattagcttccactgtgttaagtgccataagcctttgttccagaggaatccaagtgggagaaaaagagcagagtggctggaaggttaggtggtaaggaggcacagaggagggagagggggctggggccagggagctgctgtcatgggcaatgggaagctagcaggggtggggccgtggtcagtttcttggtgggagcaggagctccagctttcctgtggctcagctgaaggttgggtacgaacgggacatagggctgaacagttcacattgttaaaaataaataagttcctcgtttataattctgattaacacagaacatttataaaatacagcctctggaaaagtgacacaaaatgcattacaatatgtcattctcaatcttttaataatgaaaaatgtgagacgcccaagatcaaaggaggcacatgttcagggaactgtttcatctcagagcttgatggggacaggatgatggactgggttttaaaaatggactacctggtcagtttcatgtcttttgacctacctcggtatgggctgttttcctcatgtttataatctagtttaggagctttttcccatcctggctcgttggctggtttgaagcctcactttattcttcagaagggccttggtctgtccaccaccagatgtctcatgtgttatctgacacataccagcttcgtggatatcaaagggggaggattacagggccattgagatcaaaacagagcaaatttgatgatgaaccaggggaaacaggccaagatgtgtccctaatgggcttgttccatccgtttgagtaaattatgcatgggctggcttggagctgccagcagaagcaggtagatctgcctccacctgccaaacccagatccaaatatggaagaaaccacaaggcagccactgactgtggccacaaatgggcacatagtttaccttcactttttgaaaaccatattaaaattgagtcagcactccatagaactgcttgatgaccaccaggccttcctttataaagttctcatgaagaacattaacttttgggaaatgaagcacttatatgactatctagtagagtaggaactacgaacttcttatgttacaatgagagagccattcttatttttttgaaccaagattgagagttttgtcaggccaagaggcagcaggctaatttctcaacctttcaggtgctagaaacacattgtgtcatgaaaatttagttgccccaacgtggtgccctgttgatttttaagtcaagggcaacttcattcttttagtacactgttggaagaatcttgtcctggaggtgttaagattgccttcattaaacatagtcattcaggccgaatgcagtggctcacacctgtaatcccaacactttcggaggccgaggtgggtggatcacctgaggtcaggagttcgagaccagcctgaccaacatggcaaaaccccgtctctactaaaaatacaaaaattagctgggtacggtggtgggcgcctgtaattccagctgctggggaggctgaggtgggagaattgcttgaacccaggaggcagaggttgcagtgagctgagatcgtgccattgcactccagcctggccaatgagtgaaaccctatcgcaaaaaaaaaaaaaaaagaacatagtcattcatttcttcgttcactctcatttttttctaagtgtatacatacagtctttactctgtctatagtctctacacaaagtataagtatttcatttattagaagaaaacattaactgttttggggcccattataatgaatttttaaaacatcacaattttagaattatgattttaaaaaactttactaccaggtacagttttgagaaagctctgggacattgaatagctctgtggctcccaaagataagtcgtagacatcacaataacaagggattatagtatttgagaccttactcatgaattttaataaaaggctgtgtgactcaagcgatttcgtattctgggaaatgttcaaattctgtactacatgcctacattctgcagggttaggctgggaacatagacctttgctgagaatctgaagagaattgctaaggcaactgtgtcccatatcctcaggtataaatcttccctccctccctcccttccttccttccatttgctcatttattcacctacccattgattatcataattctatcaacttttagaatcttgagactttccccaggaaatagatgaggagggggaacccatataagtaaagttgatctcattgggcataattagctcaaatattatatactcttccctcaagaactgagaatgtagggctttatagattttaaaaaatctcatagtcttggcatttttttttctggcaatccaagtcagctggagaagctagggtcgggaaactagttttgcaaactggcagaagtagtggttctttactaagatggctcaattgagtctctctcataaactgttagattatgggcgtcagagctgtttccaaaaggaaacaaattggagtccctctcctcactctctttcgtatcatctaggtaaattgtttaaaattggtctgtgactctggcaggtgtcaaccgctccaagtgactgtaggtttggggttgccctaaagccaaatgcgtagatgatgaaagcattaagaacttctaaacatgagagcaacagctgacgccatctacacggggctgttgggttttttcctctggaaggaagtgacagttggatgcctggcactttcacatggcctattttccccatgggaagttttataaaaatatccattaaggctggtttgtatatgcaacagaagggcataatatgcccctcaaatgaatatcattatctccatccatgaactaaaagcgtttgagggatggcaatgctgtgcaaattccacaaagccacagcttttggcagagctcaactatgtggaaaccgatctcttctctctccccgtctcagtgtctcaaggaaaaacctcattaagcagacaccttaagaagtgtattatcttccctttaaacctccaaaagggagggaagaaaaggagggatgtgagagtgaagctgcctgtgtcatgtccagaagactatctggaagtcttttttacctttctttgctttcttaatcacctcgttgaggttataaagtcacgaaggagactagatttggtagttgttactttaaaacagcccaaaacatttataaaaacaggtttttggggggtaatgaaaaaaaatttaagtcagccacaccgtcacatgttcccttaaatagccacagtggggtcattggtaacatagacccataagcacatgctccatacagaatgggtcatgcagctttcaaagagcagcccttcctcaaggagctgtgttacgtgaatactcatcaaagaaattatccatgccgcttctttctaactcagtgaaaacttgatgaaatagataaaatccacaaagctgtttagcccttcattgaacagcctattttagctggtgcctattttcctgagattatgaaaaatccagttccctctttacaatagtcaccaaaaacctccatttccacaaagggagtaggattgcctctggtcagtaaatggcgattccacctctgggtaggcagaagaaaaggggaagcaataagtgggagggaagcacctataacaggaaaatgcaacttttctagaagtgtctaggagacttgtgttgagatctgactggccagagctatggcctgtggctaccgatagctgcaggagaatcggggaaatgtattttgttagctaaacatgtcatttcaacaaagctcagaaatctattcataaggggaaaaaaaatgaatggcttttggtcagaggcctagcagtgtctgctactggaagggaattcaggcccaggaagtgaaaaccgagtgattctatctaagaagtcaaagtgaacacagtgaatagtttgcatcccatacagatagctcactatcggcagtccacagaaagtgtacattgactgtatctggagggccaaaatttcagccaaacatcttgcctaattattctgtgcatgttttttaaggggaaataaatctgtcttgcagctaacaaaatagccttgagtcttagagtacattttatcatggagcatctgaaaataactcagctctgaagttccatgatgaagttgtcccctggcaatggggtaaaaataagtctttatccattcatcagcacaagtttagctaggctctttcaatgacttagttctagcttatgcatctgctcctaaaacaatattaactcctaatagtctccctaaagaggaactcaaagttctgtagagaagactctggttgactttgatgttcatcaagatgagaggctcttttttgttctcaagattctggattaaatgagctgtcccagtcaatgaaaacttggggcttcaggaacctaacagagccaacccaacagaaaggctaggtgtttgattttcattaaatggcatttacttgtcaacactgtaattcttggaattcaagtgtgtctttaaatatttccactagaagctaatcaaaatcatgattttatccattgaagcatttaaaaatgtgattatttcttctccaaggatctagaaaccctatttcctcgtattctttgtgtttaaaaacatactttgctttaagtttactattgtgaaacctgttataatcaattcaatcataccacccgttttgaccacttagtgttcagaggattatttgctccatttaggaattagaaatcttcatatcttcattagaaccagatttctttgcgaagtctgtggttcttgtagtgggagttaagaggaagcattaaaaatatctgcttcgttcatggagtagatgcacttttcaggacagatccctgttactgatctggtgttttctttgaaaatgtcacagaaacctccaagaatggcaagcaaaagtaagaaatagtacctcctctaggtgcatacgtcccaggtgtgatcagaaagagctcatttgaagcaatgtatttgcatatgtcaaaataatctgatcctctaatgcatttcctctgttaagccatagcaggattttgcagctaaattcagagagtcagcaagaagaaaagggtctttaaaaataagttgaggctggttgcagtggctcctacctctaatcccagcaatttgggcgtccacggcgggaggattgcttgaggccaggagttcaggatcagcccgggcaacatagtgaaactccatccatttaaaaacaacaacaacaaacagctagccatggcagtagctcttcaggaagctgaggcaggaggattgcttgagcccaggagttcaaggttatagagagttgtaatcgtaccactgcacttcagcctgggtgccagagagagaccttgtctgtcaaagaaaaataaaataggttgactaacagtcataataaccagcagccttcctgcagactcttcataaatactgagttgtttataattaattgtttgcaagcaatgaccttctctttctgtaacctgagaaatgagattaacaataacagaggaaagccaattacaaacagatacgtttaccatcaaaattttagcccaacagggcagatcagaagccccagatggctcacttcttttcatctgtgcttaagaatgcagtgaccatataacaaagaatttaaaaattaattgtaatgagagaattgacccatggtggttaccttttcttaggaccatggttttcattttaatgtggaaaactgacatcccctggaaaagtagatattagagtaacacttgttgggtaattaactcaataaacaagggaactgacttgtattagtccattttcacgctgctgataaagacatacccaagactgggaagaaaagtaggtctaatggactcacagttccatgtggctggggaggcctcacaatcatggcggaaggtgaaaggcacttcttaacacggtggtggcacgagagatgagaaagaatcaaaagtggaaaccccttataaaaccatcagatcttgtgagacttactactacaagaacagtacgggggaaccgcccccatgattcaatcatctaccaccaggtccctcccacgacatgtgggaattatgggagtacaattcaagatgagatttgggtggggacacagagccaaaccatatcatgactcttcccaggaaaccgttgatttgtgagttgaatataggctctgctgcttatttagttttttctcccatttcctgtaggacagacattaggacagtttttcttctctatcttccactggtcatttctttggtaaaagaagttgaattgctccttctttgtaccagaatgcctgtgttatcacttgtagcaatagaaattcacaaatgtaatcagatgaaaggtctagaattttcctcagtggataacaatgtaagtatcacttgattattccatccttaattactgacctcagccagatttttttttgcctgaacttgatgtaggcttttaaagagacaggtacacatcagcgggcaatagatttgtttagagaccttggaagcctgatttgcaaagtaacttcatgtaatggtgtgtcacccacgaaggaatgggtggaaagctgcagcttgggttaaatgtcaccattgtcattatcttcagcaaacatgtattgagctcccaggagatatgcaacgtggtctctgatctccaagagtgtgccgtgccttgggagggaatgcaggattcattcgtttgacagatgttcacaaagaacctgcttgatgcagtggccctcttttgggtgctggaagctcaaccatgagcaaggcagatcaggtccctgctacgtgtagaatttacattttaaagaaaaagttgaatttaaacaaaaatggaataagaaagataaagctaaataagaaataagataacagaacaaaagctctggagggcccctttaaccgagagagtcaaggaaaacctggaggagtaggaggcaggcacagttgagttgagccctgaatgacaagtgaggcatcctcctgaagagctggggtgcctggctccaggctgatggacagcaagtgcaaaggccctgaggcaaggaaatgtttaaaacctatgctgagaagaggtgaagagaggggagagagggactttcctgaccagggcagggagtagggggctgtacccaaagacactgaggaaaacttgtagggtgtcatcaagttgacagagagtcctgtggtgggaaaagagactgaacaattacattgggtcaaatggtagccggactaagtaggcactggggagtgactagaggtttttgagcaaaggagtgatgcatgccagtcagtgaatcctgaagagttaatctgactggggtagagtgtggcatggggaaggaagccaccgagaggctagatatggggctgtaaggcctggcttagtctggtaaagtggggttagcatgaaagggccagttcaagagacattgccagccacatggacagtttcatcttggccagttatctccagactctgaaactctctctcagtctgtttctactattgtagtactttggggaaggagtagggagaaaaagatcatagacttgaacaaatcaggtgccactgggcagagggttctaaatttgcactctccaacacagtagccactagtcacctgtggtgatttaaatttaaatgaattatttggccaggcgtggtggctcacacttgtaatcccagcactttgggaggccaaggtgggtggatcacttgaggtcaagagtttgagaccagcgtggccaacgtggtgaaaccccctctctactaaaaatacaaaaaattagccaggtgtggtggcaggtgcctgtaatcccagctactctggagactgagggaggagaatctcttgaacccaggaggcggaggttgcagtgagccaagattgtgcctaggtgacagagtgagactccatctcaaataaataaataaataaataaataaataaataaataaaaagaattatttgcaaataattgcatcattagaaaaaaattataaatgaattaaaagaaatttaaagaattcattaggagtcaccacatttcaaaggctcagtagtcatagaaagctaatggttactatattgaagagtgtggataaaatacttccctcattgcagaagattctgttggacagcattgggctggatcacgaattttctgatgaacaaacccttcatctttctatagatcacaagaaagtctcccatggtgttttatatcacgaactactttgctgtggaaacttctgtttgtacagaacgtttcctcttacggataccaattaagttctttatgatattacattggtttggctgtcaaatgttgtgtgcttaacaaagaatgatagaaaaatcactttccagaacagaatgtttgaattgcatgtagcatagaaactgagtaaaaatttcagcctgatttaacatctttggagtagacttcttaaaggagagggatatgaacactgtaaaacacaaattcatcagaagtgcaatgacaacagggttcctctctactctgctggtgacaaactttaaaactctattgacttgtatctcttgatgtcattctattcccctctagtggaattaaaaggtatctgtctttctactccagcttggacacattcgcagtagtaggaatagaaatctagagataatgaagatagaagatagcattatcacttattttcatatcatgataggctgctgctttacattttaccctttttcctgtcctcaggggaaaatagccttctgttctctgtctatttgagctacttggagaaaaaaagtttaggtatctatcctatgtatcactatttatcctcataccagaagaagccttattgcccaatatgttactaggatgtgccattggttcagcgtctagcacagggtcaggcccgttaattgagttagaggcatgggttgaggtcccgattttaccacttaactatccatggcttcaaattcaatcatttactttcctgaacctccgtctcttcatctttaaactggagactctcctttgactctccatggtcgtatcacaagataaaaggaaataatgaaacctcattgaaagttaaggtggactctgcacatttatgtggcctcattccccaccaccaccactctgcccccagcagcatccttttaggaaagatggataaacaggtaaactagaaatatgtttccgaactctctgcgtacaggtgaagcatggtggggctggggctacctttaagttggttgcaagagcccaaaggctaccatttggtttggttatatttccttttttcttttgtcttcctctttttcttttcttttttttttttgagacagagtctcactctgtcatccagcagtggcatgatcttggctaactggaacctctgcctcccaggctcaagcaatcttcccacctcagcctcccaagtagctgggaccataggtgcacaccaccatgcccagctagtttttgtatttttttttttttttttgagacagagtctcactctgccacccaggctggagtgtagtggcgcagtcttgactcactgcaacctccgcctcctgggttcatgccattctcctgcctcagcctcccgagtagctgggactacaggcacccaccaccaagcccggctaatttttttttttttttgtatttttagtggagacggggtttcaccatgttagccaggctggtctcgatctgctgacctcgtgatccgcctgccttggcctcccaaagtgctgggattacaggcgtgagccatcacgcccagcctagtttttgtatttttggtagagacagggtttttgccatgttggccaggctggtctcaaactcctggattcaagtaatccacctgtctgggcctcccaaaattctgggattacaggcatgagccatcgcgccctgccattttttcttttaaatgttgagttattctaagtttaaagtggctaataggagaaacaataatttggaacattagcagttacagtatttctctagtctcaaaaagagcattctcactagaagtatccacagaaatgcacttaaatgccacatccctccctctcccctttattccagccaccatgtcataacctccctctgcagagcagagaattaagctctaaagactagacatttgttgtggcaaacagtgctgaatttctgcctttattttaacacaactgtctgctacatgtagaaatattagcatatttgcagagatattttcattaggtatttgttttgctttaaaaaacaacccagaaaggtgaatttcaaatgtgcacagtaggtttctgccatcctaaaggcaaacttcaaaattttttaacagctaagcaaaccatgccagtgggttaagatgtaggattggaagtctctgatgctgtcctggggcgtgggggttggggggaatgtatcaatgagtactattttggtcattattcttcaggttgagttctgggaggcattgcttaggacacatttaacgccacaagggaaagtgcattagtgttgccttctgttgtttaaagaaaaggagggagagagggaggaaggaatacatgcatatgatacttttgcatgctctgtgaccaccagcacacaaacaaatgcagagatgctgagaagtgcaaagtgagacgtggaagggcaggtgctaacagacaatgcagctatacttgtgatggtgcttttcacgagtgaagaccaaggtgtaagtgtcttttacccagtcacagctataaaaccgaatccagtggatcaactaaaactaagtgccaaagaggccaatagcagtctagaactacgtgtgagtgtgtgagtgtttcttctggcaggttctcctgttttacggcttcctaccagccatccttaactaacgcatggttggaaattcagtatccccccccaaaaaattgaaccttcatagtttcccaattcctggttttagaaaaggaatgaaggggtatcaattagagatcaagtgcatctttgaggagagaatggcttgctacaatcgaagagaagaaaacctcagctatcaatttgtggaggctttgagcagtcactgagcagatggggttgatgggggtacctaactcatgcacggccaaatgcccaagcctaacaaaaacggagaaaaaccaaggattaacatatcactttttagctaagatgtaaaactggttactggcaagcttattccagcaggctcagcaagcgtccagcacaaccacaagcagcttgatcaaaaacagacctctgcctctcggtggatagcttttgcttttaatattttatgttcacctctttggctcaagatttccacttctggcttttatccttgggaactgataagacacttgcacagtgtgtgcttatagatgctcatggtagtgttattcataacagtgaaaaacaaaatcacctgaatgtttaggaattgggggttgattaaatccatcatagtgtgaatgtatgatgaaatatcatacagtaagatgtgacactgatttatatttaatgacatggaaaaatgtttaacataaactgttagattttttaaaaagctacctatcagcctctctctctttttttctctctcatctttcttgaatgaaatccaccaaaatgttaatgtgtatatacttctttctacttaactaccttttctaattttttacagcaagtatggttttacctacttaaaagaacacgtgacctaaacaatagaaaattagtaacaaattactagaatactattttaccataaactgcacatttcgatttttaaagtgaggttataaccaaaaagatcactgaacatcaataaataaaattggctgggcgctgtggctcacacctctaatcccagcacttggggaggccgacgtgggcggatcaccttaggtcaggagttcgagaccagcctgaccacatggagaaaccccgtctctactaaaaatacaaaaaaattagccaggcatgttggcgcatgcctgtaatcccagctactcgggaggctgaggcaggagaatcacttaaacctgggaggcagaggttgcagtgagccaagattgtgccattgcactccagcctgggcaacaagagtgaaactccgtctcaaaaacaaaaaaagaaaataaaatttatcttaacgtgggtaagaggggttgctgcttgggaaatatctactggaagtaatgaggagtcagggtgaagttcggaggtacctaaagagacagtcctgccgatttggacttggcagtcgagaaaaagacatggttacaccttctgcctcctctgtgtgtttaatagatgaacaaataccagctgctggggaatcttatgacattatagtgaggcataaaaatcagccctcttgcaaataatgttatactatttgaacttcatgacaaaaatgagtgcagaatcccagtcatgttagctccctactaccaaagagtggacttcaaaatttgacccacatcatcacagaatagcagacagggtacctcacacaatgacctgatcctgtttttactaaattaaaatgatgggatcttgcagactctgaataaatgtgtttttgtttatctctgatttgttctcagtcgtacagacttggccatgaattcttataggagacttaccactttgtacagggctggcagaggtttgcataatttagatgcttcttgtattcctattttacgttcctttccaactatggtattggaactaaccaagtctgtaattagcataaacattatttggtgctaaaaaaatggtatcacattttaatagaggatagatcagtggttgtcaggagttaggggaggggagggcatgactataaagagggtggcatgggggagcttctttgtggagattgggaagttccgtatcatgaatatgaatgtgataaaatttcacggaactacacacacataccctcctatacaataagcacatgtgaaatccttatacagtctgttcatagcattgggccagtgtccatttctgggttttgatcatgtgctatggttatgtataatgctgttatttgagtaagctggtgaaaggtccatgggaactctctgtgctatttttacagcttgtgagtctaaaattatttcaaaataaatgttttaaataacatttttttaaaacgtgagctattcctcaaaagattactattctcagagttaccataaagctagttaaagtagtcagtacccccaattgaatgggcaaagaaatacaatatttgaatgactttttccttagaggaatcagtatgacaataggaaaaagaaaaataatgatttatccttgaaacaaaaactggaacaaaaacatgatttaagtatatgtgtaagtatgtacttaaatactaagtagataggctagagaaagacatacaggaatatctgtggaatattgtattattgccccccactaattgttcccttacctctctgatgatcataggtcctacccattgctatgtgacttgtagcccctccctggatgcagagcatccccaacctagggtcagtcttggccaaagggagtgaagtttagctgcttcaagaagcattgacagactgtcgttcagtttcacctcttgcttttcctttcctctgccatgagaatggcatgtcccaaatagcagctgttccttcatctctaggtcctggaataagtagacaggtgctccttctctgaagctcctgatatataacatgagtgagaaataaacctaggccaatgagattttgaggttgtttggtactgctttgttgctgagctaaaattacatctacaaggtggacggtttcattgggcatcaccaacttgaaactactttcagttgaactcaaacctacaagctttcaaagtttgaagtcctaacccatcctgtggctctttaccaaataatataaaatggcagtagatactaagctttctgagggccattgtagattgtgttattatttaaaatatttgctgtccccttctggggaggttattacacccggccctgttgacttccagattggccatgtgccttgctttggccagtgacatgcaaacagaaatgatgacaccatttccaagcaggagatatatgagccgttgagtactctgccatttctttttttcctctgctgtgagattgcatatgtcctagatagtgactgctaaagtccctaagtgaaaagtgagataaatttttgttgtggaaagccactgaaagttagaagtgatttgttagcagtataatctagtctcttcattccaagttagataggacctgagcctcacctggagtcttcacatggtgggcacaccacctggcacatagtaggtgtacggtaaataattttttttaggcaaaatgaagaaattgataggtacctaggaaataaccttatttataaatgagttatgtttagggtttgtgatttgaatacttacacattttaaacatcttatttttattactgttactttagagacagggtctcactatgttgcccaggctgaagtgcagtggctattcacaggcatgatcatggcgcattacagcctcgaacacctgggcttaagcaatcctcctgcctcagcctcccaaatagctgggaccacaagcatgcgccactgcacctagcttatctttttttaatatcagaattccatattaaaccatcagaggtttttgaaatttaaaagttgtgcagggtgactataatcaataataactacacattttaaaataacttaaggagcataattggattgtaactcaatggataaatgtctgaggggatggatactccattctccatgatgtgcttatttcacattgcatgcctgtatcaaaacatgacatgtaccccgtaaatatatacacctatgtactcacaaaagttaaaaataaatttgtttaaagttgattgatgatggagcaaaaactggacataaaacaatgtcttgagatgttaatgaataagatatattatgaaataggaagatggtcttaataatagcttttcattaagagttgtattggtggcttgtggtgttaaatatcttcatagtgccttcatatagacaccttcttctgcagattggtagagaaactgccaacaaagcccctgtgtagtgagatgaggtggttgcgccccagttcctccagcatgctaggcttttcccccaatggtgtctcatgaagcagccggaatatagccagtgtattcagctggacttcgtggtaatttgggttacatagataatgtatggatttattttttaacttaaatcttttcagataatgttaaaagtctcattttactttcatgtctgaacctaatctgtccccacactttcccagagtcatttacttatttatcaatctagaaaaaaactgtcttactgttcagaggagggggctttttgttttttgtttgtttgttttttgttttttgagacggggtcttgctctgttacccaggctggagtgcagtggcatggtcagggcttactgcaaacttgacctcctgggctcaagcagtcctcccacctcagcctcctgagtagctgggactaaaggcataggccaccacccccagctaattttttttttttaagtagagatgaggtctcgttatgttgccccagctagtcttgaactcctgagctcaaacgatcctcccaaagtgcttgtttctgttttttacataaaagtcattatattttatgtcttgtgttgtggcttgctgttttcattagacaatatatcttagagatctgtccatgattttacagaaagatctagctcatttgatttaactgccatggagtattccatagtataaatatattacagtttatttagccattgccttgctgatacagatctatctagaatttttaaaataatttattgcttcccattgaatgattacagcatcttgcatagctgggcaaaggactcataagaaacctactagcaaaacctggtttgacaggttcatccaactgtatagatgagtgttattcaccagaataaactgaagtgttacattgcagatcagaaattaatgagcatcaccaaaaacggaatttctttcgttctttcttagaaaaggaaacatccaacaagatcagtatggtcagaggccaagtgcgatcctaagcccaaatggagagtgggccaggcagacccagccgcctgagaaggggcatggcagctttactgagtacatgatacacaatgtaataattacagtggtccccaagttacatgcaaccaccctgatcatatgacttggttttggtaatcctctcatgttaaccaaaaaaattttaaataggtctttttttatatcatagggttaaaaaaaaaactgcttcctacttccctaaatttcttaagaaatttaagatcgcagtaatgttgctagatttgcccttgaagcagtgttttgggtgtttctcatatagtcagcatgtgggtgacatttagacccaagcttggcttacaagcatgattcatgagaacacatcagatggtgacagcagagaatttcccttggtacttagaggggagcagcttcaaggaggcatactgctctgactgctggaggaagttgcaccgcagagcttctgttggttaaaaacagtcttttccagaaaccctgaacccccagccctcaatgacagatagtttggtccttcaagagaaacctatggggcattttggaggcattcaaatatgggtggaaaattcaagccaggatgacctctaaccaaaaccctgccattattttactcattgcattaaaagcacatgtgcagtgatgtcagttcaaatatgaacatccccatcaaaaaacatcattggttgcctgcctcctggtgtgaagggagcgttaactcctctagagatttcacactgcacatagctagattagtctccagcctcaactactgcctttgcagacttacctagaatatgacttccaggtggctgtagacacaagaatgcatctaggaaatgtgatgcccggtcagcatccgaattctgcacagtgtagatccatgtgtttattttaacatattgcaaatgatagcggtaatgatgatggtgataaagagaaactttggaaaatcttggtagaaatgttgagaaatgtttccaaggaagactaattaagttgctacattataaaactaagaaatgagaaacaggccagcggatgctttcaatagaatttgaatttttcacttgtcatttttttcctaagaggtttagatttagatttgtaggttagactttattcatgcctatgaaaagtgattagctcaaagccttcatttttttctcccaaccacatatatgacagaagtgtctgagctgtatttttccctctttcgttataatataatgtcaggcttgtgacatatgacagcaggtttcacactccacttaatgacaggctgccagttcctggagaactaaaaaggaagactaatatgtatttgactaaaaaggaaaatgttattaacttggtaatagtgaagacttggtgtgcaccagatatttctttgtggccctaagtctagccagacttgctgtaacttatctgtgggatgactttatctacagccctttggtgcacagtgataaaagtgtgctttgttaaggatttagtagttgctttcatacacatttaatgaaggtctaccatgtaggagataaaatgatttcagaggatacaaagacagacttctgcattcaggtagttttgcagttcaagaggaacctattaatgtcactttcctctttttaccttggtttccaggaagctcagagataaagttaatacttaatcctcagttcggcagcatcctttaggacctctctttcctccctgttagactgtcatgtcagtcctctgtgtgtgggaggtgagagataaatgatgaaaaattaaaggggaggtagacagaatcataattatcataagtggcagaatatgttaagtggcatgcaaaagacagaaataaaatgctctggaaggtcagatgaaggagagaaattgtaactggtattgacatctggagagacttcctggaggaggaaggagactttgataatgacttttcaggtgtttcagcaggtggagtcctggcaggtggaggcagcagccgaaatgaagacacagatgagagacaccaaggtgcctgccatctgggactcaccgaagagaaagatcagatgtccaggtttatagatgtaggaaaggatcctgaggctgctctgatcatttccatgatgaatttgatgaatttgatgaatttggtagctatcaggagacctactcttgggccagtgggggcagcttgtgccctggtattgtggtgttcaccttatctgtccatccaggtcacaggcatcacctggaagccgcaagccttacccacctttcaatccctcatggcccaggctggcgccacattttgcctgagctctcattctgcctgtgccttgagatgattttgttttgaaaaacgggtcagaaaggtttggaaacagcagtgtgtttcctttacttagagaaaagcgtcctaattctgcttttcagataaatctttagactcatcctcccacgactccttaacatgagatcagcgggttatatatttaatgaagaagtaaaagatgttcctttggtgctgttctacttgagttaatgtatttcaccagccaatactactgtattccctattcagtaaacagtatatttaatacatatgtagtacagtaaatgctcttgcattggaattatgcatgtaaaatctgatgaaaccctaaactctgtagtttagttaatggtattgtagcattgtcctgggtctgcaaatgtgccgtggttatgtaagatgttatcactggggaagctggatgaagggtatgaaggaacagtctgtactatttttgcaaattcttgtgagtcttaaattatttcaaattaaatagctttaaaaaaaaaagaattaaagagatgatctagtccggttgttttcaactttaattttagcagtggtctccctcttctgccttctcctgcctccatcctcagcatccttaggcaccacctgacgttttaaaaatgctgatcccacccaatacatttaggctccagatgaggaaatcagggcccacagaagtaaaatgcatcactatttagaggctattgatagaaacacagtgagcctggggagtttttaggacgagttgctctctgcagatcttcatgactcacagctctgtcgctaacactgtggtttcttttgtcagactaggtgagattaattagactggaaaagagtttccatgctcctgcatcccattgctgcagtgcaagaaatggcatcatccatataattgagacagtgcaagaggtggtttgggttagcagacagtttaacaaaacaccactcagggcatttgccaagaggactggcttgaaagtccaggcatggggtgcagaagtcgggaatgcgggacctaggaggaagtcccttgacttctgccagcttggccttcactctgaccacctatgaagcctgagggtgattagcccagaggatagggagtcctgtttcctccccatccaggcccaagtcactaaagtattttggggaaaccctgggcaccttgaagtttgctcctaaggataatgtaataataattgcttatatttgtctaaggattttcaggttgcaaagtctttctcttatattccctaagctgggtgtcaccccttgcccatgacacgggcagattggttttatttctgctttataaataaatgacgtgacttttccaaggtaagagcttgtgccgggactggggtcagaacacaggtctccacagtcctgctaagtgctcttctcataggagactctcttgttctaaacaaagatcctggttattgtgaagcacctgtgcacaattgctgatcaacaaacagctggtgctattattattactgtcgttgtaattcataggcaggatctttggccacatgtaattttggggtgtgacaactccaagacttgctggttctccagacttaggcaggaggtggaagcgatggtttcctctcttcctacacctccaaacggtgagaacctgaaggtgccatatggctgttgcgtgagtaagccttaggttttcctgaaaagtgagttgcctgtgtgccacatcaatggagatctatgtgacaaccaactggtatgacaaccaccctggggctgcctggcatgcacatactcctgagggctccgtgcgagctgccattctttattaatttagtgccatttgttgatgcctcgtttctgcagggaaaactggttccttcatttcccctggcatattctgcgccctccgcactgtaggacgcaacctttcctgtcaacacaggtatttttaattggtgctggcaccaacctactccctgaacattcttcctgatgtcctgggatcctggcaaaagtggtgggcttccctaatggtggaagtctaaggccatacttcagaccgtggacccaactactgctttctagaagaaataacctgtcaaggaagatgttgatgtctcacaccctgagagaaacatttaggaggtaaaccactgacctgcctcgaggatatcattaatcatctacacatagaggtgctaggtactcacctcgcaccagtgacacacttactaaatatttgttgaatgacctcctagagcagtggttttccagtctttagtgtgtccgccaacacaaggatcactggcaggatctgctcaaacacagactgtgaggccccacccccagagtttctgactcggttggtctgggaaaggactaagtactatgcctttctaacaagttccaagtgatgtgatgctgtgcgggaaccatgctctgaaaacccttgtcctaaagcagggcttggcaaacttttcctaaaaggacccaaatagtaaatattttagattttgtggcccacacagtctctgtcataattactcaactctgccattatagccaaagaaaatatgtaaataaaggagcatgtctgttttccaataaaattttatttacaaaaataggtggtggacttgtttctaaaatatatatatatatatgtgtgtgtgtgtgtgtgtatatatatatatatatgttgcaaatataaaaatgcgttgtaaatatattgagagccagatcctcattctgggtagatctccaaaagctcttgtgatgggaatccaacgttggtcacatcgtaggtctgtgctctctgaagcagcacaaatacaaaacttggagtgaaacagagatgagcgttgttcctgtgcaaggatcacgtgcaaatatgtgaactgtttcatataaaaaaaaatctgaggtctgatgttcatcaaccatgtgatttggggaaggtcattaacatctctgtaaaacgaggataattaggcagtaaaaactaggggaaaatgctcatttttataagttctgggtggtgcagacacgaggggtttactattctttatacttctctgtatgattgaactatttcagaattctcaaatctgtgtctttaaaaagtagtcataggccaaatgctttgggaggccaaggcaggtggatcacgaggtcaggagatcaagaccatcctggctaacaaagtgaaaccccgtctccactaaaaataccaaaaattagccaggcgtggtagtgggtgcctgtagtcccagctactcggggggctgaggcaggagaatggcatgaacctgggaggcagagcttgcagtgagcagagatcgtgccactgcactctagcctgggcaacagagcaagactgtctaaaaaaaaaaaagtcataacaagcctttggcatatatgtggcttagggtttaggttccatagtcaaccaaaagatgaattatcttacagtcagaatcacctttggaattccccgaaatcaccagcaccaaggccctcagaaagtcagcagccaagaatattctgctttatgtcactttgcattggagaaaccctgagagaaaggttaattcaagcttattatgtctacagtagatctctggatctcctgcccttccccaaaccctgatcttctaaagtcttgcttaattcagtggatggccactctgcctttgcagctgctcaggccacaaggagtgattcaagaggaagaacttaataggaatgagtcctgataggtacatgttgaatatgaaattgttttatagttccaatagaacagtagagtctatggccataccaccctgaacatgcctgatggaaagctaagcagggtcgggtccggttagtacttggatgggagacaaatagatcatctaagtagaagctcagagctctactattatttatttatttattttttgagatggaggctcgctctgtcgcccaggctggcgtgcagtggcataatctcagctcactgcaacctccacctcctggactcaagcgattctcctgcctcagcctctcaagtagctgggattacaggcacacgccaccatgcctgggtaatttttgtatttttaatagagacagggtatcaccatgttggccaggctggtctcaaactcctgatctcaggtgatctgactgcctcagcctcccaaagtgctgagattacaggtgtgtgccactgtgcctggcctacctttatatattaataaacagaggaggctgggcgcggtggcgcatgcctgtaatcccagcactttgggaggccgaagcaagtagatcacctgatgtcaggagtttgagaccagcctgaataacatggtgaaaccccatctctactaaaaattaaaaaaaattaggtgtggtggcaggcacttgtaatcccagctacttgggaggctgagacaggagaatcgcttgaacctgggaggcagaggttgcagtgagccgagctcgtgccactgcactccagcttgggtgacagagtgagactctgtctcaaaaaataataataataaaattgaataaataaataagcagaggccccagaagcagaggcgcttatctgcactacctgcgtggtacctacctaccctgtgatacggcactcttctaagcattttacaaagactgactcgttttgtccttatttatagtaaccacagaagacagatgctgttaatttcccagcttatagatgaggcagaaaggataagtaattcgtccaaggccatgcctctgggtagtagcagagctggaacctgaacccaggcagtgactccagaatctacgctctttaaccacgatggtcttctgtatatcatttttcttccctatccataatctgtgagttgagggacaaaagcttaaaaatctaaagaaaaaagatgtctggttgcacctttggtgctctatgtggtatgctagagaaggtaatgaaattgcagtgggctatggggaggcgtaatttcagtgcctttacgattttcatctgaccatgctgagtttccctataaaaagcataaaatactttggagatggtgcagaagcaggaaaatgtacctgtcagtttggatgtagatctggtttcgcagtgtattgtatttctggatactctgtccaagaggagatctcctgaatgatccatttagggttgttccgttcacttcacaaacacaccgattttgtgtctactcgtgccccagcctgcgctaggcagtggggagacagagaagccaagttgtttaaaacactgtgcttgtccccaagggctttggtgaccatagctccagaagtaatagctttggtggaaaccgtggtatgtgcaaatttcaccccataaatagaggaaacataggtattcattatattaaaacatgatgcgggccaggtgtggtggttcacgcctgtaatcccagcactttgggaggccaaggctggtgcatcacctgaggtcaggagttcgagaccagcctggccaacatggtgaaaccccatctctactaaaaatacaaaaatacccacatcgtggtggatgcctgtaatcccagttactcaggaggctgaggcaggacaatcgtttgaacccaggaggcggaggttgcagtgagctgagatcgcgccactgcactccagcctgggcgacgagcaagactctgtctcaaaaaacaacagtaaatatctaaaatatttagtggcgaagtcaccaccacccattgtgtgactccagagaatgatgcacagtctggtgttatcgaaccttgacttggggctggggagtggtggggcctgagcttggcttaatctaaaaacgtggtcctttcatgactaaaatgagcattgtgcttcttctcctcccaggaccccaggagcaagcacaagttcaaaatccacacttacggaagccccaccttctgcgatcactgtgggtcactgctctatggacttatccatcaagggatgaaatgtgacagtaagtaagttttcttttccagttcatagcgaggctctgtagctcatgctcagggtttgctgagcaaggaaggctcagtaacttttcaacaccaactcttcagtagagggaattagttcagatatctaccagactgacaaagtgtagattcttccactgtcaaagttccaggttattgaactacttgattgcctcattatgaacccccaaaaagcactcgatttataaatgaggttggtgggtgctgtcactttttttttttttttagtggcagaagtcttcaatcactgtaaaatatagcctagtcaaaccccaaagaagacttccaccgccaggtccacatttggttatagcttcaaaataagccaagaaaccctactcattatcttcctgtgtctctaattagtgggtggactgtggaaaaatccagtaggctcttcttaaaactgaaaccaaaatgaacataaaaaccagaatagcatcttattgaagttcactgacccagcatgtttatggacggatcaaatgtgtattagcctggctcaaaacgctgaggaccactgacaagcaagacaccagcccttttctgttattttttgttacgtgtgtatctccatcaactaccaggaggaaagaaaagcaactatgaagactctttgctttgatcattttttttttttggagacggagtctcactctgtcacccaggctagagtgcagtggcgcgatgtcggctcactgcaagctccacctcccgagttcacaccattctcttgcctcagcctcccgagtagctgggactacaggcccccaccaccacacccagctaattttttgtatttttagtagagatggggtttcactgtgttagccaggatagtctcgatctcctgacctcgtgatccgcccgcctcggcctcccaaaatgctgggattataggggtgagtcaccgcgcccaacctgctttgatcgttcttaaagtatgagattcctcaggctatgtttgtttaaatacaagctgatacctttaggacatgaaaagttaattgccgagcctgtttttctaatagatcgggaaccactgtggaaatatcagcctattgccatttgctaatgactattttcatttgctatgatggccagaagctgatatttgtatcttacatggagcaaactgtagaaaaagaaacataaacgagcatcatagagtagatggagtttctcaggacacagggattcttcaccttacagagttgtacggcatcacaaccaaatgcaatgtttgtttacttcaagaaacgctgggatttccaccatttaatcccagcactttgggaggccgaggcgggaggatcacctgaggttaggagttcaagaccagcctgaccaacatagcgaaaccccgtctctactaaaaatgcaaaattagtctggtggtggtggtctcctgtaatcccagctactcaggaggctgaggcaggagaattgcttgaacccaggaggcggcggttgctgtgagccaagattgtgccattgcactccagcctgggcaaacaagagtgaaactcggtctcaaaaaactagaaaaataaaaaaaagaaaccctaggattccaaagacatggttttcaggggttctgcaagggcttacaacttaagtgcatatgtaaatatattttaactactttaaaactgggaacaaaataaatatttgaatgtgttacatactcaaccttcactccttgggcagaacttgcaatcaggtttctcctacagcatcctcttcactgaagagtcagctgggatggggaagcatgccgttagacacggttcctgtttgtactcagttttctgcatgaatgaggatttttggatgctgtactactttaacataatgcaaaaataaatgagatgtggaggctggtctgagacatcaactggtttcaaagttgtgtttgtatcagagggctttattggtgatccttgaatgtctttataataaataagtggtataaatttgtgtttgttagctgagtttatgctaataaaataacactcatatggtttacatcattagattctgctttagactttgtttgcaaaatggtttccttactaaaaatttttgaaaaccgctgacctggaccaatgcttttttgtttggttttgttttaaactctttttcttgggaatcataaggcttctgtggctgccgcctgtgctcctttctggagacaggaggagagcaagccgatgagcaccaggactgcaacccctactgaccttaacttctgcagagaagaagcctcttcctgtgcccttccacctggtgcaattgcaatcctagatagagttccacttgggatggggcaggacgtcagggggcagttagcaacaacaacttgagtgggccaacctctcactttgtagagttggaaatgaaattagagcaaatcagcttcccaagatatacagcagagactgcaacacggcccagtgcactttcacctcccgtcccctccccgttgcctctgtgctttccagaggctctggcatttactgccttcacattgcaaattttgcccggacacttaaagacatgatgtggttaacacaagcaatatacataacacagcttttcaagagcctttatattggctaaattcgaggtgtagaattttgaacagttagccttggaaatagaagcctaatagcatccacatttgtgaattagctaattgttctttcctcagtatgtccatcattctgctgtcagtgtttaatcggagcagtatacattattcatgatgctttttccaatttactttgtcatgttaaaattaaacactcaaaatgaaacggaaaggaagactccaccttgatgattacagaataaccttattagcatcctggcaaggatttgcaaggattccagtggccttccctccttctggaagcctaaaggtacaagggtgatcgagctggaacacccacacacagtcttctgtttgtttccggcacacaggattcttttcagggtttctttggttcattgcaataatactgatctttttttatcctccccctgtctcacccacataatgtcagctgtaaggaatggctgatcatgctaggcgggtatttgttttacttggaatggtatttaaatatttgaagataggtttaaaatatcaaatacaggttctttggggagaaaaacacaggcaatgtacttaaaccttgttgaaaatacaaggttagctgaggaaaggaaaatttaatgaattttctatactcaatccacagattttcactctttctcagtggtaagcccagaatgacataaagaattcattagcaaaaagtcttatgttcaagctgggtgcagtggttcacatccatagtcccagtactttaggaggcctaggtgggaggaccacttgagcccaggagttcaaggctgcagtgagctaggattatgccactgcactctagcctgagagacaaaaggagaccctgtctgaagaaaaaaaaaaaaatcctctgtttaacattttcatattattttgcctctgtgtacataaaatatgaattaggctgagctttgtacatatttacctgtgtgaattttgtatactgttaaatacttgaaacaatcacagaagcccaagctgggatattttgcttcagtgaagactgagcaaatatggtatgagtattttaaggatattgtcactcacatgaagcctgtgctgtacaggacatctgctaacagttctttatgtcaccaaaaacattatagcaaagtatcgagttgggggtaactcattttcacttgtgctcatgcaccaaaacactgaggagcggtggttggagtccatatgcccagctcaccctctcctttcttgattcacagcctgcgatatgaacgttcacaagcaatgcgtcatcaatgtccccagcctctgcggaatggatcacactgagaagagggggcggatttacctaaaggctgaggttgctgatgaaaagctccatgtcacaggtaaggcttgctcatcccggagcagcatcgtgggcaggcatttggatgaaggttacactgatattaaggcagggtgggggctgggctggatgccctgaggcctctggagaggcagtcgccctggtggagccatcactgtctcagagccctccagccctctgagccctcgggttaatacacctcccaggagatgggtctgtacacccaaattcccaaatactcaatgtcacacaaagtcacaagcactgtgtggattgggctattctgacagcatggcccgtgtactctcctcccggtgacagggggtcaggggagccaattaatcaaaatgctgttggagggaatggaactagaacaaggggaggcgaatggatggatgacccaggtgttttgtggcattggcctgtgatggcccaataaatccacctcagcgatagcaacagccgttgagtgcttttgcttcctctgtgttaggtatggtgctaggaacttcacatagattagttatttagacctgacacctagctggttattagcctcgttttccagaaaaggaaactgaggcacagagagatcaataacttgcagtgttacagttagtgaggagctgggataggaatggaggcatttgactccagatactgtgcttataattaccacacctcctacaaacagcctggctatgggaccggaattccctatccaggggcctggttactccctcctcggggctgtttctgggtgggctctgccacaacatggctttttcctgtggttttcccaccaaatccactttcggttcatcggcacactcagtcaagttatcctggagtcttattggcctaggacccatcccgtgtcctcaagatggcttgagttctcggtaccatgacccactccatgttggtgtatggttcagctctcaggcatcagcctatttccttgcacttggggtccctgagggaccaactgtatacattacccttgttgacaagggcattcattttcatttgatcagcaaaggtatcttccttctgtatctaggaatttgaagctatcataaacatggaaagactgatgctaatctattaggtttagataacagaaaacatcatagaagaagggtttaggaggatctgttttaagaaaaaaaggggaaggtggggacttccaaagaaaagcttacctttggaaacatcctcaggtttttcctttgaaagataagcaaatgttctaaccagggctgtcccctcaggtaagaactcagagaagaacaaaggattccaaggtatcactgggagagggtaacagtttgcctctggataaccttgaaaccagctatagctgatggtcaaaatggaactgggaatgaaatccctatcatagatacagaatcccttctgactttttgtagtttttagagaaattcttttattttctcaagaccatccctattgtgccattgcctttggggctgtgattgtcacctgcatttctttttaatgggctgatgctgtccttggaatccctgcccttatctgacagccagggcccctctgactgggcactgatgctctctgcccagaggaagatggtgttcctcgggggccatgagacccctctgcaacatcacagctttgctcttgtttctctttcctactaaggcttccacattgtcaaaaccatgtatggggggagcagattttgcagccgaggggaaaattaccataaaacctagtctccgtaggtggtaagggatcaaggagcataaagtagaatgcctatggctaaacatgtccatgcttttcttaccttttcctttatttccaaagctactgctgttggcagtagaatagacatcacaggtgaatattcagtttaattatgggtttacatgtggctaccttatggctcgctgtaaggcaagaatgcctgaaatgtttagctggcattctttgtgtttctagataaagcaaaacatgtgctatgcatgctggacacgccccgtgccgtcttctgtaataaaagcagcaaccatatggtactgccggaaccttccagtatctcctataaacctcaagagccttgcagatctaaaactgcatagagagcacagatgctctggctggggtggcacaggtacacaggtggaagacaaaggtcaggccttatcgtgctagagcttacatcaggctaattcctctaccattgccaaaagttgaacttgactcacaattgtagagtcagcttaaggaacaagacctttcactgggttggatgtcgactttttgcatgtgaaagccagccagtattgcttatgccaactctctgggctaagtcccttgagaattagtttaaaaatttttgtagagctatagctccactctaggaatgtgaattcagcaagtttaattaataataataataataatgtcttattccattcaggctgctatcacaaaataccttagactgggttatttataaataatgggaattgatgtatcacaattctggaagctgggaagtacaagatcgaggccccagcagattcagtgtctggtgaaggctccgtctctgcttcatagatggcacttctcactgtgtcctcacatggcagaaggagggcaggctgtgtcctcacatggtgcaaggagcgaacttgctccctgtcatctcttttataaggctctgcgtttggttgaaggttatcccgaaaggattacttcccaaaggccctacctcttaatactatcacaccgggaatccaatctgaagatatgaattcagaccacagcaaatagtagcagcagctcacagctattcagtgcttcctccacaggaccgctttctaagtactttatgtactaacttttattcaaatctgtgaagaagttgactttattatccttacgttatagatgaagaaacggagatacaaggaaatgaagtgactcacccagagtcacacagatggtaaattggatggctaaatatttaaatggcacatgcggagagaagatattttgatgacagtttccataagaattggaatctatttttaaagtacagttatgtgtgtgaagggaatccaatgttaagtatggaaagtcaggctcaaggaaataactaattagtaattacatctttaacatttttaatttaaagtaatttaagattttcagaaaagttgcacacacagtacagagttctcgtacacccttcacccagcaacccccgatgttaatgcccttgtataactatagtacctgataaatttatgaaaaataagtgcttacagccaggtgcagtgtctcacacctgtaatcccagcactttgggaggccgaggcgggtggatcgcttgaggtcaggagcttgagaccagcctggccaacatggtaaaaccccatctctactaaaaatacaaaaaattagccaagtatggtggcatgcgcatgtagtcccaggtactcaggaggaggctgaggcaggataatcggttgaacccaggaggtggaggttgcaatgagcccgagattgtgccactgcgttccagcctgggcgacagagcgagagtccatctcaaaaaaaaaaaaaaagaaagaaagaaaaaataggtacccgcattagttactaggaatttttttaaagagccaaatagaagacatcagactcatcttatttcagtataaaaggaccacaagtggtactaagcagagcccccttggggcagtgcttgccaatgatgggtggcacccccatgcccattatctgcctgcaccttctcccaaccaaatagttcaggcatgggtttgtcttgagaaatgttttcataccaatagctaccatttattgagtgcttgctctatatttattgttcataggactggacctttatgctcagcattttatattcattgcttcattgactccccaaccaatcccatgaagtaaatactattattatcctccttcttgaaatgagcaaaggagctgagagaaaggaaggaaatggctccaagttacaaggtggaaagtgatgtagttggggccgcagcccgggcctggcttccacactcttgctttcagtgcataggctatgaatgttccaagtctctcttattaattagagtctcctttggaacaaacaattaacccataaatatttgctgaacccacaatcagcaccccacaaagttttttgaggtcacggaaggtccaaacatgggacttaaaaccaggggagaaaagagtaacacaagaagagaacaaagaacaacccatatccaagtaaaattaaataccaagtacatggtgatgaaatagcacacccttgggaggtactgagggtggggaaggggacagagagggaaggaccctgtggagaagcagccgactgaatactgtaggtatttgagagacagagagggaagagagctccgattgagagagtcagagggctgtgggaattagcctggtggtggctttcatgagaacacaaatataaaccataagccatcacatgcagagtttatggtccagatgcgagtgatttctcagaaaatgcacttaaacctgaaccctgagcagctgtgttaattgctaggttagttcaaactgtgtcttacctatgtagaatcactcaggttgaagataattcccaaagtaacgtagaaactcccgacaggagctctgcttcaggatggaaacctccgtttgcagtcagagatgagttttctttctagcttggtggggtatttatgggaaagccccgagctttggtggtgtatttttattttttgcctttgggcggtggtgctgatattatcagaatggtgtcggggtttttttttcttcttctgataggagattgtaataggttttctacactctagtgtgttttgtaaattcggtttataggagtagtaaaaaaaaaatccctcatgggaaccaattttcaatttaatcttgtaagtaaatggaaaaaatatcgggtgctttagagctgtttcaggagcacgtctctcccacagatagattattctgaagaagagtctaattttctcaacaacttgagtttgttaatttggtgtggagattgaagttttaaactgaactctggtcggggaggggaagacttcctcccagctcttacggcccagagactcctcctgcctacctagggccctgcgcgatttgatgtctgtcacccctgcagatatggagactcaccctcatcttattgtaattaaaacaataatattccctctgtgtgttcttccaccttaccatggtgtatttgttacagaatgaaggaaatgagcctcagctttgtatgataatcgttcattttttttgcttcacccattgatcatacattattgagcgtgtgtcctgctctcttcctggcaccagggatgctaagatgattaagacctagaccgtgtcacagactgtgtggtctttgggggagaattcaggcatgaaaaagaattggcgggtgctgtacctgcagtgggagtttgggagaaggggagcctcagtggccctggggaggcagcaggtgacagcttcacatcggaagtgcagtggagccgggaggacagggaaggaagaagagggcattccaggcaaagatgcagagtgtgttcaggaagctcagcaccatccaggatgtcaggaagttcaagtgagagttggagagagctggagggaagtttgtttctttccattttcaaagtatgagagctgcaatcatcagtttaccagttgcacaatccttaggagccatgcgcacaggctctgagttaaatatttctttttaaaacaggaagattttaagttccaggtagctacgttttcaacaagaacagagcatcagtctcctagcctgaactctacacatcaccctgagattcacagtgagcagagaccttctctatcattgctgggtaaggagacgcagcaggtagcccaacctttgcctaaaagctttgcacaggtaccttttgcagtgacaggcaggctgtggaatataataacttgttggaggctgccagcaaggagatgcaccaagctccttatttaaaggaaaaggcattagttggaagtcatttctgttcaataaatcttggttatgggatttggatccagatcaggaacgtagatggtgatgcagcagatgtatctgctcctttggtttgggatggagagggagagggtgctggcaagaagctgcttatcctcaggggcacccagagtgtccactgttggtgatcctgcatttgaccacctggttcagcgttctcagcagatccctccaactgcaaaggtatttttgttgttgttgttgtttgtaattaataaggaatctggatgtcatacttgatgaacagcaacctcccacctaatggttttaaccttgattattttattttttatttatttgtttatttatttttttgagacacagtctcactctgtcacccagcctggagtgcaatggtgcaatcttggctcattgcaacctccgcctcctggattcaagcgattctcctgcctcagcctctcgagtagttgggattataggtgtgtgccaccatgcccggctaatttttgtttttttggtagagacaaggttccaccatgttagctaggctgatctcgaactcctgacttgaggtgatccacctgccttgacctcccaaagtgttgggattacaggcgtgagccaccgtgcctggccaaccattcttgattaaaagagaatgaggagacatgattaccaaatgcaatctgtaacacttggttggatcctggatccaagaaaaaaacagctgtaaagaacattttggggacagtggggacagttgaatctggactgtattttagagaatgtttttgtaccagtgtgacatttctgggtggtaatggtcatgtgattttggaggggaatgctgaaatattttaggggtcattttttcctaatgtctacaacctacttccaaatggttcaacaaaagcaaaaaaacagacagaaatctgaaaataggaccaggcgggggttggggccaagaagagagcgtgtgtgcaggcaagagcacctgtggcggaataatagtgactctagaaagtgatataggtgttcactgtactgttctttcaacttcactcccaaaaacttgggcaatgatatctatgtctgaagctttgtttcagttgatcgtatttaaatgtactctgtagaggtcattcttggctagaaggaagcccctgctgaagcagccatcagagcgcctcagcagttaagcttccctgcctccaccctcttactctatgaccctcccctgcctctgtccatggccaccaacgcctttccttttgtggatggcagaccaaaggagacaattattctgcctcaacccaacgctgtgtttccttgtggttctgcactgaggctgggcccagaagcctggttcatgaagagcactcacctggcccctggcccctggcccccgttaaacaggtgagtcactgaccatttccttagagccacctgggactggctgcatgggacttgccatgacacagccggccagactgccacaggcaggttctgggaactgtacacttacatggatgggcaggggctgcctgggattgggagccactagtggtctatgtccccaagagcttgtatatgacccccattttccaaatagctcaggcagaaaagaaaatgtgagttaaacagctaaaggagtcatatgtaggtatgtgtacatatgtgtaagaagtaggctggacatggtgactcattcctgtagtcccagctactcaggaagctgaggcaggaggatctcttgagcccaggagtttgagacaagtctgggcaacagggcaagacctcgtctacacaaaaagaaaaaataaccagatgtggtggtgtgcacttgtagtcccagctactcaggaggctgaggcagaaggatcgcttgaacccaggagttcgaggtaacagggatctatgatggcgccactgcatgccagcctaggtgacagagcaaaaccccatctccaaaaaaatagtagttgtgggcacagtattggcaaagctgttgcttattgtataaataaacatcaaggagttggggaatggctgagtgggccgtttgcattctgcatctcccctccccttggataccactctcctcgatctgggggttccatgcctactttaaagacaccagcttctatttcctgcaagtttccagctcttaaaaaaaaaaaaaaaaaacaaaaccaacaagctttatgatgctcacatatgagaaactacttcctttagtttgtctttaaatactggtagagaaaagtccataataagaggggtaactgctcttcatgacaaagcacactttatctccatggctttgtagaagtttcatgaatccactaacatcagctaattctgaaagtgataggcattgttgcattaattttccctggggagaggcacagcaagactgggtcctctcttttgtagatggagaagtaagaatgagtggggcgttcagtgttcttgcagagaggattggtgggtccgtttagctaggaagtggtcgcaccatctagccaggggacccttattatccaatgatctctatgtgcctggcatcttgcaaatggaaatgctaacaagatccagccagtcacagcagtagcagctgcctagaaaggggacatgaagggcaaaccagagaagctccgggtgtttcttgaatgcttagatcctgtgagaagagaaaccgacactgattgaacacttttcgtgtaccaggccccaactggatgctttcctatgtatttcatcccaaccaccttttgggaaaaatgctatcatcatcaccagcagcagcagcagcatcattacccttttgtaagtgaggaaactgaggcttgtagagctcccgcagcctgcccagctgcctctagcacacacgcatgcccttcccactattgtaagcagctgaccgttggctctggctgagggaagatcctgtgattactcacagctgtttcccttgagtacagacacagcctacactgttgcttcaagtgcttgcaatttcacatttctatcctgcaattaattgtggaggctactctgggatggctccgcagctcctgtgattactgttctgttggcaccactgggggtgagggtctgtcctcacttccgcagaccctgcattttccagggtttccataatggctggaaataaaaatggcagcagggaatctgggtgaagtcttctgtgctggaaaatgaagaattaaaatgggcagaaggatggaaacaagccgctacaggacgtgttttgacagcatgtgagttgcgtgggcatgtgactggaccagccctttcttggcatccgtctggctttttcttagtggccccagttcttccccattggagactcatcctgctctcacgttctcacagtcttcaaagaaaccaaatctagcagtcacctgccttgagttcactggtgcttaacatccaggcacatccttggcacaagaaaacaggaaagtgcgtcttagctaaaacatacagcggtgtgcttgtaccagaagaaagcctgcacattatcccattcaaatgcgtatgcttttgggtcatgactggcatgtgttcagtggatttatctactctatcttcttccttgattgggcattcctaaacatcagtgtcttatgtccacatgaccccttctgtaggcagtactttgcccatctccccatatttaccccttatgtcccctacacgtttgcactcagatttccaagccatgagcagcttccccactgtggcaggcaacagcccaccagtgtttcttccctcctcacttttgcttgtgccattttccctgctccccagagaacgtctttttaacattcagctgcagttacctttaggaagcctctcctcacattttatgccatgcctgaaaccaaccactttctctccatgccctttataacatgtattatgagatttcacctgtgtgtttatttacatgttgatctccttccactatgtcataagtcctttgaggtcagagatagtgtcttatctcctgtacccagcccagtgcctcaaatttgtaccaaatgtgtgtctgttgagccgatgatgatgatgatggaagtacacaatacagcatagaaactgactcaggcttttactgcactcctcaccccaaatccaggtgactctccccattttagccctacatctggatcaagttaaaatgatcctgttttaacccaattcataaagccacatggctctgggatcctttagagaaacatctatcagctaagaaaaaggttgcatcttctcagagacacatgattatttacattccgactgtggtacctcgtcctgactgatctgtggctcatcttaatgtcagatatgtacagacttgcagcatgccatcccacagattgttattcatgcttggttctctgtgcggggactccaacagagcttttcactctgggtgcttagtcactagatgtgcgtgggaggcagcaagattggaacaaggggcaaagagttgccagtgtcatttccttcatgcagcatttgtctttgttgtaaagcaccctggtatccatgctcatggtgacatagtttctctttctcctgcttaagataccccaagtccccagattctttatagggtcatcagtcatctgtcgtctttgacttcagtgactgctgccaggaggaagcactcttaaagataggctttgaatgcttacatccctggaagaggagaagcaaattatttctggggcctctttcaagattaccccattagcatacagagacattgatattgactgagcaggtcattcttgtgcaggattttaattgcttctaattataggattatcatttaagcacaagattaattgctgtgaaattattgcaaggaactttatcttctggaaagtaaatgtgttagccaagtgagaaatctcttagaagcttgcaaatgatgtcttttcaatcactttccattgaaactttcttctaatgcttggggaatgagagagagatcttgggggatcaggagggaagacgaaataaataacagataaatgctccttttgtttcccggttctccatcaaaagggtggaaaacttgaagtgtttgggaatggttatgttcaccaatggaaatgtcctaaaataaatgcagaaatttttttcctctcttgatccatgtcatcttcaacggtgggtgggtaggaatggctcagtaggaagctagaataggcaggtgctgtcctatggtccttttcaacaccaagctgctctgatatcttagcaaaaaatatgtatatatatattttcagatgtgttgtaaaggaatctcccattaacatgtatacacctgctctgattattggcatcaaaatggtacagagaaacatcagactatgtgcatcttagcttgtaggcgtttccaattggaaagattcagatttcctgagaaaatatgagataagttagctcctgagcttgttctaaaatatccccatttgaatagggggccatggccacccactggaagctctgcacagagcatccccatgagggactttttatactgagaatggtagctgcctttacatgcattttcctttttaattaatgcaaggtttgtggttaattaaagatagtcagggtcccttttcaaaccaaagcaggcactttttcctagaataaagaagagagaatagaagcaaggcaaacttcctataaaagtttttgcagtgggggtggtgaatttggggaatgtggcctgaaggaagtgttgtttcatcaacttcgactcacttgaggtagggaatgtaatcaaaagagacaccttcctcactgaacacccagcagggacatggctctttttctgggaaatgccgcactgacctccctttctctttgttaagtcactcagctgggagtgggggtacagtgcaggagagacacatttctctgggatatattgctgctgtcatcttatggcccgcacaggtggaagaactctcgtggaagaactctcacaggtgaacatctgcccaaaagagcaagtgtatgtgcagtgaatgttagaaatagcaccagagccctccttactctttactaatacccaacctctctgaaagaccctgaagtctgtttcaatccctcccaccccaatatggcagggactctgttatccttaaaacttctggcttctgaaggatgctagtatatatttgaaaaacaaaaaaatcccagcatactttacatgaccaacactccataaagaaagaatacagcaggcttgtgtttataaaataatagaagtgacttgcatttagaggatactatggtgcattagtctattctcattctgctatgaagaaatacccgagactggtaatttctagaggaaagaggtttaattgactcacagttctgcagggctggggaggcctcaggaaacttacgatcatggcagaagaagaagcaaacacatccttcttcacgtggcggcaggaaggagaagaagaatgagagcccagtaaaggggaaagccccttataaaaccatcagatctcagccgggcacagtggctcatgcctgtaatcccagcactttgggaggtcaaggtgggcagatcacctgaggtcaagagttcaagaccagcctggccaacatggtgaaaccccctctctactaaaaatacaagaaattagctgggcatggtggcagacacctgtaatcccagctacttgggaggctgaggcagaggcaggagaattgcttgaacccaggaggcagaggttgcagtgagctgagatggcgccattgcactccagcctggacaacaagagcaaaactctgtcttcaaaaacaacaacaacaacaacaacaacaacaacaacagatctcattatcttcacctcgtccttcctacaacctgtggggattatgagaactacaattcaaggtgagatttgggtggggacacagccaaaccatatcatatggcgttgactttgaagtcaggtagactggatttgaatcccaactatagcactaattaatgttgaatacgtattaggggttgttactctattaatggagttttactccagtcacgttaagtcatgtagctcaatggactgaagcatgtcactttattgacaaattaactctttcagtcctgactctttcatggtgtagctataaccacagtgggactccagcagccccaaccaagaaaatctaaccccagacctcatttgttttttcttcactatgcccaccaagcaagacacaggaacacactgtgaaatcactttcaaaattggaaggcctctgtatgagtagaacagttgcatattaagctgaggatattaaccttaaagattttaactggctgtgaaccttgacctcatggcttaacctctctttgtttccctctcctctgcaaattcagattaaggcacttgaactacatgaaccctgacgttcccttcagctctggcattttgttgagagctgtttcagagagagctaatcggtggtgccaataagtgtgccccttcgtgaggaactgatggtagattggagactctagggactctgcaaatggatgaggcctgagaggctgctggtccggtgattttcaaacaagttggaacatcacatcttgtttgagatgatattcaaatgatatttcaccagagttactctgattgaagggaagaaaatagggtactcaccttcttcctcctcctccaccagccatgaggagactctgtggagcagagtttgaaagtcaaggatgtaggctgggtgtagggcctcacacctgtgtcccagtactttgagaggcggaagcagaagatcccttgaggccagaagttcaagaccatcctgggcaacagaacaagaccttgtctctataaagagtaaaaataaatataatttaaaaattaaaaataaaaattagccgggcatggtggcacacatgctgcactttggtcccaactactcaggaggctgatgtgggaggattacctgagcccaggagtttgaggctgcagtgagccaagattgcactccagcctgggtagcagagtgagactccgtcacaaaaaaaagaagtcactaatgtgattgttatcacactgtgctggggtccgtgcaccccatgcagcaaagccaaatgctgatgttgggttaacagcaggagaaactgaggcgtttattgccaagcaaggagaattgagcagctcgtgctgatgacttgaactggcagatagcttacagctatccattatttaaaggcgggaaggtggaggttacagtcgaagtcattcagtacctgggggccacatgttggtttgacccaaacaggtaggacatcccaaagctggggaggcggtgtgccacagtcatggctggattcaaagatcttctgatttgtgattagttaaggaggcgaagctttgtctaagaattagggatcaacaaaaaaaaaaacaatgttagctctggcttttgggtacaaaagcatcgaagggagatggaagaatgtagaacaaagaacagcagtcagagtgctgtcttctgctccccccatccaagggctgtgtgccagtgggtccgtttggtgggggtccagttttctgaaacaactcaagggcatgtgtttagatgttatctttaatttctacagaaagcaaaacatctcctaacttccttgctgttgttttaacttactgataccttcttccttgtcaagttgctcatttaattctcaaggctacctaggtgcctggaattttccttgaaggaactcaagattttcctttatttccatgttagggggtgctcctgcccggggaccctctgaaaattctgtcccatggtccatccccttcattttcatgcataaaaaccacggctcagggaatatggctactatgtagggtctttggggttataaaggataaaaccggccgggcgcgatggctcacgcctgtaatcccagcactttgggaagccgaggcgggcggatcacgaggtcaggagatcaagaccatcctggctaacacggtgaaaacctgtctctactaaaaaatatatatatataataacaatacaaaaaattagccgggtgtggtggcgggcgcctgtagtcccagctactcgggaggctgaggcagaagaatggcatgaacccgggaggcagaacttgcagtgagccgagatcgcaccactgcactccagcctgggcaacagagcaagacgctgtcttaaaaataaattaattaattaattaattaaaggataaaaccaacccactcaggtagaagggggaattagcaaaagaaatctagagtatcgtgaaacgcaagggtgggaatgccttggagccataagaatactgagaacccaagattctctttctgtatctcacctcttctttctccatactgccttcatttgtttcttttccacaacacgttagactttctttgcattgcagaaaacatggccctagacgattctacagcttcgcctcttgcagctgcatgtcttctactgtgtcagtcacaaatccaaaaattctgggaaagggattcatcgactcagtgtgggtcacatgccaccctggaccaatggactgtgactggagggcagatatggggtggggtgggaggtgggagacattttcaggaacaaggaatagtgagaagcagacaaaactgtaggtaatgcaacactgccatgaaacgtgagccagggttgtgcaggaagtgtgttcaggaggaggatgcagccaggctcctgccttctacttcgatgctcctttccttcaaccaccttgcacatccgtgaaattactcaagagggacagtggctgagcttatgtccaaaagttggatatgactcatcagttccttttgaacacgtcaacctgctcctggcctggctggtctccaaaaacagccaagggtaaagaaaaaaacttgattgagtgacatttgtccaattcagccacccagtgcattaatcaccctttttatttagaagctgtaaaacagcacaacaggttccaggcgtaaatggtgttgatgtggaagagattgagtgatggtggtacccgcaggaagcaagtcctttgaatgggctcacggggagattgtggaacaagtggctcaggaaggtggagctgtttgatcagggcctaggaactagacaaggccctccagaatgcattttgagccattggccttaaacaaccttcccctgcggcagctttttctgcaggccacgttgctgccttggcagaccctcaccccttacccctggagcttttctttcacgaggaattcctactgcgagaataaacaaaggtagttggcagcatgctaacaatgcctccaggttcttagcctctgtcctgagaagagccagccaggcaacctggctttcattcagcaagggaagagaaaagcaaggtaccttttatccctgaatcatcgccacaaggccctctcaggtcaggaaactgatgtgtctcctgcttggtttgtaaaccatgtggatgatacccagaatatcaggtcctctctctctcttccgtccaaacgaaagcacttagatgtcacatgcccaccttgtaagtcctcatgggatttgggatcctcatcctgtgcacagaccttgactcatgggctctacaacattggctgtcttcctgtttaatttccctttctactgacagttttgccaattcagtgatggctttagcgccatggctcagcggcacccaagcagcttgagacatccgtggtttgggggtcatcttagttatttcatggaatgaaaagttttacatccaagatactcggcccccagtcatttcttttctgtatcaatttagtctctctttagttttggtgcatgtggttgacttgtggtagtctaaggtgttgacggactggcccagagagagatctcaaagctagtgagaatgtgtccaggttcttgtttgattttgttttggtttgattttgattgtggtcgagataagaggcttttccaggtgaaaatctcgtaggcctggcatcatacctgtaattaatgtttatcttctgctttatactctcagattaaagacagcaatggtataacagcaaggctggaaagaataaagtttactcctgttttatctctctctccaaacaccgtagtgttccagagacagatactgatagtctcttgtgctcatgaactcctagtagctcctgataagtacatttctcagagaatcagctctgagcccatttgtggggaacaagtgtatgggaaagtcgtcgattctgcaggtgttgggaacagttctgtaatgggatagcagatccctcttctgctggcggatggaggaaggatacccttgccggtggacagttgcctcctaatcaggaattatgcctcatgctcagccagggccttccaggcaaggaagccgagcaaagcccactggaagacagggctccctcgggcacaaacaagaacagcttcctgctcctctccagcctcaaaggttcatgcgccttgtccctcagataaaggtgctagaaagaaggttggtgtcactggacgtcgtctcttagggtgattcagctacttcaggcgaggggttgggaggaaccaataaatatttttgtctttgtttgccacactgatgtgaatgcttataattttattagcagctgcctgggagccaggcctgacttaatttaatttaatctcctgggttatttcagttcggtttagtctattttaagcacagatgaagaggaaataatcagaccgaggggaaagatgagggaggggctggaggggccatccgctgccctcgctagttcctcaggcttaacttgtcttgatataaagggaatgacttcatggaggcaggttagccagacgaagttctagctctcactgtgttttgtctctggtatcatcaccttgttctctaagaaaagaagcatgatatcagctttgttgggggagggaggatgggggatattaattatgccactagaaatacaaatggagcaattttcttgtgccaggcaggactgaatagtgacaccttccccggccctccctttctccttttagcaaactcactgatcactgtgttgtggtagctctttctctttggagtgttttttgttgttgttgtttggtttgtttgattttggggtttttttttttttgagacagggtctcactcagtcacccaggctggagttcagtggcgtgatcttgactcactgcaacctctgcctcccaggttcaagtgattctcgtggctcagcctcctgagtagctggaactacaggcacatgccaccacgccctgctaatttttgtatttttagtagagatagggtttcgccatgttggccgggcaggtctcgaactcctggcctcaagtgatccacccgcctcgggctcccaaagtgccgggtttctaggtgtgagccaccgcgcccaaccgtctttggagtgttttgatgccctgggattggtggtttgggaggcaggatggcagagcctccgctttgagcagtttcttctgagtgaatatgtggttcagaggcccactcagcgaagcccaaggcccaaagaccaccaagtcctgtggcctgggctgccctgcctgccctgagcccaggagctgcgtcccaaggccaccccatcatttcctgcccccagggcctgtgaggctgtgcatttggtttagtaccaggaatcatcaagaacaagagaaattcatgggcccagtcagagaacccaaaggtaatgagaatgtccagagggtttttttgttttaaacagtgattgagatgataagaggtattgccaggtgaaaatctcttagccttgacatcatcaaagaagagagattcgtcatctcatgatgaagagagattcatctcaatttcttgtttctttggggtttttgttttgctttggttttttttttttttttttttttttttggcaatgtcttgctgtttcactcaggctggagggcagtgttgcgatcatagctcaccgcagccatgatgagctgccgggctcaagtgattcttctgcctcagcccctgtagctgggactaccacacccagataattttttaaatgtttgtacagatagggtctgaccacattaccaggctggtctcacactcctggcctcaagcaatcttcccaccccagtctaccaaagtgatgggattacaggtgtgagccactgtgcccggctcattgcagttttatatgccaaccctgaaagcagaaaattgtatccccactgaagtgctggttccatgaacccaggatttttatgggtcttattcattgcagaatccccgaactcatggtgcctgggacccagcatgttctcagtgtgtgtccgaataacactggagggttttttctggatgatactgataattacagaagttaagagttattaagtgcttattttgtgccaagcactatgccaagggttttacttgtataatcttttttaatacttaaacggttcctattgcatgaaactcttaccttcatttaaatggaggcatagaggatttcaggaacttgccaggtgacaaggtggagctagaacttgaatctaggcagaacatttttatctgtgtcctgagagtttccatgagaacatgaccaaaaggttttctggtatacgctgagtcacctgcatgagtgttcattcagaaccatcctcccaacaccctgcacagtggagatgccctgagaagggagcatcgctgggcttggggctgagtgtaggagtggcaagagggggtccaagtacctcccatggctcattaaagtcacctgagtagacctgctaagcactcactcctccatgccggatttctcaaagtgtgctgctggtctacctggagtggggtagagtacttccccaccccaggcttcctgaatcagattctctaagaacaagcgcagagcctgcaagtaaattctattgttagtgagttctccaaggtggttcttaggcacctaacatttgagacctgcagctatgggtatttttgctcctagccttgcggtatgttagatttacttaaaaacatacaagtgtctatatgtttgggatggtgttggagggaatttattaaaactagagttcttctttatccagaaaagcacacacattaggaaaggcaatagcatctgaagacagaggagtggcgtgtagctcattttggcctttcctgttgaaggcccccaggttcactcttgggatgaccaggcccctagagaccaattccaatgtagtcctgactgggcagtccatcaggatgccagtttatgaatttacagagaacaataaagttgaccatgtgacttgatgagagcaatcagtgtagagaagataccaggcaaggcataatgaacccattttattgatttgtcaaattaagcaccatcacatagactacatagagcagaaatccgctttgggagtgccttctcccctacagacaaacctgaggggactcagaatgctgcctagcaaacatagaattataacaaggggatgtgataaatgttggatggcagcagactaaggtttaacattcatctcaagttagaggcggctgctgtgctgctggggccagaagcacttgaagtcaaatgcttagatgccgctccttggacctgtgtcataggctctgctgacatttgcctggagcctctgctttctcgctgctcatttgaacatattcatactggacacaagctggtcctacaagcctagtacctctcagaaccctctctccttcaggggactttgagaagctctgctctgatccaatattgatgaatccagtagtttgttgatttccaaagaaagatcttgctttcctcatttcctactacccaaggaagggagaatcacctcattatggctccaaatttcaacagatgttatataaagggctatataagtattcctgtatcttcattctttgcaaaaatgccttccccaaaatctgactctttgtctgtcagataaatgatatgtagaattttgtatcttaccttctaggagaaagagtagtcgtaactctccatgcctctccagggaaccctttgaatcccccccccacacacaaatttagagattatttccaggacaaaggactatatgaaggacccttaactatctagtacccagactagtaacgtagactttggtgataccatgaaaacgaaggcataatcatgtgctatgaaaatggattaggaagcagcttctgttcacagtagaaagaatcttagagatttccctgtccagccaactcctttgttttccagactgaatataaaaactcactaaagattgcccaagaaagtgagcagcaggacagagcaagccgaaggtccctgcccagtcccttcccccacctctgccaccttttaaatcccatctggaatgtctgcgtgtttagttcagttggaggttagggatctaggaggtaaaatggccaccaggatgatgtcaaatcgagttaaacagatacagccttggcctttaaagaacagaccacactggaggcatatgtattcatccgttcttacactgctaataaagacatacctgagactgggtaatttatcaaggaaaaaggtttaattggctcagagttcagcatgtctagggatgcctcaggaaacttacaatcatggtggaatcttcacatggcggcagcaaggagaagtgcagagtaaagcagggaaaagccccttataaagccatcagatcttgtgagaactcactcactatcacaagaacagcatggaggtaactgcccccatgactcagttacctcccaccaggtccctcccacaacacatggggattaggggaactacaagatgagatttgggtgcagacacagggccaaaccacatcaaggaaccacattcaaaagccacccacacagggacaagttaacaacatgaaagcaaaggtaagagtgtctgccatgagaactgatggtaggcagcttagatgtgaagtgagtggccaagagtaatttattcctcttccaattaaccagactttctagaaacagtggaattccaagagctacttaagaaatcgagatatccttgcatttctggattgaattgcggtaaccagttggtaacctctgaaatgcaatctctcttatgtccctctgaaatgttaagaagattcaggaagtgacagaaacccacgatcaagactggcaaaccacttactgccaccttggagaaatttctgttgcccgttagcccagtggtcaagtgttaagaaacaattatcagtggtctggccatactggatgcatgaaaaaaccaaagtcctgcacacctgaaagaaagcaagaagattttttgggcctccccttttgctcagataaacagggtcttcgaccagccaaaaaacctgggaggcactcctttgctatggagtttctctcatttcagaggaccaaaatagtgtcttctctcatctttccatacagtctacaaatagactgtaacttccaaaggaaaaagaaaagggctgttgttggtgagttatgtcctgagggttagcagctctgcaagcgaagtatagtggacacaggtgtggaggtgagaagaacttcagggtcaggggattctaactttaaacggacttcacagattcaagatgtgtaattaccaagcactgtgaattggaattaccaagcactgtgaattggatatgatcctacctggctccagcaaaaacacactcgtcattggactaagagccatgaacatcaacttgagtgccctggaagagggaagcaagttctctagtgtcccagtagacagtggatagagccaatgtggcatacaaacagtatctttgggcaaataacacatctagatgtacttgtctttgaggacaagtaaagaaagaaaacaaacccaaaatatggggcccatttttaaaacatgggagataaagggatagtatcatggagaacatatttgaatatagattattggaagaaaagaaattacagaagagtatttgagaaaactccatacacattataatagggtgcaggaggctgggcacagtggcttacacctgtaatcccagcactctgggaggccaaggcaaaaggatcacttgaggccagaagtttgagaccagcctgggcaacatagcaagttctgcctctacaaaaaaatttaaaaattagccaggcatggtggcacacacctgtagtcccagctactcaggagattgaggtgggaggattgtggagcccatgagttcaaggctgcagtgagctatgatctcatcactgcactccagcctgagtgacatagtgagaccctctctttaaaaaaaaaaaaatgcacaatctctgtaaaacaggaacataatgccatttgaacaaacaggttgagaggaaaagcaagcagaatgagattttttaaaatgatagtgggctatataaagagacagaaaagatgaaaggaagtggacaagtaaatgccagtttccagtaaggaaatttatagtacataattaaaatctttgtggtgcaacaaacagcagaattggcattgcagaaaatcaaatcagcgctgtgcaagaatcctgggaagctcttctagaatgcaggcaaaaggacaaaaccatggtgatgaaagagagaataatgaaaaatggaagactgggaacaggatataaattgagaataatagctttgtcccaaagataaaagaagaaaaaattgaaaaagaagcactaattcaatatgataggaccaaatttatggagcattcaaatgaaaaggaatgcactctgttcctacaaaattaaccaaaagaagtctgcatttagaagcattctgggctgggtgcggtggctcacacctgtaattgcagcactttgggaggccgaagttgggcagatcacttgaactcaggagttcaagaccagcctgggcaacatggtgaaaccccgtctctactaaaaatacaaaaaattagctgggcatggtgatgggcgcctgtagtcccagctactctggaggctgaggcacaagaatcgcttgaacccaggaggcggaggttgcagtgagctgagattgcgccactgcaccccagcctgggtgacagagcgagactctgtctcagaaaagaaacattctggaaaacttttaattacaaagaaagaaaacaaatgtcttttcttcagaatatataggtgacctacaggagaacaaaaaccaggttgtcactagacctctaatcgtatgcactactaaattttaagagataagaaaacatcacttacagagtttggaagaacaaagtgaattggccccaaatttctcacccagccaagttgccagtcgtggcatattctcagagatgcaagagctcagaatatacatcacccacactttcttgaaaattatttaaaggcgagctaaagaggacggcaagatgaagtaaaattaaaagttcagggatgggaagtcatataaggataagcagtaagcactaaaatcagttgaacctgttaatgtggaaaacagctatcaaaactgtaactcatataaaaattatgacaagcattagagatcccatactccagataattttacagtaacaaaaagaggaagtaggatgggagctcacagggagtaagaacagagcatgcacaatgcttcatacccttggggagaggagtcagaagatgctatctcattctttcctttggtgatcggagaaatgtaggataaaaaatgttttggggtgaatcttgagatagtcagcagtagaatttaaacaacattttaaaaattttggccgggcattgtggctcacacttgcaattccatcactttgggaagctgaggtgggaggattgcttgaacccaggaattgaagatgggcctggacatggtgaaatcgccatctctacccaaaaaaaacacagaaatgaccggtgtgatggcgtgtgtctgtagtcccagctactcgggaggctgaggtaggaggattgcttgagcacaggaggtcaaggctgtagtgagccatgatcacactactacactccagcctgggtggcagagtgagactctatctcaaaaataaatttaaaaaaattatagaaaaaataaatgcaaagaaaacagagtatagtaaaagagtgaaggctgggtgcaatgcctcatgcctgtaatcccagcactttgggaggccgaggtgggcagatcacaaggtcaggagttcgagaccagtctggccaacctagcaaaaccccatctctactaaaaatacaaaaaattagcctggtgtggtggtgtgcgcctgtaatcccagctacttgggaggctgaggtaggagaatggcctgaacccgggaggcagaggttgcagtgagccgagattgcaccattgcacaccagcccaggagacagtgggagactcatctcaaaaaaaaaaaaaaaaaaaaaaaagactgaaaacaaagcaagtaactaggagacagagggacaacaacaagtgaagctccacacgacagaggcagccaagaagtgggggggtttaagaatgtactggaatggggctgcctgtgttttcagcccctccccttgctagctgggtgaccttgtcctaggtactgcttaatctctccaagcctcagctttcctcgtctataaaatgtggataccaagtagggttattgcggaggttagttaatatgtccaaggtgctgagtaccttatcaggtacgtacttgtgggtacgaatattgaggataaggtaacagattaaactgcccaccattttcagatgggatgttttgctaaagttcagcgatatcctatgaatgagacctacacgtaaagtaaaatgacccataaacactgagaaaaaggatgggcagtgatttatgagatgaaagaaagaaagcagtggaagtagaattgccccaagtcaggaaactctgtgtacctggatggagaaagccgagtcgggggcttgtaccactaacatgcattggaaatctagaacaatttaaagtctaagcttgttgcacaaattagcagaaagttgaagaagataaaatacatggccctgaaaacagagcgaacattaacaaacagaagccacacagaccaatgggaaagatagggcttattccactaataatgttgagaagttgtctaaacatttggaggaaaataaatgagatcttctttcacactgtacaccaaaataaatttcaaatggtcttaagagttaaatataagaaagaaacaaaataattaaaacttaggtgaatattaagctaatctcagaaagggcaaggtttttgtaagcctaaaagaaatggaaaaaataaaaggaaatgtttgacagatttaactacataataagttaagcttctctgtttctagaagaatggtgacatgtaacacagtttgcagcaactatgacaaaaggcttttatcatttatatctcaacaactcttctaacacagtaagaaaacttgttactaccttctagaaaacttgaataaggagttaagtcaggcagaaataaatacaaatgggcaaataaccatggaaaaaaaatttaacctcaaaaataagaaagtcaaaattacagtgttattctttacttttctcaccacttcttgatatggttttggtaggattgtggtaaacttttagaggagtaatttggcaatgtatgccaagaatcttgaataatttccatcctttaagctacttccaagaatgtattcttattcttctttgcatcagaaaatctgtggcgttcttaaacacacagggtatgatcagacttgcacagcataaatagaacaagaaaaaaagtatcagaaatttcaatgaatatttatgcatgaagatgatcagttgctatgttatttgtaaaggtgaaaaatgataaactttgtagatgcccccaaacagggaattgattaaataaattctgattagccataaaatgagatgttagacatttaaaatgttttcaaagcatactttgttataaaggcaggttctaaaactttattcctagtgtgatgtgaattctataaaaataaatatttcaatgtagatagatgtggaagatactggccataaacatgctaatgtgccaatgttggttctcccatgcagaagtatagttgttttagttttcttctttatatttttatgtctttaaatttcttgtatgatgggtgcacccgttactcctataataagaaaaaaattttcttaaatatcttcctacgttgtttatgcagaatcgtttcagtctctcataacctgggaaatatttctctcacaactaggtttcattttcttttgaaacatcagaattatagaactttaatgtaaaattttatgtcccactaattgtaaaagggaaagtaatgaaatatttatgatctttttccaaggactaaacattgttgtttctcatcttataccacagtcctccgaattctcttatgtaagttttgttccagtagaattttggttgatgagttgccaacctgtgttttctggtacgtgaatgggacagaaattcactcttatcaccaagcagccagcctcaccagcaaaatagaatattcactaaataggttccaaataagaaaatggttaatgtccctcagtccaggtttgtgtacagggccatatgaagctgtgaggcgatgtctgatcaggtgtatttttagtgtatctcattattcttgcctttgtctctggtaataaggaaacaaatatcacaaaatttaggggtcattatttctaaacatgaaagagatcacatcagaaattctgcaacattcataaacacagacggtgtcagcagacttgatacagcataaatagaacaaatgcagtgaactagacagcacccagacccagtttgtacacagaatctcagtctataattacccagtcaaaaattgttcatcgtggttgatgacacctgtgcattttatttcctgaaatctagagaagttccacgtgatcactatttaaccaagagcaaaagtccctttctgacccatttttcctgtaagtggagatacatcctgtgctcttttgtctttgtgggtacagagattctttcttcaaagcatttaacattttcaaaaaagtgtgccactccttttggcctggctttcttcgcccgtgaaaaggcctgggtggtttttccttgtccaagagtccctccaaatggacgctttatgtactgcaaccaagagctgagaagtttccaagctttcctgtctgtgttagcattccggtcattcagcaggaatccaatgagcgcagattttatcttgtctgtcctgtgttgccctgggggagtgatccctggggatgcgagggggtgtggcccttgccctcaaggtgctgtcagtctgtagacatggaacacctttgggctgggctaggctggcaggagagtggaagggcagaggaaatgggtcttgtgcaaggctaagggctgacagcactgagatggatggaggagtgtccccagcgatggggcagtgtggacccagaagcacagagcaaggtgggcacagagatacacgtgttcagcagttactcagttcacgcatggtgctgtgctgggcagtaggggttcaaaataactaaaagagactaaccttgttggtgtggagtggttcttttgggttatataaatactaaatgtgataggttgcatgcagttaaatatttagcatatagaaccaacccatcagaaccaatgccagctcctaagtcataccagcatctgctaggggaatgtgggccagaagacggagcgtcactgacatttagatagaggtgttcaagtaaatggtaggaaacagattagaggcctgttttccatgttgggagcctaaaagatacagtaaccaagtgccactcaagctgtggtagagaatatctcagttctaacttgttaatgggagaagaatatgattttgttgttgcttctggccaaatgattccagtgaatcagtctgatgagtggcagtgcctgggctgccacccacaaccaactctcacctgtcctgtcgactcttcattgttcatgcttgagaaatcagttacctccttatgccatggagggcctgactgcagtgcacgcccaccaatgggaagtcgtgcccacaccagtggcaagatatgccaccaccatcatggaccaaccacccaacgcctcctatccaaaggcagatcccagcaagcacttgctctctgttgccgggacttctcccagctccaaaactgccttagtctgatctattaatatatctttttaactgggtggctcataaacaacagaagtttacttctcacagttatggaggctggagactccaagttcagggcacaggaagactcagtggctagagagggcccatttgccgacagccccacatcctcacacggtggaagggcaaaccagctcccttgggcttctcttataagggcactgatcctctccatggaggctctgccctcctggcctaatcacctcccaaaggcccctcctcttaatgtcatcgccttgggggttaggatttcaaacacaaattgggggcaggaggcacaaacattcagaccacagcacagagctcttcccatccccagccgaagtaggaatgacccagaggaaggctgctgtccctttgcacacaggttctgaaagtgcgtggagagaggacgatccctcggtccctgcagaaccaggctcttgaagcatatagcagaggttctctacccagggcctaccctagaatgtcatcaaaactgcagtgttgtattaaaggggtgcatggcttagagagaatggagaatgcccagcccagaggcccagagtgttttaggatgtgcctgttacccaaagttaaaatctgtatgcgtcaggagtgacacttgggagctacacttcccaaccccctctcctgcggccaccggagcctgcctgggccccttctcctgaaacggccttctctgcccacataatagcccctagcgatgccagttctggttcctccgcggggtcccacgccagctgacccagcagtacctgtaacgtgtcccacccttgccagggtttgtgtgcctgcatggttttagaggttccaagtcagagcccctaaaccccttgccttattgctagacagcttgaccgcccccggaacatcacgtgggaagggcgctcggtaaatcctgttctggaggcaatctgtcactccaccagtttcccaatcaacatttgccgaggagttctggctcccggtgcagaactgacttgtggcgacgtgagggaactggcagcttcttagacccaagttctccctcgcagcatcgtcagaagaggcccaaagtagagacgcaaacaaaccctgagaacagcgtgttcttcccagtaacgtgaccgggaaaatgtgagccagaggaaacttgagagctccgtggtgcggctgagctggtggggtgagggttttttccctttttctatctggtccagcccatcggccacttgagatgctcctgaactgagtaaccaagctgttcggagggtactttctcagcaggacaagccctgagctctggaaaaacgcagctagaataacgaggaagcagaggggcctctcccacaccaggcttgccccgacaggtcagcttgcttgtggcccagcgctactgcgcacatgttcctttaagatccctatttccgaggcagccgtggcataattaaagaatggccctgtggatgtcctacggtgctcactgtttgcacttgcttctgggtggggctaaggtgtgggaccggccggggaagcctgaacaaggtggggttggccaattgcaacaggtcacagccagatcagataccctgaggaggaggctgtgagtcatgtttgtccagaagtgccaactgctgcaccagaaaagccgggagaaaagaagcaagcgtaaggtgcacatgagaggtgctggtttctgaaggttctgttaagacaggagaagatggatcatagttcctgtcaggagacacaccctctcccccgacccccagcccagaaccccttccttgctttatagcacaaggtgaaagttcagaggctcagctcaaagcagaaggaacctaagggaagtagagcgtccttttttgtgtcactttctcctcaaacaactcactgtgttggtggggtagtgtttgttctatgctgggggtcagcaaactacggcccaaggtccaaatctggcccacagcttatttttatttatttatttatttattgagactgagtctcgctctgtcgcccaggctggagcacaatggcacaatctcggctcactgaaacctctggctcctgggttgaagcaattctcctgcctcagacccctgagtagctgggactacaggcgcacgctgctacacccggctaattatttgtattttaatagagacgagttttcaccgtgttgcccaggctggtctcaagctcctgagctcaggcagtgcacccaccttggcctcccaaagtgctaagattacaggcgtgagccactgtgcctggcctattttttaaataaagttttattggaacacagctgcgttcgtttgttcacatatcgtccgtgtctgctttcgctatgcaatagacctgaatagtggcagtagagactttgtgacctgcaaagcctaaatgactggtgatctggctctttttagaaaaggtttgctatctcctattccacactaataggtgaacctgaatgcagaggtcaccttgtgaggaccacacagaggttaatgcccaggccccctgaggcaggactgagttgcactcctgactccatcccttactaaatgttcaaccttgagcaggtttgttaacatctgtctgccttggttttgtcatctggaaaacgggcatctgagtcattatttcacaggagtattgtgagtattaagtgagtgggtgtagtaaagcacgtggaaacctgtcagtaaaggcctctttgttaattcagatataactcacaggtcataatattcaccctttaaaaatgtacagtgtagtggttttcagtatattcacaagattgtgcaatatacaccaccactgtctaacccagaacattgtcatcacttcaagaagaaattcctcagtagtacttgtagtaggatgaataaccaccacccaaagacatcagatcttaatccctggaatctgtaaatgtgcccttaatttggaaaaagggtctttgcaatgtgataaagttaagcatcttgaggtggggaaattcttctggatgatctggatgggccctaaatgtgatcacatgtgtattcttagagaggcatagagagaaattacaggcacagagaagaaggtgatgtggccacaagccaagtcatgcctgccaccactggaaggtggaagaggcctggagtggattttcctctagagcctccagaaggaacatggccctgcagagcccctgattttggcctggtgatgtggatgttggactcttggcctccagaactgcaagagaatacatttctgttgtcttaactgggaagtttgcgtatactttgttccagcagccacaggaaactgaggatacctattgctaagattactattgatgtcatcctgctagcagaaggtaggccagagctagattaagtcctgtgatctgaactggggcagtgtgagctttagcatactccacttagtggtggagaagcctacttaagccaacaggcattcatctggcaggcaccccacaccttttccccacaccacttacttttttgtttcctcctgcatagggctaaacagtccttgttgactgaaaaaaaaaaaaaggacagtcccagccacccaacaggcttctcgtagtatgcacaccactgtcattgggaacatgactgtagggaaatgaacactgttttagatacatttatgctattttgtggagtgtcgtttttccttggtttcaatatttgttttgtggccttaaaaatctctacatcggtgcagatttacccagcccattttcacacccactgcaatcttcttttccctctatgctttccatgtgctgtttgtcctagaattggtaactgcagcagagagagagagaacccacaaagcaccatttcctctttggtggcatggttgctgggtactcactggctacgtggtcactgggtacatcatggtcttcattgattcagtccctggcctgttggttcttaggcagatgtcagcacattccagctgtagtgactggagcaccccagtgtactaagaggtttattggttttagaattgcatccctgaagctactacactcacaccttttttttttttttttttttctttgagacagagtcttgctctgtcacccaggctggagtgcagtggcgcaatctgggctcactgcaagctctgccgcccgggttcacgccattctcctgcctcagcctcccgagtagctgtgactacaggcgtccgccaccacacccggctaatttttttgtatttttagtggagatggggtttcaccgtgttagccaggatggtctcaatctcctgacctcgtgatccacccgccttggcctcccagagtgctgggattacaggttgagccaccgtgcccggcctacactcacacctttaaatcaggtgcagcacctttaaaccccttcactaagttcaaggcaccaaagcacagacatagctgtgcaggctttgcctgccttcccaccactcctctaggcacacccagggctcaatacagcactgcaagatgtgtgttcacttttccctctgtgctctttggccacccatctttctagtggaagagtttcctttcctcctcgttctcctgagcaacgttttcctccatcccctcctagctgaggctgacttcaccacctcttctctgggactttgtcttgctcaagtcatttcaatacatcagcaagcgaaagtggagttttgtacagtcagaagcttgcccgagctcagctactcattagctttgtgtggtggacaggttatttcacctctctctgcctgaaggccctatctgcaaatgggcttgataatagcatctttttacatgaaattaatttatggatctaaagtcctttgagagaacattctggatatctaataattatcaaaataatgaattctctgggttcgaagtcattttttattcctcaaagacaaggctcatgggttgtggaagcgtccttcactccgtggcctggtgttgaatgacatgaagttcttttgaccacagacactaaatctcgcctgtttccagcacttacctgcccttccaccaacatttttgcattcacatttcttttgctgtgggtaacttcaaacaaagaagagtttgtttgtttgttttttctgcagtgtcagagaacatttttgctcatgcctggtgtggagtaggattcgagaattttgtttactctcgcttttgctgtcaggcaggggtggaggtgggaggtgtcacggggtcagcacagactgaacaatcctgacttttgcagtaattctgttttgagcctttgtccttgtttttggcttttaagtagaagccaggagcaggggtgctcttagagggggggagaaaaagtaataaaaacagagaattatttcctaaagcaaaacagatcatttggagggccatgttgtccttaaatatggagacacttgacttttatgcattactaaacagtgtctctgtatagacatgaaccctttgatgggcagagtcactgtgggtcagtgctgacaagtctggtcctcaggcaacagggatacagctgtgtcctcaacaaagcttttggtgtatgtgcccgtggatgaatccttcagaacctctgcatgaccttactttgacccattgcccagctagagcaccctcagagtgaaattaaaaatccacattgggggtgggggaggtgggaaaggggcacacgctgggtaggttcagcagtgttgccaccgatctagcttttatgcaaggcagtgagtcacaggtgtttatcattccaccccaccatttatgctacatatattctctggattaagaaaccacctggagggactgggtgcagtggctcaggcctgtaatccgagcactttgggaggccaaggtgggtggatcacttgaggtcgggggtttgagaccagcctggccaacgtggtgaaaccccgtctctactaaaaatactaaaattagccaggtgtgatggtgggtgcttgtagttccagctactcaggaggctgacgcaggagactcacttgaacccgggaggcggaagttgcagtgagccaagattgcgccactgcactccagcctgggtgacagagggagactccatctcaaaaaacagaaggaaagcatctggaccgttctctgaacggattgcattgatctgttggatcagtggatccaatggatcaaggattgcattgagttatttttttttaattgcaaattactttggaacacctagttgctgactgtttcactgtagcctaatggggtctgttaccctgaggaaacagccctgcttctggggtcagagagaactgaatgaaagtgggagtagtggtggtgacggcgaagatgataaagatagcaaatgcttctttaacactaccattagtaataatagcaagtatataagacttactttgtcctgggttctcttctaatgctttgcgtatatcaattcacttagttccacagcaaccctatgggttcggcactgttattttccctgttttacagatgaataaactgcgaagttgggtaatttatccaaagccatacagctaataagtggcagggcagagatttggccctagctgcccacgctcttggtccctaagtgatgctgcccctgagaagtcacccaccacctgcagcacccattcacgtgagatggcctgactttcccctgtgcaccatcagatgtgtatccctcactcgggtgcctgcaagcctttgtgagcgcaccttgcttctctcagggaaagcatagcggtcactcccgcctggcttcctgtctgggtccacatctccacttttcatcaagcaggctcttggcaaaatcactggcttcattgcctagcctgcactgtgccatctactgtggtgcacctgtggcttagattctccaatccggctagggcggcccagtcctgcgagctgaggagcagcccatctgcctgtatccccactccattcctgaacatttacttacaactctaaaactctcatgtcctgggttcccgagccacctgcatcggggatcactgggtaggtggttctccatcttcatcatcttatttgaatgggctttatccagaaatgacaggttacatgatcaggaaattatataaccttctaacccaggctggtttttctcagtgccgggcttgacagctgataatttcagagcagccatctgaagccaaaaaaatgagaatataattagtattctgtatttctattaaagttctggaattacagaacagactttctattctgaaatggccagtgccgtggcacagatgtatttcctcagcagatgtctcctcctcataaaggctgcagaactgctaatgagctgcaatagaaaagcattcttcccgcgttccctgccagggccttgggcccatttgggcagacctcggggagcagtcactgcttctgcagctgaaggagcaagggaagtgtgttgtttctatactgttgtgtttagagactacctgtcttttgaaagttgagttggcatgatagatcttttaaaaaaaaactcattttcaatagtgtgtgtatctaagtagtgtgattttgttgttgttgttgttgttgtttccttatcttaattctgtgggtcaaaacaatttggttcttgcagaaagtgaaagacaagaaatgagccgtgggacctgtgctgggtctgttcttcttggacccagtattgctcttaggctgtggaacttgctcttgcttagtaactcggaattggcattccctccaactgtgcttcccaaatgtgggatgggaccactgatgggtgtgacttttggttgcacttgaggtgatttctgaaggtactgtacggatgttaaaaagcattaaattacgtgatgagttagttattctcaattttctttcaatctcagttgaagcagcaaagacttctggggctggaatatccttaacacactagcgcttgttaatttcccctttgtagctaagagacagaagatctcaggcaactggatccagctagaaatgaataacatctattttcattgtgtttacttttatggttaccttccatttatggcaaacaatcttggttttctgtttcctatagtgatgtgtttcctttttaaatgatggatattaaaaagcgagccaatttaaagaaaaatgtgaataatagttgaagtcttcaaatgatgtcagtgtgctaggccagggagcacacttagagagcaaatgctgggtgcagtgaacagtgcctggacctggcttcacctgagactcacctggggagcttaaagatcctggtgcctgggtgtcaacccggaccaagtagatctgactctctgaaggtggggcccagggatcagtgtttgactaaaacatcccaggtgtttccagggtgtagctgaggttgagaatgtctgcccacctatcctggggcagcgtcctcaccctctgactccatatctttttttgggggggtcggggggatagagtctcactgtgtcacccaggctggagtgcagtggcatgatctcagctcactgcagcctccgcctcctgggttcaagcgattctcgtgcctcagtctcctgagtatctgggattacaggtgcccaccagcacgcccggcttctttttgtatttttagtagaaatggggtttcaccatgttggccagactggtctcaaactcccaacatcatgtgatccacctgcctcagcctcccaaagtgttgggatttgactccacatcttgatcacatctttcccttgtttctctcttctgtctctagcccttgttctcatccgcttccccacttcaattttcctcttattttctctttcctagcttccccagcttcccctcttccatcttccttacaactattcctatgagtaatgccccctagcattgcctcttagcctgacattcttgaaaccatacagttgaaaccctgttagaacattaccacactgtactgttttccccggcatttgcttaccactccgtaagctgttggtgcagtttctgcacatctaagattgttctccaccagtaacttgtattaagagcaattatgatcatcactattgtgctctcaccgagtgcctatcactgctctaagcactttacatggatgagcctacataatccttgcttgaaggagatataattttccagatgaggaaacttaggaagataaaatagcttgtccacaaccacagagtggcagagccagaattcaaatgcaggcagccttgccccagatcctacactctgagcagatgggaccctaagttagttgctcgtaatcctgattcaggtgtcctggcatgccatgagtcacactcacacaggctgttctctgctgtgataagaaattgaaatttggacccactatttgcttcaatgacatttagaattgataactctttttattttcaacttaaatggtagtatctcagtaggacactcacagctttaaatcccatcaagattttaactcatcaccattccgaagagatcttacttaaatgattttttttgtgtgtgttgtctgtcaggaatataaattgaagatataaaagccagcacccgcaataattctgcaactggtaggaggcaacccaggacctcttggtgaccttaataagggtcttctttggcttatccaggatgtgaccttctgcagcctccagtattagacattccagggcattttctgccttttaaaaagcatctgattctcattctggtgtttaatcagagagagaccgttggcctctttccattcctcatgggagagctccatttttgtgctcacatttttcatctttggtgatactcagggttgatgttttagtgggctagactttctgcattggattaaaacctttcacatgagcttggtgaattctccagtgaccaagtcccctgggggcctccaaccctatagattccagcatgataagagtggaaaggagtccggaacatcatgcctggggtatagtgagcactcacaccatggatttattttttcattttccaagcccccaaccatgtaaggtattttataaacattattttatttgattctcccaacaattctataccactggaattatgtccgtcttcatttttctagatgaagagacagaggctcagagactaagcttcccagtgctcagggttacatggtgaaggaggcagagtttgcatgtacacctgctgagccacagggaccatgcctatgtgttttatttgtgtgctatctgctccctgagatgaatgaggttagatattttcttaggagaagaaatacttggaaggcacaaatggggtatgacaaactatgttcagcttctctgtggctagcagacctgagctagccccctccccctctgtatttgaatatagtcccatctgttacctacctatgtaaggcttccaggtaaggaggatgtaaggctgttggctggcaggaggcagaacacagtagatccacagactagtaaaggcaatgcctgtctctgacttccgatcttagggctgtacctccctcatttgtgtccaaagacccaacatctttagggttctccccctgcctcctccccatctaaccctgcccactgacaactccagtgccttcttctcaagttcttctgtaattcttaatttaataatcaaactatgctgataaactatgctaattgcctagatctgtggttctgcaacttttatggacatcagaatcacctggaggcttggtaaacacagatcattggacctcaccccagagttctgattcaggaggtgttgccagtgccgccggtccagggaccacactgtgggaaccactgaatcagggagcctggtcccagttatatgtgtgttgatggtgtctgaccagttgggtatctgataattcagccttactgggaaagatgccatgggaagataggaaggcatttgagataggagactcaggcttttgtcccttcatcatagcagtagataattatcttttacgttgacgtgcagtggctttagacagcttctcatggttgtgagcctctgccagctcttaaatctttgagcctgttttcctctgtggatgaaatggcctttccttctaattatttttgattcccatatcaggtttctcaagctaagattgcattggaagcacctggaggtcttgttaaagtgaggattctgagttattaagtctgaggtgggacccaaggttctgcatgtctaatgagctcccaggtgatatagatgctgccggtccatggaccagcaattctgagttacaactgtatacagcagtggtgcttgcccctgctgcccagtagaatcacccaaggagcttttaaaaacgaatacttgagccacattccttggagattctagtttaattctggggattagaatttttaactcccccattccccaacccccatgtgattccaatgtacagtcagagttggaagccattggcctttacccacaaaaagggataacaccttctgggagctcaggtgcgtgtgtggcaccatagaccaggttgggctggtcgcttccatgcagggagggtgcaccattactcctggggagctgcaaaggtcacctgggaatcttgttaaattacagattctgctttggcaggtttggggtgggacctgggtttctgcatttctaatagatatcttagtgttgctgatgctgccagtccaggctggtgctaagtcccaagacccacccacaagggcccacacgatgcccattatctctgccggtggtggcagcgggtagcttttctcatgtcgagtgttagaggcttttggcttccaccatctgtctccttaaacgccattctgacgtctcttttattcagcttggtattgacacaagacagcgggcaatataggtctgttctctttttgtaatattttcttccttctctcttcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattgtaagtggtctctccttgatcaaatttcattcctatacaccatgcagttgcccacctcattatttgaggtaatgaagtaggttcattataaacgtctttaaacatgtcttcagtcctaagacctcctcaggctgccattagggaggtagctattagcacctgttcgatagatagtaatttgatttatcaagagttgcataattcaggcctcagattattattatctaatctggataaacaattctatttaaggaaatagaattaaggtaaatagaatttaagctaaaaatgtgtcaggtgtgtccacctcttgatggacttaggttcttttgggagttaggggagggcataaggcaagaatttaaataatttttagaccacagaatgagtgagtaacatagaaagtgttattgccactgaaatgggaagatcattcttgccttcaaagagagaagacttcctggaaaaggtgacatttaaagccagcctgggagggttgccaggatttcagaggtagagaaggggaagaaggaaggagggaataaataaatcaggaggactgagtgtagctgagggaaagcaagagttcccctttgtagagtagtatacaggaagcagtttttctgtggacaaccagaaaggtagctgtctgttctagagggaccagcaagctctgctctataaaggatcagatagtatatattttaggccttgtgggtcatatagcctctgttgcaccggtataactttctagtgccaaaggagccataggcaatatgtaaacagatagccatggctgggtcctaataaaactttatttataaaaatagacagtgggatagatttggcccatgggtcatagtttgttaactcctgtagcgctttgcttgccagcataaggggttggtattttactggaccaggaagacaaatatactatttctttatctcaggctcgagtcatatacatgtggtatctcccaagaaaccatgatcaagataacctagtgtttgcatgtgtgtgtgtcttgtagcaaattgaaaccttcagacaaagaccgacgactgtctgtagaaatctgggactgggatcgaacaacaaggaatgacttcatgggatccctttcctttggagtttcggagctgatgaagatgccggccagtggatggtatggaagccgcttaggttgagtatgtctcaaagcatcagaccatttagacagttaggtttcagtctctcaaatgtcagttgaggctggacatggtgcctcatgcttgtaatcccagcacttcaagaggccgaggcaggtggattgcttgagctctgaggtttgagaccagcctgggcaacatggagaaaccccacctctacagaaaatacaaaaattagccaggtgtggtggtgtacccctgtagtcccagctacccaggaggccgaggcatgaggatcacttgagcccaggaggctgaggctgcagtgagctttgattccgccaccgtcccccagcctgcacaacagagctaccctgtctcaaaaatataaaaatgtaaaaaaagtcaaatgtctactgatctggctgtagcctctccgtaggatgcgtttcacaaaaccgctcgactagaggctgcaggaaaggcttgttaaacttgcggtggtaactcttcttctcccgtccttgaaaggtacaagttgcttaaccaagaagaaggtgagtactacaacgtacccattccggaaggggacgaggaaggaaacatggaactcaggcagaaattcgaggtgaggataacaaaatgcccggaaacacctttcctttagaaagcccaacttcaggaacggccgagatgttgtggtcacatttttgaaaagcaaaaaaaaagtaatctcaatgttaatgatctttttctttatttaaaaacatgaatgttgttcgttccctttcctttgcaagctgttgactttttatgactcttaccacttagaaaatggaaactggaaatatcgcagaactgagagcatggttgatttctgcataagagatctgtttgcacatcactggggagagaagcaggctctgagggcaggattgttcttacaaaggaggacttgtgctcttctgaaaaggaggaagtcattttggcctttccttgggagctcatttgtgtgtaatcaggctatcatctgagactttttttttctacagaaagtacaaggttcctaattttgttctgaaagagcagcttaaacaaatatgcctttgtgtgtgatccctttttatttatgctccagatgtttagcaaaggccacctccttctcttcttcctcttggtatttgtgtttgcctctgtcccggattcactggtctttttacttctcctcctctgctccttactcctctttttcttctcctctctctcccttctcctcttcatttaccgacatctcagcttttagtaaacggttcttttctgtaagcaccttccttatgttttaaaggcacaacttctaatatttgtctgtttctctaatcacccttcattttggctgttcgagggactcctagagtagccttttcagtctgtgtaactggttaattccttcgtgaatctttctcttcttcagacttgttagaattccctggaatttccccgctctagagcagtacacgtgcacacgcacacatgtgtgtagatgctgaactgctactgaaatgttgacactaatgggatgctgatgctcctcttttccttcttctgttgttctccaagaaacatacagatctggggggtggggaagagtggtcttggggggataataaacctccttcatgccccccacaaaagaaacatataggtcttatccagagagaatgaatcccaaaggatgtaaaacatgcagttgttcaaattactttgttaaactgatgtttggttaaagttgatgtttgtggcaaatactaaatggcaggggctctttggttagatgtccttgggagcacagacgagtgaaatgattcacagataataaatggcaatgaacggcaggcctcgggattgaagcaggagggagtggtggagactggggtgagctggtaagcttcagctctgtctgcaggtggcagctacggctaccctgccccactcgatgtttctcacaggcgagtccaggccctctattgccggatcttccttcttccagagaagccagaaatccaggtttttatatgatacattctgatttatcttaatgttggcagagttctaatgttaaaacttagaaccaggccctgtgcagtggctcacttctgtaatcccagtactttgggaggatgaggcaggcagatcacttgaggtcaggagttcaagactggccaacatggcgaaacccaatctctactaaaaatacaaaaattagccgggtttggtggcatgtgcctgtactcccagctactccagaggctgagacacgagaatcacttatacctgggaggcggaagttgcagtgagccgagtttgtgccactgcactccagcctgggcaacagagcaagactctgtctcaaaaaaaaaaaaaaaaaaaaaaaaatttagagctgtccggatgtggtagctcacacctgtggtctcagcactttaagaggccaaggcaggcaggttgcttaagctcacaagtttgaaatcagcctgggcaacatggcgaaacccagcctctacaaaaaatagcagggtgtggtggcatgcacccataatcctagctacgagaatcacttgaacctgggcacgagaatcacttgaacctgggaggcagaggttacagtgagccaagatcacgccagtgcactccagcctgggcaacaaagtgagaccctgactcaagaaaacaaacaaaaaacttagaactctgtgtaggtcaaatatgcatctattgctttagacaccagtaggattcaaccagtaagaaccagcttgcagtctctgctcttcaaaaatagagaaaaaataattttaaaaaattatttgtatagttatatatattacaatatgtataaataaaaaggtgcatgtatctgtgtaactactatttgtctatctatcaatagagagaaaagaatgagattcttttcaaagatgctttataatatttagaggaattcaagtacaaagatgaaagtcagggtttggggcaggttcaaatgtctatgccaggcatagctccttttcaatttgtatttcttcccttgcttcattatctgtttccacccctaccctgcagctgaggatgcagacctggggtactggacaggaccaccttcttgagccccatccctgatgtcacaccacctctgtgacggatggatccttctagagagagtttcaggactgagtgccagcattcttcagctgtctcaggcaggggaggaacctgaggagccagaaagaaccttccttaccgaatgttatgccatggtgttgatcacgagcagtcactgggtcaggggctgttgacgcagaaagagtgcattcgagggaggaacagcacgggcgttccccacagggttcctcacagtaatgtctgagacttagctttgctgctggagaaatattgacccactctttgtgcttcattgtcgtggcttcctggtgagtaaacttcctgtttttctgggcaatgagttcagctttttataaaggtcagagttctaaacaaacaaacaaaatacaggccagaggacctgagcaaaacgaagcatttctcttgggaggctggtcagaggccgcagggctgttgctgcttactattcctcctcctgggagggctgtggacttggcaggagcgccagcccaaggctgtgagcatcctggggagaggtggcatcagcagagttgcatggggtggaggctctgctcttcagcctagtgaggtctgtgtttggagcatctacatgaactgcattctaacctttgctttaaatacctttcagcttatagttcctagattttactcaaattacattagctcatttgcttagagcattttaaaaaaacacaactgcaagagactgggcagaaagccactagaggatggcgtcaaaaagatgctgagaattttacgacagctgccatgcttcattttaaatacatattcagatctgattttaggcaggggttcaatcacgtaatggtgttttgttgaggtctataaatgtgagagttgcaagacttccccagtgccaagttactgggaagggatgcaccagggcagaaaggctggcatccacatttgagcagttctgggtagcagccaggctttgcaaacagggtgccatcagttggcatcaggtccaatttgaggcacctctttgagcccccaccccgtttcctccttttcggtctgtagcatgagtgcttcccagtgtctccaggctcccctctctgggccctttctcgccaactaactgccattctaacttgctttccatcacattagtcttttcttccctacccactctttcatagatactttgccaccctccagtaacagtttgattcagctgagtaagatttttttgttaagttcaatgatgaatctgtattggttgaaacacacacgagggttcgtcctgttgggaacaggcatcactcagtgggatcacacagtgtccagtctgtccttatccttccatgtccagccctgttttctaaaaagggttccctccatgcagttttcgaatccttctccaaaaatcaaaagtcattcagttggatgaaagggaaaccaaacgagcatttacaactctgccactgcattagtattcattcgataattaggtggaaagtttttgcaatttaaatggttggttctcaaatcttggcaaacagaatgatcagtgactggagctcttaggagccaaggaatattccagggtggctggagatgaccttcctcgctggtagagatcctgctagagcagttcatcctcctacaagacaaaacaaaccagaaccttgattgcgatactcatggacagtgtgtctgtgggcctttaatctgttccacgtttgtcatcaagtaaagtacacgtggtccctgattcacaaacataaataatgcatttttccatttgttaaaaaaagtaaggtgccagcagtgggctaagcagacagttcctgctttctttggagcttacgttctgtatctatgggccctgctgcaaaaatatttgggaacaaagcagggagcttatcatatcccctgtgctggccagtgattcccctgaatctccaggcactattgaggacaactgagattcctgtttttccctctcactgcttggtctctgctccctgtgatgaggctcacggccagagttgggaaaaggtccaccttgcgttagaggcagtgcagaggatgggttagctctgctcagcaaactttttctgtacctagtcagataataaatattttaggctttatgggccatgcggtgtctggtataacattcaagtctgccgttgcagctcaaaagcagccacaaatacataaacaaatgagtgttggtgtattccaataacacgttacttacaaaaacaggtggcagaccagaattggcccaagggccagtttgccaacttctggtttagcccgtaggctctagaatcaaatcctagtttagtcacttatttactatgtgacctttctgtgcattggcatgcttaactataaatggaaaaaataggtcaggataactagttctgtttttctattagttataaatagaactaatatcctgatacgataggatattagttgttgtcagggaagtaaatataataccacagtgagaagtcagcttgcactgatccttctcgattcaatggtttgatgttgggtcccgattacaaactgaaaagtaggcacatataaaagatgatttggccaggcgcggtggctcacgcctgtaatcctagcactttgggaggccagggtgctggatcacgaggtcaagagttcaagacaagcctggccaagatggtgaaaccctgtctctaccaaaaatacaaaaaattagccgggcatagtggcgggcgcctgtaatcccagctactcgggagactgaggcagagaattgccggaacccaggaggtggaggttgcagtgagctgagatcgtgccactgcactccagcttgggcgacagagcgagactctgtctcaaaaaaaaaaaaaaaaaaaaaaaaaaaggatttgatgtaaaccacacgaagaatcaacacaagtataatcataatgattgttgcagctaataattcattagagaagtgattatgttaacaacagaaacgtcacagttgattgactactgattgcattcacatgaaggtccagtacttttgttggtgtaatattgccctctgatcttttacaaaatctgggatctgaatcattcacatcttgagctgtacccaggaagttacatgctacattcacatttccaatggttaaaaaaaaaaaaaaaaaaaaaaaaggtatcttctagccacatctttccctcttttaagacagttcccgaagttcttattgtcatttgcatttcatttccatggcttttagtaagcttagtatttttgtttcttgtttatccgtcagttgattctttccctgagcctacttgggctacatctaccttcagagccttggagttgtcctagaatcaagaaaatgggctgagaggtaggggaaggggaaaggtgaggggaagggagttctgggaccagtttctaggcctgcctgggatccagccatttcctatccccagagttacattccttcctttcctcagcgccccttcctcttgtgcagagcctttctcctaagcttggcccctcttccctagggctgtttactctgtccaagaccttcttccccaatcctgcaacctcaagagaaatcaagccagaagggcaaataaccccagccatggacctggctccctggggctgagggcacttcaggacaagtggtgaagaccacgtctcccttctccaagcttcagatttcacaaaacgaaacatacgtttgctcattttgctccagtatcacaatgactacttttaatttgcattttgatggcttttagctgggaatggactttcaacgaactcatttctacctgtagggttgcttatctactccatgtgctgttaacagttaatggagattctaatattaaaaagtcaagcagctttccttaaatgagcctacaccattcaattttgctcaattgtccaggctttttattgtttttgtcatttattatttcgttcatcatttaaaaaacagagcaaattaagaagctaaaagcgccttggccttttcctcctcttactgtaaccgtaacttttgctgcacaccattgctctattccagagcaagttaaacatctaatatttaaaaagccaaaaagaaacttgtagcagaacaaagatagctaagaggcagcacacctggggctttgtctgcgatgggatatttctgttgtcagaatgtaatgaaaaatgatgtcccattagaaagctgatggataatatatcacatattactcatttgagtatcaggacccaagaaaacaagatgaatttatttaaattgcaatgtcccttgaagcttgtatgagctctctaaagggaaatacttttaaagttcttataaagagagaaatttatagccaagtgtgaaaaatgaagtgcagttttgaggaccagttcccatcctgtcccttcctggggagcaagaggtgtgatgttgatggagcagtgatgaaagcagggggaatcatggcaaacacccgctgtgtgatgattagatgctaggcagtttccgtgctgggcatcgtatattcctttcatttgagaagtggtattgcatagtggttagaagcctcagtgttggacccagacttctaggttcaaatcctgccccttttatatcccagttgtatgacctgggacagattactcaatgtttgagcatggtatttttctagaaggaatatgcaatttaaaatagccatagtttcatatccctgctctaccacttcccagctgatgatcttggataagttccttaaactctctgacctttgttttccttgtttacgaagtggagatgataatagagactgccgcataggactgctgggaggattcactcagttcacttacgtaagttgcttagactagtacctggcatagagtaagtgcccaataaatgtttgctaattatatgaaatagacatgatttgcccaagtttggttttgatttatatttatgaaaagttatttatctgtgcaaatgaggtgctaccaagaggtaagagcattcttagaactctgttttgagcattagaaattgttatcaaggacttatttctgagaacagaccagtggattggttgttccaacatttatggtttcttagaacctgaagctaaacccgaattctgctatcttgatgacattttcagcagacaggcttcccagttcatctctgttttcacccactttctcctgacacctggcacccaggaggctggggaaagttgtttgaacttgagtgcatacgtgatcgagagctttggcatctgagagacctgccttttgtccctgctcccaggttgctaatgccaccttggcctgactccgccgtaagcatctgtgctctgccttagaacctcaagtcaaccccctcataattaatctgattttccccagtcatagaccatcgtcatcacacctcgcctgtctcctcagagagtcgagaaagccttggaaattcttcgacccattagacaagtcagcccagaggaacccagtctgtctacctcttgtgatttgaagcacattgtcagctaaataatcacataatcataaattctaaaaagtaaatagctacattttgccttatcttgaaaatcctctagagccacactatcccaatagaatctaaagctagatgtcagcacagtggtggaataggagctttcaccatcattcccctgtagacgcatcaatgttgacaactacctatggacaagagtgtctttgtaggagtctaggaggccagcagagaagtttcagaacactgttggaggaaaaacatccacaaataaacacattgaagagggtaggaagaactagttttactttatctgtattacccctccctcaaagcagcactgctcagagccaagagagactctctcacctgtaattccttctaagggggaaagcaagagcatagtaagtaagcacccagctcccccagccatccacaacactgcccaagagccccacttctttctcacctcacccagattgctgagataatcagcatggctgagagattgggagaggctgagagcaggaaagagaagctgctggccctctgaagtgttctacagactccatcaggaagcccatccacgagctgcttgagacacctcatctactgttcccaaactctacaccccccacccccagactgagtccctaaatgtgcccccatggacagtgaatgcaagcgtattatgtagacagccagctcaactctgtgggattgggagaaggtacacaaacttgagtatttcaggacaccatcctagggaaaacaaacaggaggctcttagcacctaacctagctttgcaggattgaaagaaggcatgcaaagtcaagaattagccctcaagagggaaaaagaaatgtagagcaggtgcatccatagaaaaggattaagaaagtctcattatccatagacaggctgactggtgaaggcatttctctcctgatgccagtcaataaggattggaggaggagatgactgcctccttcttcaaatgtgaagacagcatttgaagcaacaagacttcaaaggacagcacttcaaggaacatgaaaagttaaggagccatgacatcacaaaggaacacaatattccagaaagcaactactaaaaaatggagatctaaaaatgacctgacaatttaattgttttaaggaagctcagagagctagctacaagaggatacagacaacaaaatcagaaaaacaagagctcaataaaaagattataaatcatttttaaaaagaaccaaacagaaattttggaggtgaagaatacagtgaatgaaatggaaaattcaatagagagtgacaacagcagatttgatcaagtagaagaaagaatccatgaacttaaagacagctcatttataattaccaagtcagaagaaaacagaaacaaatgaaaaggaatgaagaaagcctatgggatttatgggacaacattaaaagggctaacatttgcattgtggaaattctagaagggaaaaagagaaaggggaagaaagcttatataaagaaatgatggcccaggtgtggtggttcatgcttctaatcccagcactttggggagactgaggcaggtggatcacttgaggccaggaattcgagaccagcctggccaacgtagcaaaaccctgtgtctactaaaaatacaaaaaaaaaaaaaaaaataggtgtagtggtgcatgcctgtagtgccagtactcgggaggctgaggcacaggaatcacttgaacctgggaggcagagattgcagtgagctgagattttgccactgcactccagcctgggtgacagagcgagactgtcttaaaaaaaagaaaaaaaaaatgtctgcaaacttcccaagtttggagaaagatatggacagtagaaaaggtaagcaagccaggcacagtagcatgtgcctgtagtcccagctacttagagggctgaggcaggaggatggcttgagctcaggaatttgaggctgtggagcagcttcgattgtgcgtgtgaatagccagtgcactgcagcctgggcaacataactagactgtctctcaaaaaaaaaaaaaaaaaaaagattaacaaaactaagagttgatttttttgaaaacataaacaaaattggtaaacctttagctagactaagaaaaaagagagaagaccaatgaataaaatcagaaatgaaggagacattgcaactgatactacagaaatacataagatcataggagactactctgaactgttacacaccaacaaattggataacccagaagatatgaataaatttctagaaacatacaacctaccaagactgaatcataaagaaatagaaaatctgagtaggccaataatgagtaaggaggtggaaccagttatcaaagatctcccaggaaagaaaagcccaatgcctactggcttcactggtgaatgctaccaaacactttttaagagacaaggtctcgctctgttgcccaggctagagtgctgtagcacaatcatagctcactgcagctcaaactcctgggctcaagcaatcctcctgcctcagcctcctgaataggtgggactacaggcatgcaccaccacacccagctaatttgtagggatgaggtcttgatgtgttgcccaggctggtctcaaactcctggcctcaactgaattcctagcctcaaggcttgtcctccctttgctgggccactgtgcccagactctaccaaacatttaaataagaattaataccaatccttctcaaactcttccaaaacactgaaagggaaagaacatgcctgagttcattttatggggccagcatggccctgataccaaatccaggcaaggacatgacaagaaaataaaattaaaggccaatatatccaatgaacagagatgcaaaaattctcaacaaaatactatcaaaccaaattcaccatcacatttaaaggatgatatgctgtgatcaggtgggatttattcctgtgatacaaggatggtttaacataaaccaatcaatgtgatacacaacattaacagaacgaaggataaaaattgtatgattattttaatagatgcagaaaaaggatttgacaaaatttaatgccctttcaaaataaaaactctcaacaaattaggtataaaggaatgtacctcaacacagtaatagccatttatgacaagcccacagctaacatcctgctctatggtaaaaagctataagttctttctttcagatcatgaacaaaatgaggatgcccattctctccacttctattcaacatagtcctggaagttctaccaatgcacctaggcaagaaaaagaaaaggcatccaaatcagaaaggaagaagtaaaatagtctctgcagatgacatgatcatatatatatatagaagaccttaaagacaccaccaaagaacttgttagaactaatgaacaaattcagaaagttgcaggatacaaaatcaaaatacaaaaatcagttgtgtttctctatgctaacaatgaactattcaaaacaatataagaaaacaattgtgtttacagtagcatcaaaaagaacgaaatacttaagaataaatttaaccgaggaggtgaaatatctgtacactgaaaaatagaaaacactgatgaaagaaataataatacctaaataaatgggaagatatcgcctgttcctggattggaagaattaatattgtcaaaatgtttgtactacccaaagtgatctacagattatacgtaatccttatcaaaatgccaattattagtataatttgtttccatagaggaaaaaataatcccagaattcgtatgaagccacaaaagaccctgaatagctaaagtaatatggagcaagaaggacggaggtatcacactttctgatccaaattatattacacatctataataatcaacacagtatggtactggcatacaaactgacatacaaaccagtagaacagaatagaaaacccagaaataaaccccacacatacgtggtcaactatctttgacaaaggcatcaaggatacagaataaagcaaggatagtctcttgaataaaaggtgttgggaaaactggatatccacataccaaaaaatgaaattggatagatgcatttcgtagcatatacaaatgtcaactcaaaatggactgaagacttaaatatgtaaaacctgaaaccatagaactagaagaaaacatacttggggggaaagcttcatgacattggtcttgacaatggttttttggatatgacaccaaaagcactggcaacaaaagcaaaaataaagaagtggtactacatcaaactaaaaagtttctgcacagcaaaggaaacaaagcaacaaaattaaaaggcaacctgtggaataggagaaaatatttgcaaactgtatatccaataagggtttaatatccaaaatgcataaggaactcatataatacaactcaaaggcaaaaataaaaaagaaaacccacagattttaaaatgggcaaaagacctgaatagacatttttcaaaataagacatacaaatggccaacaggtaaaggaaaaggtgcttaatgttgcttatcagggaaatttaagtcaaaattgtcaaaattataatgaggtatccctgcagacctgttagaatggcagttatcaaaaagtcaaaagataagtgttattgaggatgtggagaaaatgatatacactgttggtgggaatgtaaattggcatatcagttatggagagacagtatggatgtctcttaaatacttgaaaataaagctaccatacgatccagcagtcctgattctgggtatatatccaaaggaaataaaaatcactgtcccagaagagatatctgtactctcaagttccttgcagcattattcacaatagccaagatatggaaacagtgtgttcattaatagatgaatgcataaagaaaatgtctgtcacatacatatctcatttatgtgtgtgcatattcatatatatatatatacacacacacatatatacatgtaaaggctcaattgtgtatacacatatatgtatatgtgtgtatgtgtgtgtatatgtatatataattgagtctttaaaaagaagaaacatttgtaacgcatggatgaacctggaggacattatcatattatcatctaagtgaaataaaccagacacagaaacacaaatagtgcatgttttcacttatatgtggaatcttaagaaagtcaaactcacagaaacagaatagaagtgtggttaccatgggttgagcagggtgttggaggaatgaggagatgttggttaaatacaaactttcagctttaagatgagtaagttctggagagctaatgtacagcatggtgaccaataataataatgtgtttttatactagaaatttgctgagtagatcttaaagattctcaccacacacacacaatggtaactgtaaagtgacagatatgttaattagtttgattgtagtaatcatttcacagtggatatgtacacaaaacatcacattgtataccttaaacaatgactaataccattttgttagtcatgcctctatacagggatgccttctgaaaatgtatcactaagagatttcatcatgcaaacatcatagagtgtatttacacaagcatagatggtataacctattccacacttaggctatagggtgtaacctattgcttctatgctataaacctgtacagatgctgactgctgtaggcaactgtaacacaatgctaagtatttgtgtatctaaacatagaaaaggtacagtaaaaatacaatataaaagaaaaaaagtggtacactagtatagggcacttaccctgaatggaggttgcaggactggaagttactctgggtaagtgagtgagtggtgagggaatgtgccagaacaatactgtaagccaccacaacacttaggctacactcaatttatttttaaaatcttctttcttcagtaataaccttagcctacagtaactattttactttataaacttttaaaaaagttttgactcataataacacttaaataacacttaaaacacaaatacattgtatagctgtacaaaaatatttttatctccttattctatgtctatttaaaaatttaaaattttttttctgttaaaaaattttttttttgaccctacacaggtcaggatcatccatatggctgtccctcacctctgcatcttgtcccactggaaggtcttcaggggcagtaatacacatggagctgtcatcacccctgataacaatgccttctggaatacctcctgaaggctctgcctaaggctgttctacagttaacttttgttttaataagtagaaaaaaataagacctgatgtggtggctcatgcctataatcccagcaagtttgccaggccaaggcgggtggatcacctgaggttaggagttcaagaccagctgggccaacatagtgaaaccgcatctctactaaaaatacaaaaattagccaggcatggtggtgagagcttgtaatcccagctacttgggaggctgaggcagtagaatcacttgaacccaggaggtggaggttgcagtgagctgagatcgtgccattgcattccagcctgggtgacagaccgagactccatctcaagaaaaaaaaaaatagaaaaaatatactcttaagataacaataaaaatatagtatagtgaatacataaaccagttatatagtcatttattatcgactgtgatgtactatacataattgtgctgtatttttgtgtgactggcagtacagtacctttgtttacaccagcatcaccacaaacatgtaatgtgttgtgcagcaatgttagtgtctgtgatgtagacatcactgggtaataggaaattttcatctccatgataatcttatgggaccaccatcatttatgcagtccatcgttgaccaaaatgtcattgtgtagtgcctgactataaaacctttttctacatttataatctcagcaaagttaaaaaaaaaaaaaaaacaggaataggttaagttcagaactgggcttgaatttaaaatccccactattaacaccaccactattgatttggtttcacttaaacatcatcttctgtcccataaattagtgctgttatttggaaatgtgtctataacacttcgctcaattttaatttgtatctttattatagctttagagttgttagtgtactagtacatatattaaggcttatagttatctgtacatacatattctactaactctataataaaatttgttaacacatggagcaaaaaaataatctcaagctagcttaacaatggcttctgtccaaactagacccccagtaatattgggatgactgaagtctcatgcagagaaatatgtgtgtcttcacagttcttatatttgtgaccattcagaactatatgaagatataagccaaaagaaaattggtgatcttgaatgagctgttttgtgaggattataagtccagatactacaggaagtatcaccctggattcagattgcctgaaaaatcaaatgtgtatctgtttttacttattcaagagaaatattttgagattatccttcttactaattaacaaattaatatgatccaattaaactataattaaggtacttaaatcaacaaagatgagactctgttgctaggttatatgtggaaagagcaagcaagcatttttctcttttatcagaattagattttcccaaagcctccactgtctttgaagactttatctagttcagaatgctctcttccagttgggggaaaaataaaaccacaaaacacagttcactagagaccctcagataaattgtagctatttgttgatctgatcagccctgccacggttactatggaaaccagagtactttcagatgaccttttagacacaaaacaaaaaaatctatgtgccccaatatgctctctgcttttttgtccctaaatagcttacttaattacttccttaactgtgtgatgttaagggggaaaaaaatctataaaatgcacagcagttgaaagagatattttaaggcttatccttcagctttgtcttagaagcaaagtcttaaactgatataggagacaggttagtagtagaaatcattttcaaacactcattagatcactgccaacagaggttaacctggcattcagctgagcagacccaaaggaagcaagacagcctctgaaagcaactgtacagaatttctcatgagtctgtaagggagggtgcatgcatttatattagagtgctggcagcatgctttcagtttaatttgtctcgaggaaataattttgttgggaaaccaaaaaagattgtgcattctagttgtctgtctaatgaattcctgaaacagcataaaagccctgtgtcttgtagttacagggatggccttgtgggtggatgttgctggttgaagaaatattagttaatatcacacaagcctgttattaaatgttagaggcagctttgcaaatgtccccaggccctggtacccacaggggatgagcaggtaccaagggtgccacccttcatttacaggaactggaaggagggaagacagagccgatgtccactggcactagcatgaacatggcagctaaacattggcacaagtcttcatggctctatctcaagcacctaagaggaaattaaagccccctaaaataaaattaagggacctagaataagggtgacaccaaacataatgctatttgttgttttccccaaaaaacatgccctacagagaattaagattgcctgtccctggagcggtaaatcgcaagggttctgacctccctgggtatcctgaaagaggaagtggcgagcagcttgagctctagatcttgcacctccaagtatgggagctgattaataatgcagaggttcagagcccagcccagcctctgacccagtcagaatattattttaacaaggtccccaggtgattcctgagcccattaaagtttgagaaatgctggtcaagaagatgaaacctgttgactgatgagtaaacaaattcagtctcctgtggtcgtaaagacagcaaggatagacttcatcacccccagtacccatattaaatagcgaagggatcagtgaactgtgacccacacccaaccacctgcttttgtatatacagtctatgagctaagaatggtttcaaggctgggtgcggtggctcacgcctataatcccagcactttgggaggccgaggcaggcagatcgcaaggtcaggagatcgagaccatcctggctaacacggtgaaaccccgtctctactaaaaatacaaaaaaaaaaaaaattagccaggcatgatggcaggcacctgtagtcccagctggaggctgaggcaggagaatggcatgaacccgggaggcggagcttgcagtgagccgagatcacgccactgcactccagcctgggcgacagagtaaggctctgtctcaaaaaaaaaaaaaagagtggtttcaggatttttaagtggttgaaaaaaagaaggatatttgcgagacatgaaaatttggtgaaatccaaaatctggtgcctataaatagatttttattaacacaactacattcattcattcgtgtgttgtccacagctgttcctttgctaccacggcagagttgagtccctgcaaaagagactgcatgggcctcaaagcctaaatgtatgccctctggtcctttacataaaaagtttgtgacctctgggttaatggaataatagggtattcaaactgggagagatgtttaagattgtgtttgttgatggggaaacaaaagcaaaagggagtgtgttcaaagcttgttagtgcaggacccagacctcctgtgtgagttgatgcttctgtctcataccctgtcccttcccacacacccttccctatgacacccccttttctgactcctctccattcatccaccatgctcattaatgcatctcagcccatgcttgtgctccttggaaagaccctcccttctcctccacttccgtcagtcctaggcttttcaaatcctacaagtccctttatgtggttctctggcctcttaaaattgccttgacttatgcagtctaaagactactcacttgccagacacacctgtaagatgtgtcaccttcctgattccagagtaagaacctcaggccctcctctgaatactttgaagtctaaacatcaggcccatgaggagtccacccttcacctgcacttttttgacagcccagaggaaggtgtctgagccaacatctttatgaggctggttggaggccttcaggggagaggccattttagagccacgagaacctccctttcttcctctagcagttgtgtaaaactcacgtgtgtgacaaatctggttgctcttgaagatggaccagtttctttcccatacattttatggttccagaaatcagtaattctggacatttctaactggtggatgctgcatctactctgtgtcaagcactgtccctggggctagagacagaaccttgctcttgggaacattgtggagtagtactaagggatatgagaccttgtaccttatctccactttctggaaacgacccctgaccctcatagtggagggaagcttacaccctgtctcctaaacagtagctagcctagatcagcgggagtctgacccaggccacaagtcagttctttgtccacgtagcagtatctccagctcttgagatgctgagtaagcctcactgctgaaaagattatggctcgcctgatgtaacatggcttttataggcagctagaaccacagaggcctcagagaattcaaaatcacagctccctacatggggtccaggaacgtgtggccaaggtgctcatggtgttgtattttggttttagtttgttttcagggatgaggcctctttgcccattaggactgtcgccatgatgtacacatgatggtggcacttcccagttcatcaggccgaccaagtggggccatagatgtccttgttcaggaattcagggaactcggtggctgtcgtgtcttcagcacttaattgaaaacgaagtggttaacatttggcactagtgcagcttcctgccatttgccactttcaccttgagcagaggtgttttgcttcctcatctcccttcccagcatccaggtgtgtggtccgggaaggattccctgggacctcttgcagatgtgtagagcaagaggtgctgtgcgtatctgggctgggtcacttcagcctttcctttgatttttttttcccagagaagatttgggatggtttgtcatgtccaagtgtgaaacagccttagagttctttctaggtccatttgagtctaagaataactacccagtggctgccggaaggctgtgaagccacatagcaattgtatcaaggtgtctctgctaaatgttttttgtctccctgtagaaagaagcaggtgacctattgcagatggcagttggagataggaacctcctaaagtcatgccatatacttctcagggcatcccagctactcaatacagagtaccctatgcctatagatatccaagcaaagatcaggcaaccctctgagaaagatgtaggagaaatgcctgattaaatttcctctaaggctctgtccaataccaagattgcaataagggtgtttttgttgctattgttagttccctttaatcttgatgtggattaagatcgctatcctaaaatagagtttttggggttggaacaaaatggcctattttaggaacaatcataaatggatttgtgattactgacttttaaaggcccataatgataaattggaatagaagataacccatacctggtaaaagagatgcaaaactcatgatttgactagtttctcattttagtagacaaagccttactgagcacgtaggattggtttgcctctgatctcctctgttcaggttcagggctgtgatgacccattcaggctgtgggattttggttcagaaatctgatcatctgatccctctcaaattctctcctggaagccacctctcactgcttatgaagttgggggattacccctatgaatccttgtagagaagtctcaccttcatgaatccttgtagagaagtctcttttgagatgatttctttttttttttttttttttttttttttgagatagagtgttgcttttgttgcctaggctggaatgcagtaacacagtctcagctcactgcaacctccactcccgggttcaagcaattctcctgcctcagcctcccaagtagctgggactacaggcttgagccaccacacctggctaattttgtattttagtagagacaaggtttcaccatgctggccaggctggtcttgaattcctgacctcaagtgatccacccacctcagcctcccaaagtgctgggattacaggcatgagccaccatgcccggcctcttctgagatgattttaacttatttttctcacattagtacttgagaaaggaaagttatccagttaagataggtttttttttttccctttttctttttcggtggaagttgaaagtaaaaagaaaagcaaaccctggttgtgtggcattcagtcaactggagcttggttaactcactgcccaccagcttatgtttcgtcagtcatcttgggcacttccaagatattgaagagccttctgaatcatcaagaaaaaacaaaatcttgttactaatagttttcatggtaagcgggtttggtttcatcatcatttattgaaaaatggcaatctgtatataacattactgggcaccttgctatgtgctacctcaaacgagtcgattcgccaaatactccaggaccccgtcatgtgaactggccgatagcaaaacacatccctgaatgtagtggagctgtttgatgtgagaccactttcagacatggaaatgccacaaggaggagagaagggtcctgtcctcataaagcttgattctaggcctttcactattcaaacaaggaagagttacttcctacccctccaagggtcaaatgagacctgcacctggggtgcctccggagcagagtgcactggaaggttcaccgcaccttctctcctgaccctggtgctgtgtctcggggtcaccgtctgtctgctgtgcctgcctgcatcataattggaacctgtgctgtgttgtactcaatctcgttttctcacaccactaattgtgtgtagcacttcctgtgtgtaacatttctcctactaacctggcagtttttctcctcctcctgtcttttacagggctgtcatgtccgcttcttaaaggtagttcttcctctgctctttcctcatccactttccttccacaaaacacttgccttggtttttgtggctcccgggcctcagcctgcagccatgctctccacccttaaggatgcaccgcgtgttctggtagcttgaatctcacacctacttgtgtcttagtctgtgtgctcccttccaagcagccacggccctcccatgaaaaaaaatgccatgtcttaatcacccagagaatagaccagtctcccctcctcttcagattaggttagtttaaaattttacctgctgggcacggtggctcacacctgtaatcccagcactttgggaggccgaggcaggtggatcacccgaggtcaggagttcaagaccagcctgcccaacatggtgaaaccccgtctctaccaaaaaacaaaaaaaaaaatacaaaaattagccagtcatgatggcaggtgcccgtaatcccagctactcgggaggctgaggtaggagaatcacttgaacccgggaggcggaggttgcagtgagccgagatcgcaccattgcactccagtctgggtgacagagtaagactccatctcaaaaataaataaataaaataaataaataaataaataaaattttaccaagcaaatatcaaaacctcctatcagtgattaaagttcaagtctgtattgaaagcatccatccaatgaacagaaagagtgcatctttaaatggacagctcattttcctttctttctgttaatatctttcaatcacatatgagttaagattcattttaagttttataggcatacatctgcattagcatgcaatcagtatggtgtatttacactacatgagtgtgttcatatggatgatgtagtgtaatatatcataggctgaaatcctgtaattgttctgatgttcttaatgcctgacttaatccttctcactcttatttcattttttctcattttttaatgttttcccaactcaatcgttgcaatctaatcaaccattctatccccaaactatggaggggaattttgcaacttgcatgtaaatggttttaaaaacctggtctattattgtcatttctgatagcgccactctcttctgggaagctggttagggccacacaccagctgtgctctcagcgtattgcctgtgttcgtaattaaaatcagcccaagattgtcgcagtgcttttatgttcgcattagatcaaactggaaaatttaaaccctcaaatgctcgggtggaggatttgcaaggggagaaaccctactccccgaccccaagctggaatccacatctaatgctctctcaaaaacactgtcctaaagacagcatctaataaataatgtttttagagtttctcatctctagaacttgtatctcaccctgcagatgtgcctgttagaggaaccacaggagatttgtgacctagagatactggaaatgagaaagaaaaaaaatattccttgaggtttcctaagtcttgcagagtgtggtaaatactgtgtgtgaaaactgcctttcaaggcttctgttgttactgccccccctccaccccgcccttgtctgtgtttgaaaaccctgtcccatgattcaatgcagggtgttgactttggatacacatctccagaggctggccacacctgaatacactgagcctctgtgcaacttcttcctgtggagtaaaaccctccagcattctcagaggaaagaggcacctcttgatcactccaggaggtggaaacagttcctgtttaaaaaccaagtaaacccctctcattgcaccccctgctacttcagaggaacacctccattctgatggaaggaactcgtacttgggtcctggaaccctatttgggacccaaacctctcccacttgtgtggcctgacgtgcctgagtgctgtttgtgtcctttttattatgttgaaaactttgttattccaaagaaacatctgaatcacagagcttagtttcccagcatgtcggaaagctgggtgctggtgtaaaaaactcagatgtggctgaaaagggaagtaatgagaggggagaaaaataagaagaaagagttagggtgaggctttcacctccctgggttcttgcctggctcctcctagctctaatgaagggctgtccctgtccccttctccttaaagactgtccctcttctcccacctgctgggcaacgtggctgtcacctcgtcattccaagaaggcagcagggtgtggcgaggaagtgccacactgcctgggttcaagggttcaaatcccagctccaatatttcatagctgtatagcctggagccatgcagctcatctctcttgcctcagtttctccaagtctaaaatggaaatggtaaaaggaccaacctcctagggatgttgggaggattaaatgagtaagtatggaaggtgcctagaacagtgcctggctagatttgtgtttgctgcagtcattactcagccttttctctgccttccatccccaggaattatgaattacagagttttccctaatggaggtgtcactgtgcattgctggtttccaagaagccattgccaagttaaagtgaaccctttgttgtccttttttttttttttttttttgagatggagtctcactctgttgcccaggctggagcgcaatggtgcaatcttggctcattgcaacctccacctcccgggttcaagcaattctcctgcctcagtctaccgagtagctgggactacaggcacgcgccaccatgcccggccaatttttttactttttgtaaagaaggggtttcaccatattcaccaggctggtcttgaagtcctgaccttgtgatctgcctgcctcggcctcccaaagtactgggattacagtcgtgagccaccgcatccgacctcattgtgctttctaaaccactcccgggccccagttgggagaccccggttgtacattaggtacaaataacccatcagataggaatctgctccccgtaccccaccctactcccacctgcagcagtgaagcaaggccatcttgaattcatttaagaacagagatgagaagtgtcaagtcaacaaagtctcttttctgacatgttttgtgttggtgcttattatgtttcctgtgtggttttgttatgaggacaagaaacaggctactctacctgagaaagaaaatgtcacccgcatgttggaaattcaccctgacccaggcagtgataatagcgtgccaccgctcgctcacacctctcttcaaagtggcttccttggcttggtcatgagctaatctttaccttgtggctttttctgaaaatagacttgtcaacactcagtccgagtctggcccccagtcactggttttctctgttgacaggctgcaaagaatcatgcaggaagggctctgtccatgaattcccaatggtcatgggtggtcagccagctcagagctgatggtttgggtgggggcaggcaggacacagccatagtctcagctcttactaggggtattcgttttgtgactcacattcccccaggtgctcacagcctgtagatacccttagggtcacaataattgtattaatttagactccctggctctctcctggcccattgacaaaacctctgttcacttccaaagcccagcagttgcagctgggagatcccaggagtatctcgtgcggtggtgaagtgatccgatcacacacctttcctctccggtgtgaggccctctgctttgaggccacttgcatcccagccatgttcccccccacccgctgcttcctttggggagaatgcccccttgtgagtccacgcccccctcaagctgccaggcctcatgcatggggccagagagctagggtgcaaataccatgtgtaaagggaaaagtgtcctgacctcagctgcccttgtgccctcaggcctgtgcccaccgttggagacaggaaacacctacctccaccttgccctcaggcagcccctcctgctggagaccagctcctcagtcctgtccaagtcccctgagggcagctgggaagcccctgtctttttaggagaggtctcactgttccaccccctcgtctcttcccccttcctggaatggaaatttgtcttctgacgctgccacctggcagcaggcgatggctgtggcgagactactcagaatggcagcagccaccagccccgagctctgatcactccctcaccactgcaggatggcgaggctcccaagcctgcaggacgagaaagggagtgttgacccattttacagatgaagaaacaggcctcagagaagtgtgcagtgcctttactggtgtcccagaccgctgctggcagaccccagatcccatgcttgtcaccttcctgagcgcctagtgagctgcctgacacagagggcccagagaatagcccagaacagtgcagctgctgctagccttggaagcaggtgtcccattgagctataattaggccccttggttttaaaaactggtgtggattaaaaaggctcagtgagggtaggatgaaatcaatgattatggaaatattgtgctaaatttaatgacagtcggccctgctttcaaattgcttgctcctgtcagagacattttataaaaattttccgttgagtagttgagcagtgtatccagcatttcggggataggatgtgttttgttttttggtttttttttttttctctgtgaggatgcccagtcatcctgtttttcctttctgcagcagctgcacagccatggagggaaggctctggaaccttcttccttggggaactgggttttattgccagttatagcttgggtgcgttttttgttactgttttttattgacttcaggagctgctgttctgtgctcgcttagcttcaattggattttcccagaagtggctttttcattgaactctgccctcgtgtaactgtcgttacttctcactattttccaggtcgttctttgtttctaagataaacaccgtggctccctcggaccactccagggccccctgcagccctcactgcctcccttccccccaggccctttcttggatctgtggcttgcagagtctgcacccagtcaagggtttggaaagattcgggagacacagaaaggcctacaactgtttggatctttgttttctagaaatagagcacccagagatcttaaaacccacttttggcatctgtagttccgttggcactctatagttccgttggcattttgcaaagtcctggcacttacgtgagtgattcaggtcatctactataaaggatacagttttttttttgcatctgcgtagatacaattttgtgtcttgtttgtgccatcttgccccatttactgggacttcacctcggtaaggcagactagtgaatcttaggtggatctctgctaaaagatcccagccaaactgcagttgcttcagaaactgaataccacaagagggcagtaaagatttgcaaatgaaagattccatgacacctgcacacaacaaacagcaatcaactgttgcctggatgtctttacattttagtggacatagagatgagatcaccaccttgtgctccccattgcttcttggctttagaggatcttcagtgtgctgcaaagaagtcaagggtttcccaagagctggatggctccttcagtctattcttgcttgcactgggccccagcccattttctatctccccgggtttttttttttagcaccagagaattacccacttcgaagccatgttgctgacagtctgaaaaactatttactttgatgatgtttctgagttcatgtgattcttgaccctgccacagccaacccataaagccagtgtggtggtaattccaaaggggagcattcgagcaggaaaaggaataggtttccaaaaatgattaagtgcccaaagttctcgaacaatgctatgtcatggctgttgcagtgcgcactgggccttcctctaagccgggcatcagacgcaagtgtgccatcagctagctccctggtgggagaaaaacattgttgcagatggaaaaacttaaggtcattggtggggaatcctcatgtaagcctggagatttagcaattggggagaacgcggtacaagggcaaaccgcctttccaggaggtgtttagcaggtgagacaaggcgtgcaccaccaagattagcgatcctaacagatgtgtcaattatcaacagacaaatctgggaaacagggaaaaatttggttggctgcaaagaaaatcacacaccgggatactagaggtgaatattatgtggtatgaaaagaaccaagcacttcgcagtttccacatctggcaaagtgccaacacgtcagggtcccacgtttctccttggagaatggctcagttgccatgacaacggaggccctctcgctgcctgtgaatttattttaaccgtggcaacagccaaagtgggtgtgtccatgaaaatatttcttgttaagaaaacgattgaatgtgttgcccttacattttgctctgctgaatacatacttcattcaccaccattgtatggctgcaaaatttccttttcctgtgctgcctggcatagcaagcattgtggaagagcctgaatagtgatttaattctagtgctcttgagattcttaattgtcgctgttgtgatagattaagaagatacagacattgtactgaaatctaactgcaaatgaggatgagtgatttgagaacctgcgtgatacagggcaagggtcatcgaactgcaatccacagcccagaccccagcggctgcctgtcttcaccattaaggctttattggaacaccttccctcctttactcacttttgcagctttcgagctacaatggcagagttggagagttacaacagagacagtatttggcccacaaagccacaaatatttactatctggacctttacagaaaaagtttgctcaccctcgatgtaggaggaagagcactaggttcaaaggctggagttctggattcagagctcaggatggaaaactgatttagacatatcgcggtgccccctgggctcattctcctcatctgtaacatgggcagccttgatgagactatccccaagttgcttttgaattctaaaagctctgtcatcctcctgctgttagtcaaagattacagcccagatggggcaaccttagcacagggaaacgtacgggatgatccagcatctagtttcagggcctctgtagagaacagagcgtccttctcttcctccaccagcactgccacgaagcggcgcagaggctgtggtgaagttagctctctagacctcagcatcttcatctgcatcctaggcaggtcagactccccagggacccttctgtggctgacagtctgtggttctgaggccctcgctgcagttgccagcaggagaaagaatgactcatgcctgtgatttgctggtcacctgtgattcccgcctccgggagaaaactccaagtagcaggtgttgacccagttgtgtgggaggaatcacccaggcccttatttccaggttgcacttacagatcggattgtgcaaccagaaaaatgccgtcagaaggaagtggggtggcttgggggactgacttactaaggatcactgttaagctctccatacaaattagctccccttctgtcttagtccactcgggctgctatagcaaaataccataaactgcatggcttacaaactgcatatgtttctctctcttagttctgaatgctgggaagtctaaaatcaaggcaggtgaggtgtctggtgaaggctcactttctgattcacagatggcatcttctggctttgcccacacatggtagatgggatgaggagcctctcaggcctctttttattaaagtttttattatttagagacagggtctcattctgatgcccaggcgggagtgcagtggcacaatcactgttcactgcatcctcgaattcctgggctcaagcaatcctcctgcttcagcctcccgagtagctaggactacaggtgcacgccactgtgcctggctaatttttaaaattattttttgtagagatgggggtctcactgtgttgactaggctgttctcaaactcccagcctcaagctatctttctgcctcagcctttcaaaaatgctgggattagaggcatcagcctgggatcacacccagcttccaaggcctcttttataagggcactaatcccattcgtgagggatccaccctcatgacctagtcaccttccaaaggccctgcctcctgacaccatcatcttggggctaaggatttcaacatgtgaatttgagggagacacattcaaaccatagcaccttccaagaccactttctgtgttgtggaagaaaagatgtgtttttgttttgacatctgaacataaaacacatatacacagccacatgtgagaaagaagtacagttaaaaattccaactgtgaatttagacacacaacccaaaagaaaccaagagcctgccttcaggaattaggctgccttgactctgggcttcttcctcttctctttgactattcatggtgagattaaaatgtctgtccttgtgcagctgggcacaagggtacttgtttgtgacctccccaaaaaggtcacaaacaagtaattaatgtttcattcatccaggaatctatcctggggacttcaaggatgcacacatatttagaccacaaaattgttcatctgcatgtcattgaaaacagaactaggaaaaacctaggtgtctaacaataaggaatggttacatcagctacagtagagccgtgtagtaggatatgatgcagtcactcaaatcatgtggcagaagagtgcttataaccagaagttcacaataagcaaaggggagaagcaggttacaaacaatctgattctatctgtatcacataggaaatcatgaaaagaaaggattaggaaaatgtccaccagaatgttattaatgattacctctgggtaataaaattataagattttagtatatatgctgccaaaatgagtataaaattttagatgttttaggccagccgtggtggctcacatctgcaatcccagcactttggccgaggtgggtggatcacttgaggtcaggacctcgagaccagcctggccaacatggtgaaaccccgtctctactaaaaatacaaaaattagccaggcatggtgacatgttcctgtaatcccagctactcaggaggctgaggtgcgagaatcgcttgaacccaggaggcagaggttgcagcaagccaagatcacaccgctgcactcctgtctggaagatagagcgagactccgtctcaaaaataaataaaaataaaattatagatgttttaaattttgttctcttttttctgatgtatccatgcctgttagattttctaaaatgagcaggtatacttttacaacaagaggcagccttgctgtagaaattattttaaagcaacatttctgcctcttaaaaatgttatatgaaaagctgccttccccatatactctactcattgcttctgcaaatatttgaggaccaccatgccccaaacaccatcctaggcactggagctgtgccggggaacaaaacagacgagccgtgcgtgctcatcccagtggccgaagaaagtaacaaacaagtagagaaatacaggattggtaatgagaagagagggagggagtatgcaccacagaaaccggtgcagggacaatgtcagaaggagtagggagcctcggggctaaagcatcctttgagcagagatagaagggagtcccgtgcctatctgggtcagaggaagtgcccaactgcaaaggccctcaggcggcagcgtgcttggcgtgtcccagcagatgaagtattgagccagagaacagcggacattttatttactctaactgtgctacccaggaggctgtcatgcccattaagtagcatcattttaacctgttgccccgttaccgagtagaagataatagatatcatgacttggagcttattagaaatacacaggccatattccactaacgataccgtgaaaaccctcagttcctttgtggctttctgcttcgaaacacttgatctctcttaactaacgttgcagtgggtgcaggtaaaggcattaccttagaggtatgatgctgtgctgggcatccttggttatatatggcatggctatttctgttaaccatgccctgttacatggaatagcaatgaatcaccatcagtgttgttttgccagtgttgttcagattagctgtgaatacagaggactttcatcgttgtacaaaaaatggtaggagaaatccacaattattcatttgttcctatggttggtcatcgttggcctgtccgtggaatcttagaagtagaaagaagcttctgttgtcatctctccacacgttgcaactgtctttgataagtatattactcaaagccttattttcgagaatgctaagagatcatgtatttttgaagacatatttacaaaataggtgagaatgaacacatttaaagtggaatgtagttacgttactggaaagaagtcccaatccagaccccaagagagagttcttgaatttcatggaagaaagaatttggggcaagtccacagagtaaagtgaaagcaagtttactaagaaagtaaaggaataaaagaatgggccgggtgcagtggctcacacctgtaatcccagcactttgggaggccgaggcgggcggatcatgaggtcaggagatcgagaccatcctggctaacatggtgaaaccccgtctctactaaaaatacaaaaaaattagccaggcatggtggtgggcacctgtagtcccagctactcaggaggctgaggcaggagaatggcgtgtatccggaggtggagcttgcagtgagccgagatcgggccactgcactccagcctgggcaacagagcaagattccgtctcaaaaaaaaaaaaaaaaaagaatggctactccataggcagagcaacccccaagagctgctggttggctatttttatggttatttcttgatcatatgctttaaaaggtgtggattattcatgagttttctgggaaaggggcaggcaattcccagcactgaggggtccttccctttttagaccatacggggtaaccactggatgttaccatggcatttatagaccatcatggcactagtgggagtgtcttttagcatgctaatgtattataattagcatataatgagcagcaaggaagccagagggtcgctttcctcgccatcttgattttggcaggttttggctggcttcattactgcatcctgttttatcatgagggtctttatggtctgtaccttctgagaacagtcctgctgacctcttgttttatcctgtaactaagaatgcctgacctcccaggagtgcaaatgcagcccaacaggtctcagcctcattttacccagctgctattcaagatggagttgctctggtttgaacacctctcacaattagacattaaacagtacttcagaggctgcccaggagttctatgatgatgagatggacccaccgggagccctggagtaatggttcagtttctgattcttaactgtagatgaatctttggacctgtattcatactggagataaatcagcaccccttgtaagaatttctggacagagggctattgtattagaggtcagaaatttctatttttatggtctgtctgattttccatatagtgtatattcattatataaaattcaaacatagcagagtgtctatggtattaagttaaaccctttgaaattgctgttaaggtgggttagactgtcacactgtcacagcttagcagctgcaaacttttaacctattagaaaatgaacgtctccagccatccagcccctcatagatatacaatgtaagtcatttgtcacaaccaccctcaattttaatttgaaaaaacccctaatagggagctgaatgtggagagcttctcacattacacatggatagcttcagacacagatgtttttacacatgtaccataacccccatgtaggcgaatttgggtttgcaatattcagattcattttgtatgatttgctttacagaatgccactgcaggagctctttgaattgttaatagcttcagtgattgcaaactattgtgacttttcaagaatgtatctgtggtataaagtgagacgtgtcagtcatcagtaaattttcaaatgaggagggaacactgcctggtctcacagcctggtcttccaagtggcatcacaatgccaaacttgaaccaaacgtgaatatgccattttttgaggaacctaaaaatcctggattctgggttgttgaatcatagccaataaactgtgaggtactttagtcccattttgaaaaaaagagcatgctacagcttctgcatttaatgtcacttcattctattcacaacattacatattgtagttcccatttttatttccttttaaaaatttgtgccattttattaagtcagggtcttttcctactgcagtcttaacccagaccccttagagggcttcagcaggctttccggaagtcagggtggatagctagagccaagacccattgcctctcctgccccccttaggagggtgtgggagcccacggggatgtgcctcaacctcacaacaggtcatgagctcctgcaaagcccatttgtagcctcacacatctctgcaggtcacaggtttctggtctgtgagttagcccacagaactctagcccaggcagcatgcagttgctcattgaatcccagaggccttcagtgtacagtcacggagcaggtgcatgccagaagcttgaaggaaagtgcagtctcctgcactttgtctcctttctgggtcaaagcaaagaagaccagagtaatgttgggtgcggtggcttctgcctgtaatcccaacactttgggaggctgaggcaggtggatcacttgaggtcaggagttcaagaccagcctggccaatgtggtaaaacccatctctactaaaaatacaaaaattagccaggcatggtggcatgcacctgtaatcccagctactcgggaggctgaggcaggagaatcgcttgaacccaggaggtggaggttgcagtgagccgagatcacaccactacactccagcctggtgaacagagtgagactccgtctcaaaaaacaaaaaaaaaaaaaggaagatgacgaccagggtggagggaataaagcatggggtgctacactagagtccttttgcaaaggataccttatttcaccttcagtgcagtccagagagagagcccagcatagtccagggacacagtcttcttactactatattacagataaggaaccgggggctcagagaggcagtgtcatttgtccagagtcacacagcaaaaatgggtaagattaagatttgatccgagctctttggaatccaagttcagggctctttccagagttgcccactggttttatataataattgaagactgtggacggtggaaagggtctcagagacgagtgaatttgacagggatgttggaacttggagaaatgtcccaactgtcttagatcagcatttctcaaccttaaatgtgcacaggacccacccaaagattttgtttaaaatgcatgtttggacttagtagatctgggatggggcccaagagtctgcatttctgccaagcctctagctgatgctgctggtcctaggaccagtgcccagctacttgggaagcttaggcaggagaatggtgtgaacccgggaggtggaggttgcagtgagccaagatcgcgccactgtactccagcctgggcgacagagcgagactccatctcaaaaaaaaaaaaagaactgaacagacatcatcagagctgaaaggagattcctcctggtgcaggggtggaggacagtttcacaggaggatggcagcactgagagccatgggggtctccagcctgtggactgctgctcagagcctggtcccccaccgctttctttacctaacttggaaatgagtgagatggactcaagatttgggacacatcagcaggagcgtttctaatgagttaatatctgcttgaggtcagcagcccagtgcatgctctgctctgagcattcattcatcttcaggggacattctgtgtttctgcatttcatcctctgcattcagaattttccatttgctcaggcccccagcagggcgtctggccacgttgggccgtgtttgtattgctggagtaaaggatgccagcacacttactcttctgcttcctcaggttttctgaaatctctgcagttaggctgttagcttcagctttatccctagacgtatattgattttatttgcactcctggtgaagtctgaattatagtcatgacaactagagttatgtcaacaatatgcaagccaggaagggcaggtctcttaattctgctgggaggccagttgccaaacaatacattaaaaagctcagagaaagaaaaatggtcagctcagggctcactgttgctcttgagccagagatcccagctggatcttgggcaagccagacttctcagcagaggaatagcccttcagagaaacccttccaagggcatggtttcagcttgctggcctggctaactagtctcgtgtggcctctggggagggtcatcatgtggccaaccaccctaaaggcagagagccctcccagcacttctctgtggctgtcccagcatgaacagtgattgcttgagagaaggagttcagattatgtatgaaggtgcaaatgcatggagttctgggctgcttgtctgcaccagctcacctgactatcagctgcctttttatgttagtttgtcatctggccaactagtgctggctacaagttggcctctgtcagttctgtcagtcttagtgcttaatgagcacaaatgtgaatgaatgagagagagaactctgagttttgaatgcatgtgcctgatatagtgcttggtctcaagatacaaacttgagtaagacttggtccttacctcctaggatctcacaggctagtgaggaagacagatcaataaatccaagaagaagaggctgggtgtggtggctcacacctataatcccagcactttgagaggctgaggtgggtggatcacttgagctcaggcgtttgagaccagcctgggcaacatggtaaaaccgcatgtctacaaaaaaaaaaaaattagctgggtgtggtgatgtatgcttgtagtcccagctactcaggaggctgagatgggcggatcacttgaggtcaggaggttgaggttgcagtgaaccatgatcatgccactgcactccagcctgggcgacagagtgagaccctgtctagaaaaaaaaaaaaaaattccaagaaggaatgtgtgttaagttccccagaagctgacgtagccccatggttttgagaagttcattcctgaagggatcccaggagacatgggtggggagtagagatgggagccaggtaagggtaggacctagccaaggttgtgttctcaagctgatgaccactgtgggcagctggagctcggtcttcttgtgagctggaagaacattctggaacaggcttcctgttcccataactcgggcacctcgggctccctctgcaggagtggtctgaatggaaccctcaggtgttcgcaggtgtgcaggacagaaagctcaggtgtttgcaggtgtgcaggacagaaagctcaggtgttcgcaggtgtgcaggacagaaagctcaggtgttcgcaggtgtgcaggacagaaagcgcaggtgttcgcaggtgtgcaggacagaaagctcaggtgttcgcaggtgtgcaggacagaaagctcaggggatacgggtggggccctgtctgctgcaggttggaaattccagagaaaccaaaaggaggcacttgagttggactttgaaggtgaacagaacagcaagacccctgccctcccagacttgcagtcaggtggcaacggtttccgggaagaaagctaactgggagaaggaaggagtgttggggtttcaggaagaccactgtggaggatgactgtgaacagcagaagagggaagggcggagctggcgtcccaaggcaggagacaggtgggagcttgcggcaggctggcatggctgggaccgaggcggagggagtggtgggaaataagccgagagacagagcagagcgagtgtcctcctcagccatcaaagcactcagccttctctctgtcgtgtgggaagccggtgaatccaggacaggaccactgtcttttttttttttttcgagacagggtctcactctatcacccaggccagagggcagtggcacgatcttggctcactgcaaccttcgcctcctgggtttaagcgattctcccacctcagcctcccaagtagctgggactacaggcgcccaccaccacgttggctaatttttgtattttttggtagagacggggtttcaccatgttggcaggctggtcttgaactgctgacctcaggtgatcctcctgccttggtgtcccaaagtgctgggattacaggcttgagccaccgtgcctggcttctgctgtcattttagcagtagcccgccagcgagagcaacgggacatctttggggaggggttttgctgcccgtgggctaggggaggtccccaaacgctggtgggacctcgacctcagctggtgtccaggctcttgatactgccacgggaaggaattcaaggatgagtcagaaaatagtgaaaaatatggagatttattgcaaagtgaccagtacacacttgagaaagggaaaggcaggcatactccagagagagtggcgtgcaagggggtttggggcctgctacctttatgggcttctttaaggggtgggatattcctgaagattcccagaaaaaggtggagatttctcagaaatgtggtgccacctgtttttacactaaatattggtgttcctggaacggccgtggcactggtgggtagaggattgaggatgttaatgagtggacagtgaggtcccaggtgaaactgggtcaaatccagcaccatgttgggtccagttggtcttagccagcttggcccacatcctgatgtttagggtcttgtgggcccctagcttatgcagttatttcaacatttttttttcttttttgctagtcccgtgaaactgctgcctggaattttctgttctcctgctaccaccttgtattattcctgtttgagttttcttgaagaaatagcagttgagctgggacctgaagaagtgggagaggtcagccaggctagggatgggggagaaacggcaggccagggaaggctgggtcttcaggaagacagaggaggtgctggccaaaggtctggaggtcaagcctcgcgctgcatctgatcttgccctggcgccctgcccacctggaagtcctatatggttcctcgtccccctgccctcaggcatcccccacccccagtgatgtagctgctcggatatccactggctgtctccctcaaccccagcattgattagacccagactgaaagtgggacttgctcaaagccggcccagacccctgaggttgccgtaccgtggagtttcctaccataacagagctgctttcaaaaactcagcattggatggctctgtgtcctttggcagcaaggcctgcaggtggcagcgtggagatggctcagggagtgtgttctgtagtggaaacagaagtgctgctcttgattgggggagcaagggcgtgaagatgctgggtctgctctgatctcagggctggcttgggctggggagaaatctattctgaccctctgggccaggccactgagaagctacctctctgatatggacgtggtcagcctgccctggaccccacacaccggtctgtctccttcccaaacagctgcctgttctaccagcctccagaaactcagctctgcttccggctgaaaagaatctgcccaggcagagcaggaagcgtgtggcgtcctctgcccagctccaccttgtgcgagcaggtgtctcctttgtggatattgctctcaaacctggtgattgatttgagacctgaggccaaggtcatattgcaaataagttcagaagtacttgaatgtaaaaatgcttctgtcagcctttagcctgactgtgagcagtgtctcatgcttataaccagactaatatgataacatgaaactcacaaggccgtcgttaggttatgtctgcagttgaggcggtagatggcaaagtgtgtaaaaaggccccctgcctatctggaggctcatcactgcatcagcccacatcccctgactgtggtggtgacttgtcaaaggaggaaggcggaatgactgtctgggaatgtcagaggagtccagcatagctgggtagaactgcgtgctacagttggaaactgggcattcgttggtagtatgaaccgcaacttcacccaggtgaaagtagtttttaactgtttcaagcatctcagatcagcaagtcagttgtgtttgggtgttttcagatgttattgtgaatcctgagaaaatacgattaatctgtgcctctttctggtaacttttttcttattctaagtcagaagtgcagagcagggtggcatagtcggtattctcatctcaaatttgcacttcctatgtattcttttaaatttagacacaaccaattgggtgcggtggctcacacctgtaataccagcactttgggaggccgaggcagatggatcaggagttcgagaccaacctggccaacacagcgaaaccccatatctactaaaaataaaaaaaaattagcttggtttggtggtgtgcacgtgtaatcccagctactcaggaggctgaggcaggagaatcgcttgaacccaggaggcagaggttgcagtgagctgggatcgcaccactgcactccagcctgggtgacaagagtgaaactctgtctcaaaaaaataaaaattaaaaattaaatgtagacacagcctaggaagtttctcaacttagaatcattgccggggccagtttttagaggactgggctggccctgccgaagtgggcaggccagtatgtgtagcatcacagttcatgttttatctttatgggccttctacgtttccagtggccccaaattcacaggtgtttccactacatgctgccaacaaaggcagagctcagccgtgtttcacactttcagtctggaagcaaaaatatcagggccatctctccctcatgttttaatgtctctggtcaaatgggggcactcaactcatcagagcatgttcacaagccctgagacttgatccctgtatgagcgagttattctttttttttttttttttttttctgagacagagtctcactctatagcccaggctggagtgcagtggcacaatctcacccactgctgcctccgcctccccagtcccagttcaagcaattctcctgcttcagcctcctgagtagctgggattataggcatgtgccaccatgcccagctaatttttgtatttttttagtagaaacagggtttcaccatgttggccaggctcgtcttgaattcctgacctggtgatccacccacctcaccctcccaaagtgctgggattacaggtgtgaaccaccatgtctggccacaagcaagttattgttatcggagaaaagcatcacccaacagcacagcatctgataagcacatttgggcttcagttctgtatttgttcagccagagagctgagtgcatgtcctgtgccaagcactgttagagttgggaatctagacacagctggcagtgtcacagggtgaaccccaaaattggggttcagcctaagaggccacatgggttcttggctttgggcgggagggaattcaagagcaaacctacagagtaaagtgaaagcaagtttattaagaaagtaaaggaataagagggtggctactccataggcagagcagccctgcaggctgctgattggctattttggtggttatttcttgatcaaatgctaaacgaggggtggattattcatgagttttctgggaaaggggcagggaattcctggaactgaggattcccctttcacaccatgtagggtaacttccacatattgccatgacatttgtaaactgtcttggtgctggcgggagtttcctatagcatgccaatgtattataattagcatacgatgagcagccaggagacctgagactgctttcattgccttgttgattttggcgggttttggctggctttgccacagactgttgtattaggggttctttgtgacctgtatcttgtgaaaccagtcctgctgaattcctgtatcagcaggggctcctcctgcaaatgcagaggctccccaagagagcacaagggggctcaatcagtacttgtgggatgaaggcatggtggtgctccaagagggacgacggatgattcctcggaagccttctctgctgctgatccatagtaaagccccttgagtgccttccttatctccttcaccatcatcttggtaaccaccaaggtgttgactggagtgagttcctggaaagagctccagagctaaggtctgctgcactagggagggaggtgcaccctctcattaagaatgggcaggcgtggtggctcatgcctgtaatcccagcactttgggaggccgaggtgggcggatcacctgaggtcaggagttcgagaccaggctgcccaacatggcgaaaccccatctctactaaacatacaaaaaaattagccatgcatggtggcgaatcccagctactcaagaggctgaggcaggagaatcgcttgaacctgggaggcggaggttgcagtgagctgagatcgcgccactgcactgcgcttcagcctgggcaacaagagcaaaactccgtctcagaaaaaaaaaaaaaaaaaaagaatgtatccaaggcaagaatcattgccctagggctcagggatgtggctgtggaggtctagccagggaccagggtcctggacctgtcagcagctgacgcttcttacaactagctccttcccgtcaggcagatgttcaaaattcggagtcttgtgctgggagactcagcccactccaggcttctccagggctccttcggtgacagtgagacttcccgtgggtttactgaccttcctttttctgctgagcccttttaccttttgcctttgacatggactctgaggccctggtgagagtcgtgagggcagggccccctctagagcttctaaaaactcctctggtagctcgcccaccaggcagtgaccagatattcttcaggcgcaaagggcgccttgtgctccctttctttttttttttttttttttttttttttgagacagagtcttgctctgtcgccaggctggagtgcaatggcgcgatctcagctcactgcaacctccgccccccgccccccggttcaagcgattctcctgcctcagcctcccacgtagctgggattacaggcacgcaccaccatgcccagctgatttttgtatttttggtagagacggggtttcaccatgttggccaggctggtctcaaactccagacctcaggtgatccacccgcctcggcctcccagagtgctgggatctcttcttatgcacatcaccatgtctttttgtgagttcaactcttgatttaaaagaaaaaaaaaatcaaaaaaaaaaaaacaacccaacccctgttcttactgtgcatttgaaaatagcgatgaatcatcccaatggctttgccattttaagcagttcctctccagagaacattttcctcccttttggtgtgggtacaagttttcctttatgcagattaattttaaattggaaaatctacaaatacaaaaagcatcagtacacagtttatttcctttattatgttcatggacccgaagcactgtttttcccaagaagtcgactttgacatactggaattacaaccaaccagcccttcacggatccccacgcatcaattctaggttgactgtgtaaagagttgtctcttaatagggagagcagttttctgctaccttgctgactttccctgtagggtgagtgtagctgctgatatctgaacaggtactcaattctcaccctttgttccttttctcaccccatcccacctccaagcaaacattaaactcagttacaacacggtggtttctgtcactctttccccagaaaaatgacccacgtgtttcccatttgtgcttgttatttagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtaagaggacagtcgtctgcaaattgcaggggcttctgcagagaatgtcgaatcagttttgttctcctcgtagtttgcagaatagcacattagatttccctgtgattcaaggtcaggagatcaagaccatcctggctaacacggtgaagccccatctctactaaaaatacaaaaaattagctgggcatggtggtgggcgcctgtagtcccagctacttgggaggctgaggcaggagaatggcgtgaacctgggaggcggagcttacagtgagccgagatcgcaccactgcactccagcctgggagacagtgagactccgtctcaaaaaaaaaaaaaaaaaaagatttccctgtgatttgtacagtcatccagaagaccaccaggatggctaaatggtagaaaggagaggtttattggtggtatcagtttgcaaacccataaaagaaagtctatggtgtgaaatgaaggtgccctctctttgaggagagaaagggcaggttgggttttatgcctcacagggtccatgttacacagtagagtcatccatattcaacaggtttggggggaaagcttgacttatctgtgagggaagcctagcacaggcacaatggatgaacatatatgtaacatgcatcttatgttcactttggggtggggacttagcattaaaatgaggtggaatttgcctaggcatggtggctcatgcctgtaatcccagtactttgggaggccaaggcaggtggaccacttgaggtcaggagtttgagaccagcctggcaaaaatggtgaaaccccatctctactaaaaatacaaaaattagctgggtgtggtggtgtgcacctgtgatcccagctactcgggaagctgaggcaggagaatcgctggaacctgggaggtggaggttgcagtaagccaagatcatgccactgcactccagcctgggcaacagagggagactccgtctcaaaaaaagtaaataaataaaaaaaggtggaagttggctctttagatcaaaaggtgaaccacaggacccaaaaacagtttgtgtgcaggctctgcaagctgctgaaactggcttcaggtctgcagttgcatcacagaaaagaatgtttgtaaggccagttctctgtccagtccaagtcatagtgatctgagttgtcaatcaaagttaggaggggcctgatagctcctactgctagggagtttagcgagagtggtttatcttgtagctgtagggatttagaaatttgccatgccagctgggccctgaaccctcaacccatagataactatttccttaactttaatgttaccagaaaggggtcctgatccagaccccaagaggagggttcttggacctcaagcaagaaagaattcagagcgagtccacagaataaagtgaaagtcagtttgttagagaagtaaagaaatgaaagaacagctactccataggcagagcagcagcatgggctgcttgactgagtatacttagaggtatttcttgatcgtatgctaaacaagggttttattattcatgagttttctgggaaaggggtgggcaattcccagaactgaggcttcctccatcttttagactatataaggtaacttctgggcattgccatggcatttgtaaactgttggggtgctggtgggagtgtcttttcacatgctaataatgcatataatgagcaatgagggtagccagaggttattctcatcgccatcttggatttggtgcgttttggctggcttctttactgtatcctgttttatcagcagggtctttctgacctgtgtcttgtgatactagccctgctgacctcctatctcatcctgcgactaagaatgcctgacctcctgggaatgcggcccagcagatctcagccttatttttcccatcccttattcaagatggagtcactctggttcaaatgcctgcgacattagggtccatcttagtcgctaaagaggcatttatttggtctctcagatcagagtgcacagtcctcacctggtttctacttccttaaaagcaactgcatccaaaaagctatagtgggttcactgtgttgttactatttctcagtgttcagaacagaagggatgctcagaaatgctggttgatgaatagttttcacaactaaaaattaaatgttcacttgtagtaagcaaatacaatcattaagagatactgacatggggtcttcagcaatttgcctgtatctccattcggtttctgtggccccacatttcatagacgcaggaactgatttcaagtctaggttcttgacttgagagattataaatgtcagtcagctttcactctaaggatactcctgaaaaatgtgcattattccagactaatcctgatagagaatgttgagtattcattttagcagccaaaatagtgccattatgtggcagtggcctataccatttacaaatcttggcagcattgaagttttgcaaatgctggagggactgaatttgtagtgatgtgtagaatttacaaatttgcacataaagtttaatatttttatgttccacattgacaaaggtgcacaaactgtcactgagccgtcacctggcctggttccttccctctgccccccaagatatgtgcttacaagtgttcaggttgttcttgacgtgttctcaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggtaaggaccctgggaatccctgcgatgcagtacccagctctcagagctacgcctcagcccaaagcttcttagcatccttgttcctttggagaaggctggagaaaggtgtgttgtgatgtcaagcagaggtgactggggaccacctcccacctctctcactggtagatttggggcatgccttctctgtgatgtcctctgcttggcattcatgccatttaattcggcaaacatttctttttctttttctttctttctttcttttttttttttttttttgagacaggatctcactctctcgcccaggctagagtgcagtggcacagtcacggcccactgcagtctcaagtagttgagaccacagatgtaccccaccacactcagctaatttttgtatttttagtagagacgggggtttcaccatgtttcccaggctggtcttaaactcctgagctcaaacgatccccctacgttggcctcctaaagtgctgggactacaggtgtgagccactgtgcctggccttaattcagcaaacatttccatgaaaggttttcttcatgcctggtactgtgctcagactttgggatacaaaaacaaacaaacaaaaaaactcacagtcttggctttttttttttgagacggagtcactctctcttccccaggctggagtgcaatggtgcgatctctgctcaatgcaacctccacctcccaggctcaagggattctcctgcctcagcctctcgagtagctgggattacaggccgctgccaccacgcccggctaatttttgtatttttagtagagatggggtttcaccatgttggccaggccggtcttgaacttctgacctcaggtgatccacccgcctcggcctcccaaagtgctgggattacaggcatgagccaccgcacctggccacagtcttggctttttaagaccactggttccactgccaaacatggcattggagcataaggagacttgattttgtaaaagagcatgttcttgttcaatgccacacaacagggactggcaaactgtggcctattctctatggcttgtgagtttaggaaaggtcacaacaaggaaatccaaagagtcatatatcgtgacacgtgaaaattaggtcaaattttaaatttcagcatccataaacagctgttttgggacatcaccacactccttcgtgtacctgtcatctacagctgcttttgcaccatgaaggcagagttgagttgctgcaagagacactcacagcctaaaatattaatacatactgtctggccctttgtggaaaaagtttgctgagctctgtcgtaaagtaaaactaaacagaggacaaaaaaggacattccaaagcactaatcagtccgttgcagggcttgcaagtggcctacaagaaacagacatggccgggcgcggtggctcacgcctgtaatcccagcactgtgggaggccaaggcgggcagatcacgagatcaggagatcgagaccatcctggctaacacggtgaaaccccgtctctactaaatatacaaaaaaaaaaaaaaaaattagccgggcgtggtggcgggcgcctgtagtcccagctactcgggaggctgaggcaggagaatggcgtgaacccgggaggtggagcttgcagtgagccgagatggcgccactgcactccagcctgggcaacagagcaagactctgtcttaaaaagaaaaaaaagaaacatagatgtttagatgccaccatagtgagacgttgccaaagctggtctttccactcctcagaggctgcccatttaaaatatgactccataatcagtagctgtaattgatgcgattattactattttcaactgcccattgatcagagattgactttctgtcttatgcctctttgaaaactcttgggaggaacctctcagtgcttttgtgttttagaatctcaaaatggctttgcagccacccggagcctctgggtgtgtagcagtggccgcggagtcaggcgccggccactacgtgtcagcctagcgctggcggcacgttgagcttcctgctcccagccgttcccactgactctgaatcaagtcacgccagggagagatgagagcagcatgctcggaagagacaaccacagctctgaatcccagcccagagcctgtaaccctggttaccctgattaagctctggaaagctacaaaacaaagaaatgaagatgaaattaaagttcataacaggaaagctagagactggggctcccagggttgcttcctggctattagcaccagcttcatcatttttttctccctgtgcagcactttaatgtttaatatcctctgtgaaatggggatgttttctagcagagagcagaggtcattatttcactgttaaacccctccatcttcctatctgtcccagcataatgtcctcaggaatatgcagatttatttgggtctatgatacatgcccatcatggggccaacacttagcctaccagtgacagagaaaatagaaaaacagtgtttgggcatattacagatgcaaaagaacatttgattagcatctccatctagagtcccctgtcccatgtccagtaaatatattgagcatgtgtaatcctaagcctgagagatgtgttttcaggagtatccatttaaacacgatactacattagtatggcacgcctcccagacactgcaaaccagcctttaaacatttggaccatggagaagcactagttaaaatgaaataattgccttatgtggattcctcacaccatcccttacttagaaatttattatatgtataggaagatagggaagaatgttcaaggccgttactataatagcatatgtaacaggaaggcacgttgatggagagccattatttcagggttatgtaatgactttatacttcccaaggccctcatgcagtagggtttattacttattctttctttggaaaaaaatgtgaaagagctctaaactgagcacatctgcccatgcagtccccatttaactaatgagaaagcaaaacacaacctgtgaagagcaaaggaagccacttggctggggaggagccctgctcatgtgttgaaccttggtctgcaggatcggctgtacttcgtcatggaatatgtcaacggtggggacctcatgtaccacattcagcaagtaggaaaatttaaggaaccacaagcagtgtgagtattattttttaagtcctttaatttgaacaaccaagtcctaccaactggaaacttccttttttcccccccgcttgagattgggggtctcactctgtcactcaggctttgcctcccaggctcgggtgattctcccacctcagcctcctgagtagctgggactacaggcacacaccaccatgcctggctaattttctgtttttggtagagatggggtttcaccatcttgcccaggctggtcccgaactcctgagctcaagctgtctgcccacctcggcctcccaaagtgcggggattacaggcgtgagtgagccaccatgcccagccccaactgggaacttctgctgggtgaaatgggaaagtgggattctgcccagttttaggttgaatgttataaacctaaacatgggaggcggagggcagatatactggtaggatccatctaagatggttcctaaggagcagtttattctatttccagtatttccaataaactggagatgttgccatatcccatcatcacccaggtccacccttgttgatggagttattcttatctgttgaacaaatggttatcacacacctgctctgcaccaggcactggggttgcgaaaggaacgaggtgctccctttccagagggagtttacactccaccctggaggtggagaagtcacctaacaattaatagtgcgttgctgtaactttagagacttgcgcaggataccaggataacacgtaagcccctaaaaatcggggagagggaagtgcaaccccacgaaatgaccggctcagaggtgggggaagagccttccaggaagagatgtgaacagaggcagaagcaagtccagggaagcagccttgcagctcagcaggtgtgggagatgctgtgagattatttgaggggcgggggaaggggggaacgtggtaggtggggctctgggtgaagagcctggtaaggagcctggctgtggaggagggaagagggaaggcactgcagtggggcttgcaccatcagattcagtttttgcagagctctctgggggaagaaggaagcatgaaaggaaatggtagaggctggtgcaggcgctggtgagaccctttatagataagaaggaatggagctgtagttagggctagaccttggagccaaagaggaataagtgtctttgaaaaacaccctggaggaagaaaagcagaacttattgactatggaggagagaagagataaacctcttccagtgagaccccatttcaggcttgggtcggggcagccaccaaggaggaggtggtttgaggggggagattcatgagctcagttaagaacgttttattggaacgcacctgcatgatgggatgcgggagtcggcagcacaggaggaagacgtgggctccaggtgaagatgagagattcatctgaggggtgtggggagctggaactttggtgctggaaaacatcatctcacctctcaggggccaggaagtctcaggaaacaccagtggagcaagcctaaacaaagggcgagtttagttccgcagtgaggaaacctcgggggcatgtaccctgatgaatgaagtcagcacctgttaataggattctggctgctgtgccatctaagagacacattggaagaatttttggcctgcgagggattatgcaccctagggaagattaactgaaggcagaatagggaaatctttggttgcaagctttaaaagtgtgaagggggatttttctgcctttattgattgttccttttcagttttcagaaatgcctgtccttttcttctgtcttatgttgtagttataaagccttaaaatactcagattgtaaaataaagcttggtcacacaggactgtaaagagcagatagcagagtcaccctatgttataaagtaacataaaggtgtctggtccaatatcctttcattatattatttgtgttgcagaaaagtttagaaaagcatgaaaaataatgtaaagatcacctgtagtaatcccatctcttcaccctccccctttctgtactcttctagccttcagaggtggcccctcgttaagggtttggtcttgatcattagagattttttttcctctctgctcgtgtagacacgtgtgcttattttgagcctcctgcatgtgatatttccacaggcacagtcttgtggcttcttcgacttcaaagactcctgaatgctatgcagatttttaaatattcgcctccttttaatctgagtttcagctattaatgtattaacaattttgaagtgatggtagttactgctttttattatgaattatttaaaagagtaaactcagatatgaatctctccaacactcgcaaggaatgaaaacactagctaaagagttcatcacccactatactttgccttccagggagtaattgtattgtattttcaaacaccagtgtattctgccagtgaataggaaaatggaaattttctttacgccatactcctgatatagaatagtctaactggtatccactctttaaatgattgtatgagaaattactctgcaggcaataagctacttgtccaccttccccataagagaataagaagccggtttcattggttttattagctgtctcattcacggataagctggaggacgaagtgatggagggaggaccgggggttggaagaacacgatgctggtctctgagagcctctgggtctgacattcttttctctctttgatgcttgaatttgagaatgtaaagtatacaggcatctaaggaagcaagtgagaaacctgaagcccgttttcttttgcagattctatgcggcagagatttccatcggattgttctttcttcataaaagaggaatcatttataggtgtgtattgaagccctcctaccagcagctcagcagagaggttagctgggcctctgtgggcatgtcattctggaatggtgacttaagacacagagttgataactccccaggaggaacagagacctgctgggacccaccttcctcctcaccctggaggcaaatcagagccaccttctgatttctagaccgcaaagactttatatcttgtttctactttttccacaagaaaacacatttttctctccattgacagctccttccactgccttttctttggaatggaggtcagggagcaatggaaactgaattcctgttatagatgttcagcagaagaagaacacagggaactggggagaggcaaggaaaaaaatctattgaattaaattctgcctgttagtagctgtgctgaaagtctggtgccaaagaaggaagaatttcttccagtattaattgaagcataattagaaggatatatggcacaggcagaatggaagggacatgtgtatgacccagtgaagtggttctaaacccgtgattttgcaaacctggtcatgtgtcagaccccctgtgtgggacatgaataaatcaaatgattgagactttcccagacgtgctcaattggaatctctagagtcacagacataggcaagattgagaatcactagtccagtcgtttagtaatccattcagtatgcatttaagcacctgctgtagcctaggcacaatattagtctctgaagatatcaacacacattgacttctgatactacagtccagggacttatagttaatattgccattgagctgacaggtattcagatatccttctatttcaccagttccaaagcaaaccatgttatgtcatgggaaggactctgatgttaacccggttccttgcagggatctgaagttagataacgtcatgttggattcagaaggacatatcaaaattgctgactttgggatgtgcaaggaacacatgatggatggagtcacgaccaggaccttctgtgggactccagattatatcgccccagaggtaggaaccccagtgatcgttttctcaaccaggactcccaaactgtaaacgcagccctctcatgggttatagggtcactggcgaatcatgaagtcagtgcatggtcacagccactaaatggactaaactggacaaaacagactaaaatagaggaaataggagagcccattgcacatagtaaggttgtgtcttgcttcctggaactgttgtttgctccatgtgagccagttgcttgggaaaatgtatttgttacatggtcatggtcaaaatcatttaagaaacactgttggctgggcgcggtggctcacgcctgtaatcccagcactttgggagcccgaggtgggtggatcataaggtcaggagttcaagaccagcctggccaacgtggtgaaaccccatctctactaaaaatacaaaaagccagggatggtggtgcacacctgtaatacctagctactcaggaggctgaggcaggagaatctcttgaacccaggaggcagaggttgcagtgagctgagatcatgccattgcactccagcctgggtgacagcaagactctgtccccccaaaaaaagaaatactgttgagtggagggaattacttgtgaaaatactctgcctggaaggcggggtgagacgggggttgcagtgatggtgtattagcagcatcgcggtgatgactgttctaaactgcatgttgtctggtctaggaagaatgtgtcagtgtggttctaagcaaaatggttccaggacttgtatcttgacagcagcggctgtgctgctctgcttttgttataacacttacagaggattttttttcctgttttatgaaacatcccacatgccaatgatagaatgggttgtcactgtagtcactgtagagccaactttccatccacacacagtcctatggatgccacagttttttcccatctgtacccagcatggtggagaccaatggatccaaagctgagctggcttcagctcttcacagagccctcagatgagctgttggcagccggtctcacatttattcaacagattaccccatgcatttatctcagagacagtagggatagtgaaaaaggcacccacaagctcagaagtcagacccatgtgagcttcaatctggaatctgttatttacagactgtgggaactcgggtgagttacttaacgtctctgaaccccgtttcttcagcggcaccttagggataatatcctccttgtagaattgctgtgtggactgaagtgcctaatacaacattttgcatctagtagaccctccatagtcattattccaaaagggaagctgctttttattcctttgtgaagaccttgtagttttatgatatttcaagacagcgtggacacatagacttcatttagaaacttaaattctgaatcgcatggccagaggtgatatgtgatcttgctgcataacttactgggattttcccccaaaagaactccctcattagtacctacagacatgaggtgaaattaaatagtcttatttttcaaatatgaggaatagtcagggtactgtcagaaatacaatctcttgatgtagtatttattctgaagcctgttactaaatgacaggtattaagcaggctgtgattatgagccattcagccttcattgaacaattcagcagatgatgtaaaagcttagtgatggggaatggcagcttttttaggaataaaggtggcattgaacctcatctctattaagaccaggtctctcctgttccgacaaatagctccttgtgttcagtaacacctcagctatctaataacaccaggaacaacagtgtccagtagagacaaaattttccatatcattaaggtttgtccatttgagtgtcttgtctttttttgttgttgcggttcggtatcattcacggtatgagttcctgttgccactgtaacagataaccacaaactcagcagtttaaaataactcagatttattatcatgtggttccggagatcagaagtccaaaatcagcctcactggactaaagtcaagctgtgggcagggctggtttcttctggaagctttaggggagaacctgttgccatccatgccttttccaacatcaagaggccaccacctgcattccttggttcgtggtgtcttcttccctcccccatgcaacgtagcatcttccaatctctctgtcttttccaactacaaccctccagcctccctcttctcctacaaggatctttgggattatatggggcccacttggataatccaggatcatctccctagctcaagatccttaatttgcctctgcaaaatcctttttaatgcataaaggtaatagattcacaggttccagggataaggatgtggacatctgttggggagaggggacttagtctatcacacttgttatatgttggagaacctcctcactgtcctcaacagggacacctaaacacacttctgtcatgtcttggtaacttcgggcctcttcatacacagagaatactctgttcttgctctagatactttcacatctgaagccttcattcccctccttacatctactgtacaagcaataatagaggaagtgaccaccttctattgtctaccgtgtgccaggcacatgataaactttctcttggctgggcacagtggctcactcctacaatcccagtgctttgggaggccaaggcaggtggatcaattgaggtggaagttcaagaccagcctggccaacatagtgaaaccccatctctactaaaaaatacaaaaattagccgggtgtggtggcaggtgcctgtaatcccagctgctcaggatgctgaggcaggagaatcgcttgaacctgggaggcagagattgcagtgagctaagatcgtgccactgcactccagcctgggcaacggagtgagacaccgtctcaaaaataaataaataaataaatacaataaaccttctctcatttaatcctcatgacaagccccacagggaggtagcatcagatctgtgtttcagatgaagtgacagaggtggttagtaacgtgtctaaggccacgttactgagaaatgccagaattaggctttgatcccaagcccaggtcacctccaaacctttgcactgctcactacactaaactgctcgaaacttgagcgactcacgtatccagacagcactctgcgtgcttactgtgcttaagcatggtgccacgagggatacaaaaagacatcagatggcccttgccctccaagtgctttcagtttataagaagtgacatcatactgaccagcaggaatgaaaatctatatgtggattccagtcagctttcgttgaaaacatcaggcaccactgctttggaaaatcaccttaaggttgtttcaccttttttgttgccttgctttttttttttttttttttttttttttgagacagagcctcactctgttgcccaggctggagtgccacagctcactgcagcctcaacttcctgggctcaggggatcctcctgcctcagtccataggttgctggtagtacaggtgtgtgccaccacctgtgcctagcctgttccagcttttgctagcattttttcctcataagtgttcagtaatttggcatatttggccacacgaatacttacagtatagagaaagatcagataggttcaaggtttcaaaatgtgtggaaaggttaaaataatatttcgtgtggaaaattcaaaatgtgtggaaaggttaaaatagtatttgtcctctgtgcaaatactcctgtcaggcagagacaaaatcattatcttgcatggcattctccttaataggcaaagcggaggcttaagtatttatggctatttgttcaaaaaccttgaaatcgattaataccttagcgtctccttaggcagcgaagccgagctgaggcaaaaaatgtcactaacagatgagagtttgaagttgaaatggacacccacagaaggagcactcatcagaaaatgattcctaaagctgacacagagggtcctctttgctttgacatagaaagaattcttcaaggtcaatgagagtccttgagcaggccaagcaaaggcttcatttggatttaatccatctctgaaacttagttattctgggcgtgtgtgatccagtcacaagtcaagtagattccagcagccaagaatcaggctccagacactagcattgcgcactcttgcctggaagaaagagaagcaggaagagtgtctgcttctggcctgtgtcccgagaaccccctactgcagtgagagcaaagcttttcattttatttattttatataattttgttctaagaactttatttttttaaagacagagtttcgctctgtcgtccaggctggagtgcagtagcaatcatagctccatgcagtctcaatctcctgggctcaagtgatccttccacctcaacctcttgggtaactgggactacaggcatgtgccaccacgcctgctaattttaaaaaaattttgtagggatgggggtctcgctgtgttgcccagactggactcaatttcctgggctcaggcagtcctcctgccttggcctcccaaagcactagaattacaggcctgagccactgtgcccggccctgaagtgaagctttttcaagtgtgccatgtagagtcttcctcacagcatcgctatggcgggggctacgttagaccacacacaaaggacatcacccgtgatacactgacttctctgcaccaacctccctgagcacttctgacttgccacatgttagtatgagtagaagttcagtgacttgcccaaggtcacatagctggtaagagcaaaggtgggatttggatccgagatgttctgaccggagcccgtacgttctttttacctattgcattgtctccatagatatgggagaaaaagcaggtgaaagtgagcactcagtttgggccacgttttcttggccactcacttatctcaacgtgaatcagggacctgagtcatgatcagagatgcagtgaatgacgcagaattgcattccagctgttatccccagggagatcccttagaaaccaagggtgatccagccacacgcaagcccctccccagcacgtgggcatcgatctgttggcatattcagggtgccccccgagtgctgggcactgttccaggccggggggtgccgggccagaaagaggagcccagaggagagctgggaggagggccttggggctggaggcagctggaaatcagtgactgcagcccaggaggactgtggattttgagaggtggacagggcagtattctcagcagtaacagatggtgcatccaacacggttgaaatttccagggaagaagcttgcagacgtggttgcctgacctgcagccagctgcctatcagcagatgggcatactcctgggaggactgggggcttcatgggtccagagagctgaagagccattctggggtcacagcttctgcgttcccgccctacaggaatgccagcccactgatgcctgggacagcagccagattcctgtatttttatgtaaaatacacctaattgttccaagttggccctaacatatgttttttaacatgtgtatacaagtgaaattcagccaatgggctatcacctatgacctgtcttcttgaggtcaagagtcctattaatatttggggggagcatattaaagatgggaggaataaagaccaaaggatgtccatagaggtggaagcactagacagccgtctcgttcttggaccccaaggagggcaaatgttcatgaagtcagggtggccagggactgaggaggtccagcagacgggagtgggatgggcagaagatctagccactgggacttgatgatccctgagagagcagtgttggtaatgatgccgggatggggtgagcgtgagcatcagcagcgcagcaggaggaccttcctttgaggacatctatggtaaatggaaggaaagaaagtggacagtcactcccaggaaggcaggctgaaggaagcatcatttacgtggcagaaacttgagccaaagtttctaagccaaaggggaaatgccggagagagagagggagggcgggaaggagggagggagaaagaaggaatggggcacccgtggtaaggatgcccttccctctcagcttcaggaggaaggggaggggcacacaggagacctcacggtggcaggaaagctgaaaccccctccctggccagtctgcatcttcagagggtgacaccaggacgggcgggtattaggtatcttggctctgaattggaaccccctccctggccagtctgcatcttcagagggtgacaccaggacaggcgggtattaggtatcttggctctgaattggaaccccctccctggccagtctgcatcttcagagggtgacaccaggacgggcgggtattaggtatcttggctctgaattgggtatcttggagaagccaaagccttcacaggggccccaagaccctttagcacctgcctccccgccccattccctccctgacctcctccccctgccctccacccctccggagctctctagacccattgcactagctccctttccactctccaatttgccagacctctccatcctcaggccagttcctcttctttttccttccacccagcatgtcccaccccaggcatctgctcagagatcaccttggggaggccccctgccctggtgaccctatttgaacctgcaaacctccagtcccatccaggactgctgactcctgtccctgctgtttttcatggcactcatcccccttggagggacaaagatgtactcctgaactgatttttcagtctatctcaccaagctccaccacgggcagaatttcatctggtgttggctgctgtgcccctaccccagggtctggagccgtgcctggcactcagtgtgtacttggcatgggtgcctgcacgctgcgctcctggatgtggccacctaggaatctgcaggggagacaccgcaggaggacagagatgaagccttggagactgagaggggtggaactctttagccaggtgattggaagggtgacttccaaggccatcacaggtgttgggctgatggtatgtgacagtgcagagaagggccacaccacctcatgtcatcggctgaagagatccagcaggttgggggacctgagtgaaggtcaatgggacatcatcccaggtcccccagacagccccagctgaccccagagacttctcctggcctctggggaaaggattgtagagagggatagaaaataagagtatctaaaggttcaaagagaaaataactcatgtggtatatacatgcagccgggcagtcaggcagtaaattagcactcaccaccaagaagaaagggggagaatgagatacagggagagaaaagccaatcagcaccagcaatggctcctctgagatcagccgcttctgaaccatgggccccgcaccagcccagcatgggcaggagcaaagaaaagcacttgatgaaagaaacagaatgataaaccaaagggcggctttctttctatcaaaggccaatttccctctatggagggtcatggtccagtgactccagcgttgcaagagagaaaatgaagccgccgctttccctcaaagaaatatttaaagagccaaagccaggctttcctttggggtcttctttaagttgtgcgattctcagatcttttctaggaattatgttggttttattatctcatatattgtattgtctgcctgcagctctttaactgtctcataattctccccgccttggagtttaatcagtttagcctcttctctagagcactgggcaccttctgcgatattgtggtctatgaaacaaatgtggcccgctcctttcttctgagcctccccacttccaatcctccctccagaagtaaccagctcctggtggattcgctgccccttcgcaaatgcctgctacatcccagaccagggctgagcaccttgtttattttgtttaatcctaagtcaattctaattcctggatggtgaaactgaggcacagagatttgttaattttccccacctccccagttcaatgcagacttggttttgaacacaggactgagcagcttttccctgcggtgactgttaccctgggaggaagggcctgcagacatcagctccaatgctacccaagcaacatgtcactccacatgtgccagtaagctgctctcacaggcctgttattggctttcagagctcagataatgctctgttagatttttactcctggtatttggtggcatgctttaattagccctttatttagggatttgcttaaatcctgtaaaagtgggtcagagatttctgagcttatttcgcctctttctttgtaacattgcccaggcgatggcaggatggaggtgggtatcatgagagattactaacatttgttcatttcttgctatgcgccacgcacttaacgcctgttatcacatttaattcttacaatagccctctaaggtaagtggtattattcatgctttacaaacactgtaaaggagacttggagaggagacgggacctgctcagggctcacagatggcacatggcaggggcagaatgctggcccgccagcctcagagcacaggctggcgccctgatgccatccacggccagttgccacctcagtgtatcacttattgccctgtctccaaatcatatctgtagagatccactagactttgagacttcttggttctggaaaatcttttaatccagctaataaagctcttacgacacaagttattcctaactcacacttcattcctttaccatacaagcagttattttgttctgatgcataattaacattttgcacagcttctctgctgaccccagaggaggcctgagatgagcagggtcctataggtgggtgctgagctgggactcctgcccagcttttccctagcacctcctatgcccctgccaccctcagagggagagaccagggacaagggctgctgcttccttcctcccaggaagcatggctagggggggtctcaggaaacttacaatcatggcggaaggggaagcaggcacatcttccatagccagagcaagagagagagcagggaggtgctacacactttcaaacaaccagatctcatgagaactctgccacgagaatagcactaggcggatgatgctaaaccattcatgagaaactgctcccatgagccagtcacctcccaccaggccccacctccagcactggggattacatttcaacatgaaatgtgggtagggacacagatccaaactgtattataaactctggctacagtactgctattttaagaacttggggtgacatctgtataatagggtataatcacagcatcttcctgaaagcccaactttgagggctcagtgagtctggccataatgacttagcctgcctcagagggagcactccggaaagccttgtccattatttggcagttgtttcaattatctattgatgtgtaatcgccccagaacataatggcttaaaacaataatcacgttgggctgggcgtggtggctcacacgcgtaatcccagcactttgggaggccggggtgggaggatcacctgaggccaggagttcgagaccagcctggccaacatggtgaaaccccatctccactaaaaatacaaaaaattagctgggtgtggtggtgggcacctgtgtagtcccagctactcaggaggttgaggcaggagggtcacttgaacctgggaggtgggggctgtggtgagccaagatcatgccagtgctctccagcctgggcaacagcaagactctgtcaccaaataaataaagttaatgctgcgattcttggagccagggcctccatcaggacccggcaggtggactccttgctgctgcagggacatccctaccatggctctgctggggctggagggcccaaggtatcttccagctattggccaacgccacatgggttctcctctacctggtccttctttccatgcagccacttgtcactgagcttcttgacatggtgctggctactaaaaggccaaaaacagaagccacaggctgctgaagtctatacctggaactgaactgtgttacttccaacacgttctgcaggtcaaagacagtgaggaccaggcaagagggcccctgccttgtgttttagagcagagctgagcaaactttctctgccagggactagataaaaaataggcttttcctaaatcttaattttagatttttaccaagaggcaaaattgagcaactgttcttgccaaaatcattttacatttaaaaatgtaaaaagcatgcttagctcacaggctgtacaaaaactggatttggcctacaggctatggtttgttaagccctaccttagtgggctctcctctccccaccagtccccaggctgggctctccttatagggttagagtctgcagggccaatgcccactcacagcctgctctccgaccccttttagacaacaacctgggtactcagagcctggaattcccttccagggcctcttgccaagatccatccttcctgtgaacaccgccctgctggcgtatgcactcctgtggccagtggaggagtcagtggatggctgttttcaggggcagtgggacgcagttagacatgcaggttggggtgctatgatggaaagggcctgggaagagaagtggggtggcccatgtcaatagtacattcttaggcctccacatactggagtggaatctcaggggtccatgaattcttaagtcaaacttgtccttccaggttcttgggaaatgtaaaggactgaattgcatccccacgcccccaccccacaaatccgtgtgctaaagccctaatctccagtgtgactgttctgtagagataaggccttgaagaaggtaattaggggagaatgaactcatcaaggtggcgctctgatctgataggattagtgttcttacggggaggggaagaggccacaggagggtgcatatggaataaaagccacgtcaggacacagcgagaaggaggcagccagcacggcaccaagagaggcctcaccagaagcccacctgctggcaccttcatcctggacttccagcctccagacccaagagaaatttctgttgtttaagccacccagtctgtggtgttttataagggtagctcaagccaaccaatacaggaaggtacttgtgtcaaggggtgggaaagagcatactgtatttaaccgtctgttggcttgatttgtaatactcctatttagataaaggctgtgtgagtcttagttattcttgtcccggctccctcaccccacatgttagagatggcctcatcctaggtcaatagggagttgtgggttagggccaagtagattatgttataaagcgagatgtattttatatattcatatcttttttcatatatatgttcatatatatatgtatgtgtatgtattcatacaatcaacatcgttgtcactcttatcaagcagaacaggaaggaggaataaaggccccagagggcaggggcaccatctcagatgtctttgtcccattcacagctccttcttacacagagcgggcaccatgtgcgacagtaaagcaagagccaggatgaatcctggccccatctgccacctccccactgtgcgtgtgactctggtcacctcacttgagcttgctgtgcctcgacttctccagtggtaaacgagggtacgacctagcacggtgctggcttaaagactgtgctcaggggtggctctgattcacatttgatttatagtcaatattacattcttagtgcatctcaccattaaggaggttcctgaaaaactcggtgggggaaaagagaggatctgaagaggtgtttgatttctttgacgtaacaagaaattaaagaagtttgctgggcatggcgctggagaggtccggtgggccaagtcgattagatgatgtggggtgggccatgtcaatattacattcttaggcctccacatactggagtggaatctcaggggtccatgaattcttaagtcaaacttggccttccaggtccttgggaaatgctaaggacggaattgcacctgtcagatcagggccccaccttgatgagttcattctcccctaattacctccctcaaggccttacctctacagaacagtcacactgggggttagggcttcagcacacggatttggcggcgggggatgcaattccaaggtcgggtgacccaactcaattagataatgtttttctagacccagtcgctccacagtcaccttcccgatttctgccaggatcagctagccttaccgaagagctaaaaagagattcatcccaaacaagagcttccttggaagcattccatgaagacttgaaacggtgctgcctcccaccacctgacccagtattgtcagtgcctcctctgaggatcgcagaaaatcgcaccccacgcccccccagtgcacattccagacttggagaagcgcggcatggggtggcggtggggagaacacctttctgccagatcaaaagcccagcactttattcagagttttatttatggctccttcagaaggttagtccagtcacgcctccttaataaccgcctcatcacacatgattcaggtgtcctggggccacttcacgctcctggcttcctggcccaaagcccaggagaccgctgaaccccactgcctggcattatttgcgggcgagacaccactggtgaagtgtttgtcttttcttatggcttattttattgaaggttgttcttttagtcaaacaccttttcagttctttgtgtttgctgagcacccagggctgtctcacccagccttgaattgtttccaggcaccttgcaagccagtattgtacagttcttttctgcacagaaaaagtacagacttctggtttccagtccagcatgttaggagcttagacgtcatcgttccatcctgacaagtgaaaagctggactggaaaatcaacaattcttcctagagccattggcgcctcccacgtgggagacctgggttcatttcctgaccagtgcaccagcattggtggttgagtggtagaattctcgcctccctagagccattggaaaaatgaggtaacagggcaaaccactgtccccaaaattagacagacaggcagatacagataattacaacttaccagaacagaaacctccctggctactagtgctggggtgcaaaaacctgatccgtaatcggcaaattgctggaggctaagtgtggacaagtctgagaatcagtcacgggggctccacgcgttttggagttttccctcaggaagcgctgccgggtcctcacagtgaatgctggagaaaaatcgcctcatgcttctggcagggagaggagaaaagtaataaccattgtgaaatatgccagagcatcccgttcttcttaacaagggcttccctcaggagacgctaatgtgagcttaatctcctggggttttatcagaccctaacctacctagaagaagggacatccccgattccaatcccttccacccatcctctcccacccaagaggagaggggggagaccaagaagcacttgtgaaggtcacaatccacaggcacaggctccccacaagacagagacctcatcgtcggaccgtagcacacttcccctctccacacctcaccaccacatcactaaaggttcatgtactacagttcctttcacccagtgtgccatgtccagccctcaagaaaacaattacagcacactaaatggcaaaaaaaaaagaaagcaatttgaagagatgaagcaagcatcagatgcagactcaaatgtggcaaggatgttggaatgataaccaggagttttgttttttggtttttgggtttttttttgttttggagatggagtcttgctctgtcacccaggctggagtccagtagcatgatctcagctcactgcaacctccgcctcctgggttcaagcgagtctccggcctcagcttcccaagtagctgggattacaggcatgagccaccatgcccagctaattttttgtatttttagtagagacagggtttcaccatgttgcccaggctggtcttgaactcctgacctcaagtgttccgcctgcctcagtctcccagagtgctgggattacaggcgtgagccaccgtgcctggccataaccaggaatttttttaaactatgattaatttgctaagggctttagtggaaaaaagtagacagcatgcaagaacagatgggcagtgttaagcagagagaaattccaagaaagaaaagatgctagagatcggaaatactggagcagaaatgaagaatgcctttgatgggctcatctgtagactggacacagctgagtctggggtgactgagcctgaggatatggcagtaaaaacttccaaaacggaaaagcaaagactgaaaaaaaaaaaaaaatggaacagactatccaagaactgtgggacagctacaaaagatatatgccctgggaacactggaaggagacgtaagagagaaagaaacaaggaatgtttgaagcaattgggacagagaatgtcccctgaattaatgtcagacaccaaatcacagatccaggaagctcaaatgacacaaagtaggacaaatgctcaaacaaaacaaaaagctaggcatatcatattcaaactgcagaaaatcaaagaattctgagggaagcccagagcggggaaagcaacacgttacctaaagaagggcaaagacagtagagtgaaatatttaaagctttgggaggaaaaaaaaaaaaaaaaaaacgaacctagaattgtgtaccctgcaaaattgtccttcaaaagggaaggagaaataaagactttctcagacaaaaacaaaggaaatgtgttgccagtagaccagcctggcaagaaatgttaaaagaattttttttgttttttgggtttttcttgagatgtagtcttgctctgtcccccaggctggagtgcagtggcgccatctcggctcactgcaagctccgcctcccaggttcataccattctcctgcctcagcctctcgagtagctgggactacaggtgcccaccaccatgcctggctaatgtttttgtatttttagtaaagacagggtttcactgtgttagccaggatggtctcgatctcctgacctcgtgatccacccgcatcagccttccaaagtgctgggattacaggcgtgagccactgcgcccggccaaaagaagttctttagagagaaggaaagtgacataggtcagaaacttggatctccatggggcaaggaagggcaggctttgcagatgctgccaccacccatagccccctgcaccagccgtgggcagccccactgtgttcttcaacatgaggccgcatctctttcaagctgtttgcagactacattccaaaaacagcagaaaatttttgtgctctgagcactggagagaaatgatttggttataagggctctttgctttcacagaatcatgccagggtttgtgtgtcagagtggttacttcacacaccatcaaatttccaagaaaatttactggtatcaagaaagaaatttgatctacgggaagaaatttgatggtgagcacttcatcctgaagcatacaggtcctggcatcttgtccatggcaaatgttagacacaatacagatggtccccagtttctcatctgcactgccaaggctgagtggttgaatggcagagtggcatgcatgtggtctttggcaaggtgaagagaatatcgtggaaaccatggagcactttgggtccaagaatgccaaggccagcaagaagctcatcattgctgactgtggacgactcttaataaatttgactcatgttctatcttaaccaccagacattccttccttagctcaggagagcacccctccaccccattcgctcgcagtagcctctcatctttgtgctcttgctgcagttccttgggttccatattttccttattcccttccatgcctagctgaattgcagagttaagtttatgattatgaaataaaaactaacaagagcatcagagaaggtataggtgaaagtaaaatacttttagtattcttgatctaacatgagtttttttcaaaataataacatattctagtgtgtgtgcatatcctatgtataagtgaaatgaacgagagcagtgatagaagggataagagggaagaattaggattattttgttatcatagctactttcactatgcatgaagtgttacagtgttatttgaaagtagacttgggctgggcgtggtggctcatgcctgtaatcctagcactttgggaggccgaggcgggcggattacaaggtcaggagattgagaccatcctggctaacaaggtgaaaccccatctctaataaaaatacaaaaaaaattagccgggcgtggtggcgggcacctgtagtcccaggtactcgggaggctgaggcaggagaatggcgtgaacccgggaggcagagcttgcagtgagccaagatggcgccactgcactccagcctgggtgacagagcgagactccgtctcaaaaaaaaaaaaagaaagtagacttggtttcgttgtaaatatatattgcatattctagggcaaccactaagaaaaggaaaaaaggaagtcactgatatgctaagaaaagaaacaatggaatcatatgaaatgctcagctaaacccgcaagaggcagaaaaagagtgggagacaaaaaaaaaaaaatggacaagggccacaaatagaagacaataacaaatatagcagtgattaatccagttatatcacaaataactttcaaagtcattggtctaaatgcagcaattagaagattgccagactagatcaaaaaacaagacttaactctatgcaagaaatccactttaagtataaagacatgtagattaaaagtaagtggatataaaagatatatcatgctaatactaatcaaagaaattaggagtcactatattaattgcagctagagcagacctcagagcaaggagagttatcatggaagggcattacataatgataaaggggtcaagtctccaagaaaacatagcagttgttaatgtgtgcgtctgacagcagagcattgaaatacatacggccaaacatgatagaactgcaggtagaaatacatgaatccactattttatttgaaggcttcagtgcccctctatcagaaatagacatatcccgcaaggagagaatcagtagggacggagttgaactcagcaatactgtcctgtagactctacttcatccaacaacagcagaataacatacattcttcacaagctcacatagaacattcaccaatatagaccacattctgtgctgtaaaacacaccttaacaaactgaaaataatagaaaccatgcagtgtcttctctcagaccacaatagacctaaactaaaaatcaataacaaagatagctagaaaattccaaaatacttgaagattaaagaacccttctaaatagtgtgggtctaagaagaaatctaaaaggaaattttaaaatattgttaaataaatgaaaacgtagatacgacttatcaaatgttatacggtgcaattaaagcagggcttaggaaacttatagtattgaattcatatattagaaaagaagaaagatctaaaatcaaccacctaagcttccatcttaggaagctagagaaagaagagcaaattaaatccacagtcagcaaaagaaaataaaaactagagcagaagccaatgaaatagaaaatagaaaacagggaaagtcaacaaacccaaaaggaagttctttgaaaacatcaataaaattgataagcctcaagtcaaattaagaaaaagagagagcacaagttactaataaatgaaagaggacatcactacagatcccatggatgttaaaggatgataaacaaacaccagcatggaaaactacagactaatacctctcatgaacatagatgcaaaaatcctcaacaaaatattagcaagttgaatccaacatgtatagtaggaattagcttctgtttgcagccagtataaacaattgcaaacactgctttcatttgatcctcttctgaccttttttgggaggggtacttaggctgttctgctgtttgcttcccattcttacagggaggtaaaaaagggtggctactctaaatagattttaaagcactttcattggtgtaattactattagagagatcattttctgttttctccaattgtacatagagccacaatttttgtctaaatagaaaatacataggctgggcgcagtggctcacacctgtaatcccaacactttgggaggccgaggtgggcggatcacaaggtcaggagattgagaccatcctggccaacatggtgaaactcagtctctactaaaaatacaaaaattagccgggtgtggtggcgtgtgcctgtggtcctagctactcaggagcctgaggcaggagaatcacttgaactcgggaggcagaggttgcagtgagccaagatcacgccactgcactccagcctggtgacagagcaagactccgtctcaaaaaaaaaaaaagatacatagtttggactctagactctttgtttttaatcttgtggtaattttctttatttttctttacttatttatttggcggtggttgttgttgagatggagtctcgctctgttgcccaggctaaagtgcagtggcacgatcttggctcactgcaacctctacctcccaggttcaagcaattctcatgccccagcctcccgagcagctgggattacaggcacttaccaccacacccggctaatttttggacaggctggtcttgaactcctgacctcaagtaatctgcccacctcggcctcccaaagtgctgggattacaaatgtgagccactgtgcccggccagttttcttttttttttatataatgcactttgtccaaggatttcaaatattgtagtcatttcccatgtgacatagtaagatccttgatcttggatatcgtatcttagcgtatttgtctgttatcccagttagtttggtaatctgtgatacctagcagagtgcccaacccatagaaatgtacagtcagccatactcagtgggagtgagcaaaggagagggccaaggagggtgtcctaataccataagaaaacagagaagcctgaagttttgctgctccagtaaaaaatcaatttaattgcctaaggggagatttttaaaaatctgtttgattcacttctgtaactgattcacttctgatttactatgtctggtacacagtaaattaatatttgctgaaagaacgaatggaaggtttattgtcgcttaagaattttcaggtgccaacaatcatttgagtgtttaacatataccaaaatgtttcctctgtccccctctgagccaagtttagtttatttccttgaataactttcacccacctgcttatttctggtaggccagttcttatttctaatgttaggcagtatggagttatgtatactcagctgcagtaagcacattttaatacacataatgccatttaatccccaccacctgcttgtcaggtgggtgctgaaatcccaagatcacagctgaggaaatggaggctcagagaggctaaccaacttgcccaaagtcacacagctcctggcctccagcagttgggttcggagctctctcacctcattctgcttcccgcttgtattctgagctttggctatgccattggaaaggagtttaattaggaagtatctcgattgagagctgggggtgtttcacttctcccctgctgcggggctttctgtttatgacgctctggtctctgttctgatgctttagaaagaggacacggtcaggagacctgaggcctctctcttcctgaccttgctgttaaccagcccaatgacctcagcaagccactgtgccactttgagcctcaggagcctcttcagaaccctgaaaacaccttttttattttattttaatttgttttagacggagtctcactctcttacccaggccggagtgcagtgcatcatggctccctgcaacctctacctcccgggttcaagcgattctcctgcctcagcctcccaagtagctggaatcacaggcatgtgccaccacgtccagctgatttttgtatttttagtagagacagagtttcaccatgttggccaggctggtcttgaactcctgacctcaagtgatcctatcgccttggcctcccaaagtgctgggattacaggcatgagccactgtgcccagcttgaaaacatttttctaaatcatccctccagacttagcaatccagcaattctaacagcccttttgattttgcactttagaggtaggcagtgtctatggagtggtcttggatcagatccactacttctccaacacaaccttgtgtctgccccgtgcctgaggtcctggtgctgggtacagaagtggatggcccagccccaaccagggagaagtctgggttgagtaggggcagacagtctcagtagacatgacaaaggctccaggagttgtgggtcccacagtagcaagtggaggagacagttatcaaacccaagatcccagctgtcagatcagaacacccagaaaacgttcaggcctgtcttctttctttccaaatggtgctgtttggacgcgtcagacagtgctttgaccatgttacatgtaaagagtgcctctggggtcctgtgttctatccttgggaatggatgatgtttttcaaaacaaatgtaatttttccatcaaaatgtttttgttttttgaaaaagaaaggatattctttgtttccctgaaacagtaaaaggacttgagtgtgttttatgcataaaggccaccgttattttgtaatgacagcttgggaagaggcttttgtggccaggccttttatttaagattgggctctaggggtttgctgtatacatacagcacaaaaatgaagagtgaaatcccagttcaagtgcagccgagaacaggagagtgaatctccacacacgtactttataggtccgtgggttccttcaagaaaaagcctttagagccaagagctcctgagtgaaggaggcatcttggctgttttgatcctgttaagcatttgggccccttttcagcaggactcatgtaaactgggcgagtacccaccatagctgtctagggaaccccactggatcaaggccttcagtatagaaaaagggtcagaagtatggatgccaaagccgatgaccagggttctaatccaagcgttgctgcttgcaagctctgtaacattggacaagctactgtgtctctctgtaccttatttcctcacctttgcaatgggccttatgaggattaggtgagcttcagagctaaagagcctggctctcggcacatgcctactgtggtgatgttggttacagctactgtcaatattgccagtggcatctaaaaccttcctgtgccgtcctcaagctctcccaggctggagatttcagaagttagaaagctcctggagtcccatcctctctgggaggcatttgaatgtgaagccctggtagagagtggaaggctgggtggccttggagtgacatccttccagctgctgcaggcccttggccttgtacaagacaagaagctaccccctggtccctttcatgccctggtcctgtgcccgggctggaagaaagctcattcatatctcacttttacaagacaggcagccatttgtaacatcctgacattcccccaagcagttggctcttgtaagtataataataatgatctaaatgacaaatagcagtaaaattgaatgacagtggccttgttgggggtctgtctttgaagccacagctcaacctcccatgtgcagcagggaaatccgccagctctagcccttcttgccaactctgcctctccttttgtgagtttctccattatgggaaaccagattggcgtcacagccccttgcctggggcttcaggatatcaggcagccctgggcttggctgtaagcccacattggcccacaagtgccagagacacctgctcctatccccataggggacagacaagagagtctcctcatccattccatggtctctgagcctggtcctcagcccaaagctggctccctagaccaatgagagccagagaaccagaatgggccataggagccggtggaattcagagggtctcagccagcactgtccaacaaaagtaaaatacaagccgaaactgcgtttagcagccaagtttttaacaagttggaaaggaaacagatgaagttaatttattaataaaaacatttaatgaaggccaggcatggtggctcacgcctgtaatcccagcgctttgggaggccgaggcaggcagatcacctgagatcaggagttcaagaccatcctggccaacatggtgaaaccccatctctacaaaaatataaaaattagccaggcataatgatgggtgcctataatcccagctactcgggagactgaggcgggagaatcgcttgaacctgggaggcagaggttgcagtgagccgagatcgtgtcatcgtgtcactgcattccggcctggtcgacagagcaagactttgtctatatatatatatatatatatatatatatatatatatccatatatatacatatttgtccatatatatatatttgtctttatatatatatgtctttatatttgtctttatatatatatgtctttatatatatatgtctttatatatatatatatatgagctattttgcattttttatactaagtcttcaaaatatgatgtggatttcacacctacagcacatctcagtttggactagccacatttcatctgctcagaaaccacaagtggccagtggccactgtattggatagtggctctagacagctgaatagggacagtatagccaacatcctaagtcgtgtgtatctgaatgtttatcttccagtggggctctctaacactattttcccttttacagtgaggctttggttaaccagaggtatttattaaccacaactgctcattgagagaaagatatgctttattccaaaaatgaatttgcagcggtgaggttgtgccctatacctgtaactgagatcttcaggacctcccgtgttatctggtacacaacaagccaaaggtgacacgtttctctgggaaaaaatgctctggctagattctaaaccccatcctattgttacaattgaaggcactgcagtgttcagagtgactttgtaatcttggcccagtggctgagcaggcgggctctatgcggctgatgaggatgagtgctgtcacgagaaaaacgagccttggcgcttggcattctgcttttggtaagccttggaggaaggagagcgtgttatcagaaggagtcatgggaatttaatgccttggaaatagaaaatgaagagccagctgggagccaacttgttgtagaacttaaagcaaaaccaatcaggtggccatggcctttaggattcatgaatccttctgaccagaaacagggctcccacacccttgcctgttgatggctttccaattcggacatcagtttccatcacccaagcagagagatgtggttggcaagactgctcagatatttgtagaatataggataggaaacaaagtataacctcctttgttcagccctcactgatcctttacctgatacacacagcaacactgttgcttcagccctgccactgttaaaaacaaactcactttgggaggccaaggcaggtggatcacctgaggtcaggagttcgagaccagtctgggcaacatggcaaaaccctgtctctactaaaaatacaaaaattagctgggcatggtggtgggagtctataattccagctactcaggaggctggggcagaagaattgcttgaacccgggaggcagaggttgcagtgagcagagattgcaccattgcactccagcctgggtaacaaaagcgaaactccttctcaaaaaaaaaaaaaaaaaaatttaatgaaacaccaagtaacataacatacacagatggtggggactggctttaaccaagttaaacatagtttaacatagttacaagagcaaattttattcaagtgcttttgaaatatagttacttaaaacaactgaaatgatgctttccaataaatcatcttaatcctctgggccctttgattaatatttcattaatcccagtatcaatgtatttgaaaatacattgaaaagataaaattatatctttaaaataaatgtgtcagtattcagttccacatattaattgattggctttgagcaagtctttaaacttagagaacctattttctccctataaaatgagaatatacagtaagacctcacttaacattatcgataggttcttggaaactgtgacttcaagtgaaatgatgtataacaaaactaggtttttctccctcatcagcattataaggaaatgatgttatttgaggacctgctgtatgttgttttgcttaaaatcacagtttccaagaacttactgctggtacggagtgaagacggactgtaataacaactctgcatcatcagattacacaagatgtgtgtagtgggtacaacctgcatttggtgcccagaaggtggattttcactcacccaaagagaatttctgttgcccttctacttggtcaggacaggatttgtagaaaagctgagattgtgtgattcacttacatgaaggaggaagtttttagaatggacaactcttgctgccacagcaatccctgaaatctcagtggcttaacacaaccaatatttccttactgctcacacacagtctgatgcaaatcaggcaaccctcctccatcttgcaactgagccatctggaacaggtggcccctagaatcacagtgacaggaggcaaatgggcttttaattgcctcaacccaaaagggcaacatcacttcctctccctgtccattggccagaactagtcatgtggctccaaagcagaggagattatgaaatgtaggggagcacatgggctgtttggggaatactatctgatgctgaaggtttgctcctatcattctaatttattctctgatatggcaatatgatagcctattaagcgtcttcccactgacttgttttgttttgttttgagatgaagtcttactctgttgcccagtctagagtacagtggcacaatctcagctcgctgtaaactctgcctcccattttcctgcctcagcctcctgagtagctgggattacaggtgtgtgccaccggacccagctaatttttgtatttttagtagagacagagtttcaccatgttggccactccggtcccaaactcctgacctcaagtgatccgcccgcctgggccgcccaaagtgctgggattacaagcgtgagccaccatgcccagccatttttttttttttttttgggggggagagattagggtcttgctatgttgcccaagctggtctccaattcctggactcaagtgatcctcttgcctcggcctcccgagctactgggattacaggcatgagccactgtgcctttcccctattcatttttaagtttgctttctggggtaggtttatctttatcattaacctaggttttacaccactggaattgaagtgaaattatccccccactgcaattagtccattttcacactgctataaagaactacctgatactgggtaatttccgaagtaaagaagcttaacaagaagcatgactaggaggtctcaggaaacttacaatcatggcggaaggcagaggggaagtaagcatgtcttaccatggcggagcaggggagagagagagagacaacaaggcgggaagcgccaaacacttttaaaccatcagatcttgtgagaattcactcactatcatggagaacagcaaggggaaatccgcccccatgagccaatcacctccctccaggaccttcccccaacaggtggggattgcaatttgagatgagatttgggtggggacacgatatggtttatggacacaaaccatattgggaggtaagtagtggctttcaggagttggccgagcagttttaatggatttttttcctttgcttaagggtgtaggttaagtgtactaagcatgtgctaagtggagaatggataagcagacttgatactgccactattctcaaggaaatggctttgtttttgttagtttgaaatgagaatccagtgtataaatcagctcttgatcttttagactgacgggctgtggaagggacaactcatttcagttaaaataggcatttccaggctgggcatagtggctgatacctgtaatcccaacacacctatgcaacaaagcaaaatcctgtctctaaaaaaattgttaaaaaattatctgggtgtggtggtgcatgcctgtggtcccagctacttaggaggctgggtgggaggattgcttgagcccaggagttgaggctgcattgagctatgattatgccactgccttccagcctgggcagcagagcaagacactgtctcaaaaaaaaaaaaaaatagtattgccaaatagccagtatgaatcagatcttaattttcctgtgtttaatactttgctttggattgaactgttagagaagtacttcagtagctagctgctgagttacaaatatgttgatttttttcctatgcatttatcctttaacattctagtcccccaggaccatcttgagaacagtgtggcctgctgcacaagcttttctcccttgcaaattttgttggggaaagccacatttcccacctagcatcacagagtgtgtttttctttaattttataatttgcagctctacaaagactgtgttgataggagcaaggtgtgtgagacaataattatgtttgtggaaccttgtcacattttcttagactattattttagagaacagccctaagccaagacattgggtcttgtgatccttttcaaagaaaatcgttgggctcgttaatcctttgattcaagtcttttttaaaatgatattttccattttgactaattgaagatttcccactaagataaatggaagagacttatcatttgatcaaaattatagcagtgcttgatgtttgcctactaccctacagttttcaaacaaaatccatttacattcactcatttaattatccccctggtttttctggataagcagagtttcccatgggtggaatgcttccattcttgggaatactttatatttcctctcagatttatacatttctagttggcacagcttctgccgttcagatgcaggaaatagagaatgccactagagaaacagatggaaagacaagaagcagatccaagtatgtgtaagttcatttgttcattcatgcatccagtcacttatctatttattcattattcattaaacaaagttattaaatatactatggcagtgtctcccataggaggtaatatgataggatgtttaaaagtagaatgctggagtaggaaatcttccatgtaaacatttgttcagacacttgctaattttaagtttttcacaattttttaatctaggcaattgggaaattatatagtcaatctgtctttatatggtatagcagttctgtgttttctgttctaacttcaaaaaaacaaacggaaacagaattgcccagtgattacaatggcaccagcctagatcagccagcatttagctgactcccagatgtgtaagcacccagccaagatcagcaatgccccctgactggccccctttaaagacttaaacgtagtcctaaaattaatatagcaccttctttctgatccaggtagaagtacgtgtctaaatgtttctagccctatggtagtgtctgccacggcagcagtagcaatgggagcagctgtgttaaggaagagtgagggttccaacttttctgctgatctgggaagtagtggatgtggagggttgcagtgtcagagaaaaagcagccagtagacctaggtctcttggtgaaggcgatgagtttgaggagttccttgccaaaggctgggctggcttagatgaagatgcacgtgtctgggaagataactgggataatcttaaggccagaagtttgagaatttggaaaacgggcacttgtttactggtgggagtgagcgtgctactgttttgagtaacctggcaatgtgtctttttttttttttttgagacagcatctcactctgtcgcccaggctggagtgcagtgggggcgatcttggctcactatactctgcctcatgggttgaagcaactctcctgcctcagcctcccgagtagctgggattacaggcatgcaccaccacacctggctaccttttttgtatttttagtagaaacggggtttcaccatgttggccaggctggcctcaacctcctgacctgaagtaatccacccacctcggcttcccaaagttctggaattacaggcgtgagccactgcccctggccagcaatgtgtcttaaaaagttttacttttgagttagaagcatttattttgacccaccaattctattgacaggaatttattttgcagaaatagtcaaaggtcttgccaagatactcatgatatattattaaataaacaaactgaccacaaaatagcaggctcacataattcagtttttaatgcatatgtacacacatatcacacctagaaaaaaatatggaaaggttttatatggaaataacattaatatttctggatagtgatcataaacaattttacttccttatttctttttttttattttttttgagacggagtctcgctctcttgcccaggctagagtgcagtggtatgcagtcttggctcattgcaacctccacctcccgggttcaagcgattctcctacctcagcctcccaagtagctgggactacaggcaggcatcaccatgcccagctaatttttgtatttatagtagagacagggttttaccatgttgtccaggatggtctccatctcttgaccctcatgatccacccgccttggcctcccaaagtgctgggattacaggcatgagccaccacgcccgccgcttccttatttctttagcttttcattttcttcctaattgttctttaatgagcatgcatggcttctggaattttttttaaaagcacaaaaagattatttttaacagaatggttttacctggtaatggaaaatataatgacattggtatcagggagataaattcagtccagtccttttgggagagcaatttaccattgtatcaaaggttataaaaatatgcaactcctttgatgcaaaattttgtctgggaactggaatgagatgtatcatccccgggtaatagactggagactcatttcttggggtttcttatgtgtgtattttccaagttttcagaaaagaatgtgcagaacaaaggttgtaaaagaaattagagactccttgtaggttcctatgtttatatcattttcttgtcaaggaaatgagctacaaaggtgccagatctaatcttgtttacccttgttactgcccacacttaaactgttggtgcttgtgtttctcatcctacatgcagaaatattagtaatacattaaagaaatgaaagtgggcagacatgcagaaagttttatgtccgaggacatttaattagacattctgggccattaaaaaaaaaaaatcccagaacatttcaaagtaaaagttgtaagcgaaatggcagaatggttatgctgagtacctgttagtgtgtcttgaccttgaatcctggcatgtgatccatgggtctgggaattgtgtgcagcaggtacacagcgtacctgagaggtaatgaagccagtgttttaataagccctgccatacttagaaattcaaatccatgttactcccttccacgaagggaggttatagaattattctagtacttctgatagccacaaaggtagaaggaagtgtagaatgagctccctgtggacccatcaccaatttcaacagctgccagcatttgccaactcatttcatttatttttctcccacctcatttattgaagtgtttttttttaatttaagatatgtcagttcacccataaatactttatctcttttctatttcacccataaatatactcatttctaactgataagcacactttaaaaatgttttaatagtattattactttttaagagacagagtcttgctacgttgcccaggctagcctcaaactcctgggctcaagtgatcctcctgcctcagcctcccaagtagctgggactccagactcacaccaccacacccagccagaaaacatgttttctaactagtcaacataccattatgccacctaacaaaatgaatggtaagtcctcagtatcatctgacatccagattgtatcttaattttcccagttgtttcaaattttctttgttgcagttggctctagatactatatttgcttactatattttatgtcttttaaaaagtgttttaaaacttctgtttttcaatagactgaatgtatatcattgcacttctctgtgcaacacaagaaaactataatgtttccttatcatcatccttactattatactcttagtaaagccctgttacatagtttgatcatcttatatgtcagactcaaactctgaatgacctctggcttttcctttttttttttttttttttaattaaaaaaattttttttaatagagacaggatcttactatgtcacccaagctggtttcaaactcctggactcaagcaatcttcctgcctcagcctcccaaagtgctgggattagaggtgtgagctgctgcacccggcctctggctttttctcaaaattaaatccacctcagtgtccacatactttctgccagggaggataattaaaactaccttcagacagtgctgtggcatctccaggtggattcagaacaagattccccaaaccagccgtgggcagtgaatcacggggtgatagttctccgtgtgtctgatttgaagggtcctcttcccttggcgtaacatcaaagacagatcttagcacctcatctgcatgaactgagtgtataaatgcctacctgcttgacttacctgttctgacaggggctattggacttaccactaatgtaattgatgtgtttgttttcacacagataatcgcttatcagccgtatggaaaatctgtggactggtgggcctatggcgtcctgttgtatgaaatgcttgccgggcaggtaatgttttgctacattttcatgtttgtttattgctgtgttatgtgaatacttcagctctggttgggcctcgagagcaagacctgacgttttagtgcagctggtgttggcgtgacttccctgacccaggcgaaagagggagaaacgcccccttcaaagtggatcacgttcagtatgcacagaaattatctctggtcatagaaactccaaattgaaagctacaacctggagtgtagacagtgtcagtttcacgttatgaaatgtacatgttggccaggcgcggtggctcatggctataatcccagcactttcagaagccaaggcaggcggatcgcctgaggtcaggagttcgagaccaccctggccaacatggcgaaaccccatctctactaaaaatacaaaaattagccaggcgtggtggtgcacatctgtaaactcagctacttgagctactgaggcatgagaattgcttaagcctgagaggcggaggctgcagtgagccaagatcgtgccactgcactgcagcctgggcaacagagtgagacggtctcaaaaaagaaaaaaatgtgcacgttgatgacagcagtggcctctaagttttcagtatcttaaaactggggttgggttatatggttccctgcaagtttgtctgcaaagattgccccagctgctgccaatgtgtgtaattagtattattatttaaggaagaagacagttaccttgaagaagtgttttaatagtttctccccatctcctcctatctcacccttggcaattcgttgtaattttcactgaagtccagtgaggctgaacatccagttaaggaaggtaaattagctttctcttatgatgtgacatgtaccagataaccatgtgccttattgcctaacatggcactttctaatataatggccttaatatctgtgtcatcagggtgaatcgtactatctgccacttctaggcctggcccctaagacatcctttatgactgtcctcatgctctaggctgaaattaggaggaattagtggagaaatctgagaccctacaagatggtggtgctgatggatgcgagaagcctgagtctttgaatgaccctgtggtcagtgcccacccccacataggacacttccgtggcaaagtcccatgtgggggtggggcactgacccacaggttcattcaaggacacaggtttctcctgtccgtcagccctactaccttttagggtctcagatttctccgctaattcctcctcctttcagccgagcacagatcagttacataggatatcttaggggccggcctagaaatggcatgtatcacttctgcctaggttccactggccacttggccccagtgggacacaaagaggcaggaagtatagcatatctgagagctcagcaggggaagcaggcttggtaatcacgaagcaggcttggtaatcacccagcagatctctgccttatactaaacatgattctgccgtgggcagctttttataattcccagcactcacatgctagtgccaagacctgtgactctccatagccagaagccttagtcagagacaatggaaagagatggccatgctgtgcgacagagccacccccaaagacatctttgtttctggggaaaaagtcttcccttcccacatgttacgtccattgactcatttattcattcactcaccacgtatttattcactgaatgcttacaatgtgcatggccataaggatgaacaaaacagacgagaatccttaacttcgtgaagcttacagcttagaggaggagagacagcagacaggttagataaggaaaatgtataacacagcagaggtaagctaggaagaaaagtaataaagcaggaaagaagatagtgttgggggaggttgaaattggccagagaggataaggttaagacctaaaggaagtatggggttgtctgtgtgcatatctgttgaaagggcattccaggcagagggagccaccacgcgaaggccctaaggccagggaatgtgcagccacgtttaagaaatggaagctcccagcagggctagagcagaattgagctagagagggagggagtaggaggcctgaggccagagaggaagaggctctggatcctgttgttagcagtggtgcatccccatgaggctgcagcaacctcagttcttgcctcctcagaagaaagaatttgactgtggggcatcaggtagagtgagagcctaagacaagctgtttctgttttgttttgttttgtttttgagatggagttttgctctgttgcccaggctggagtcggtggcgcgatctcagctcactgcaccctccgcctcccaggttcaagcaattttctgcctcagcctccttagtagctgggattacaggcacctgccaacacgcttggctaatttttgtatttttagtaaagacggggtttcaccatcttggccaggctggtcctgagctcctgacctcgtgatccacccgcctcagcctcccaaagtgctgggattacaggcatgagccactgcacctggcctaagacaagttttagagaggaatgaaagttcatggaaaagctttcaagcaggagcaaaaggaagtaaagtacacttggaagagggccaagccggcgacttgagagatctagtgcactctttgacttttgacttggggttttatgcattggtgttcttccagggtcttacatctcttctcccctgattcttcccttgggttgggctgtctgcgtgcgcagtggcctgctagtgcttgggaggggcggcatgtgcagtgtgtttactggagttacgtgtgtgctcagctgaggcattcttcccttaccagtcagatgtcctagaaggtggtgtaccagttaaactccgccatgttgccttttcatgcgcgtgcttgagcccactcgcccaactcctgaaatcttattgggaagctgctgctcaccagtttcaggtgtttccctttattgggagactgcctttccttggtgctggctgcgaccaattattattttacagagagagagttaaccacctgatggtcgcctgacattcctggtgggtagggggagccctctcctgccctgcccatgtccgaacagccacctgttgtaacactgtgaccatgaacgtcatctccagatcagcggctttgcctctaggatgggaggctgtggatgatctctcctttatgtgtctttcattatatttcctaaatactgaaatggtcttgtagacattgaaagacataaagctttagcctgcatttgatcattatttctcaatggtgttaaggcttgactgacatcaaaagagtggtttattatttatttagttcccctccccccaccccaaatcaaagcattcctcttaggccaaatacgtccgggtgtaaacacagaaaggcagttcgtacacagtcaccatcagtgagtcaatggctggagaaacaggagttgtctgctcctcaagttaatttccccctctttaaaatttttacagtaaaattcggctctgaattacaggccccctaagagtcctgcttttcatgaagtcacaaaaagccaagtccccctcttgatcccacttgaatgttcagctcttgagtctggaaaacaaaccctgctttcattaagagtcacatttgcatatgctaacatgcaaaaggggctgggcggaaacgaagccaggatctgtttccgagggcgctttacaagaggtcacgtgagtagactcttggccagcaggagacaagaatttcagaacccaggtctgcaggaaagtcctcctccctcccgcagcctggcttctcccctctccaagccttcctgggatctcattcactaggggagaactcagggaatgctttcttctggcagagaagtcccctttggggggtgcattttgaagctctgccacactggcctcagacctcatttgcaaattggcctgaggtgatttacaggccttatttaaaggtttccctactaagctcacgccccctggagagcaccaggctccagctctcaatagttctgcaaactttctggcctgtttccaatatttcccacactgcttctcagagccacttagcctgccttatatgcatactttcaggtctccatcatctctattaaaaacggtgatggctgggcccggtggctcacacctgtaatcccagcacttcgggaggccgaggcgggcggatcacgaggtcaggagattgagaccatcctggctaacacagtgaaaccccatctctactaaaaatgcaaaaaaaaattagccgagtgtggtggcgggcgcctgtagtcccagctactcgggaggctgaggcaggagaatggcgtgaacccgggaggcggagcttgcagtgagccgagatcgcgccactgcactgcagcctgggcgacagagcgagactccatctcaaaaaaataaaagaaaaaaagaaaacggtgatattctttaaagatgacaccttagaccaggtgcagtggctcatccctttggggcccttgggaggccaaggtgggtggatcacttgagtccaggagttcgagaccagggcaacatgacaaaatcccgtctacaaaagatgcaaaaatgagctgggcgtggtggcaagtgcctgtcatcccagctacgtaggaggctgaggtgggaggattgatcgagcccggggggtcaaggctagcagtgagctgtgatcatcacaccactgcactccagcctgggtgagagagtgagaccctgtctccaaaaaaaaaaaaaaaaacaacaactccttaaaggcactccacattctggtgcaatggcaggcacagataacagcctttgttcctctaaatctccacctcacccgcctcaaacacagtgttttcattcaaatccccttcttcatctttctctctgactcctcaatgcaaatttaaatgtattcctaggctgtcactcagctcagaaaggataatgaaggctctacccagtattatccacagcccctccaagcttcagcaatcccagagacccagcaaacggaatagatgttgttattgaaaagtaagattaatgataaagtcgttgacagggttttggtctaagtttgtcctctttaatcgcagagggctgaagatgagcaggaaaaaaatagtttattgccattttcttctcatttgctttatttattgtcagcagccaagggggcagttaagaataaacagcctcagtctttattcagttcctggactgcttgacaaatacaatcacttttggggcataaatagtgtttacccagcactctaatgagcaccttgtgcctgcaagtgttctcggtgatcgtcataaagggaccagccctctccttatgcccttttctccctgggttatttatgctttgatttcactcctactgaatcagtaatcgccacttcatcttaacttcggcctgaattgtccaggggagcatgcctagcccccagcccaggtttccgtgatttgcaaataagcgtggcctccatgaccacttcctagctgagatcacaccagtgcagtgaggtggctcacagctgtgattaggaatccttttttgcaaaatgtgaaccatcactcctcatgtgttggtttccacaaatcacatattgttaaagtgggaaggagcgggtgagaggggatagaacccattcagaaaatgtttacaccaacccaagacttttcaacaggtagcttagcctggaacattgagtccaaatttgtagaaattaaaaaccatgggaatgggggaaagaggcgagagaaggcatccaaaatggtaatgtactaaagcacctgagtgacacgttacccccatggtccccaggctaagtggctggcagtaccagaaaggaaaaggaatagaattagtaacttttcaccgttcccttgccttcaacgccagggcctgagagcgagtgattacctgtcagatgctccagggagacttgagcctagagagacttaacaaaggccgtaaatgtgttcacatttttttaggctgcaggatgccacacctgggacgttattatggggatgtgattcagagaagaaaacaatgatatgcacaggtgtctctagtagcgttagtgatgagggtacatgctggaagcaattgtaaatgtgccatggaacagtggatctgtcctgatgacgcatcacctcaatggcattcaactcatgggaacactggcagcaacaaagaaaatgtatttgcaacagtcggtgaaaaacaaaaaaactccaaattatgcatcataatttgaaaataatataagaggctgggtacggtggttcacacctatagtctcagcactttgggaggcccaggtgggtggatcacgaggtcaggagtttgtagaccagcctggccaagatggtgaaaccccatctctactaaaaatacaaaaattagttgggcgtggtggtgcacacctgtaatcccagctactcaggaggctgaggtgggagaatcgcttgaacctgggaggcggaaggttgcagtgagccatgatcgcaccactgcactctagcctgggtgacaggcaagacttagtctcaaaaaaaagagaaaataatataagaaagcataagaacccacataaaaataagcgcaatttttgtgtccaggtaaagggaatggggatgcttttttcgtagacttcccttccacaccatattacataattttcgtttaaaatagggcttcaggccaggcgtggtgacacacacctgtaatcccagcactttgagaggccaaggcgggcagatcacttgaggtcaggagttcaagaccagcctggtcaacatggtgaaactccatctctaataaaaatataaaaaattagccaggcgtggtgacgtgcacctgtaatcccagccactcaggaggctgaggcaagagaatcacttgaacccaggaggcagaggcttcagtgagctgagatcgcaccactgcactccagcgagtgagactccatctcaaaaaaataaaaaatataaaaataaaacacgggctccagggagcttttctgaatgtgctggtcattactgctattcaccaggtactcccagtcttcctccctcctggctcagtaggattgtacttcctttctcatgtgtatttgtggggtgtcagggagcaacatatgaccagcaccggccaatgagatcagaggggaggtgtccagggtggggctggaagcgcaggtacaagacatggcagagctgctgctccagcctttgctgcagcaagactgtgatggcagctgctccatcccggtgggtccccgaatgcaaccagcagaggcctctctgaccctcaacgtacaggtagcataagcaggaagtgaaacgggttgtcttatgctttggagatggtctcggttgtttgtttccacagcaggacccagcctatccttactgataccggaaggcacagttaagataccaatagtctacatcttgaagtaagccagtcacagggacgtgtatcgtatcaccccacttacatgagatgcctagagtagtcaaatcatagcaacagaaagttgaatggtggctgtcaggggctgagaggacaggagaatggggagtctcttttgtgagtggagtttcagttgggaagatgaaaaagttctggagatggccagtggtgatggttacggagaaacatgaacgtacttaatgccacagtacagtgcacttaaaagcggttaagatggtaaattttgtgagagagagagagagagagatatatatatatatatatagtgtgtgtgtgtgtgtgtgtgtgtgtgtgtgagtgagtgtgagtgtgacagagtcttgctctgttgcccaggctggagtgcagtggtgcaatctcggctcaccgcaacctctgcctcccgggttcaagcaattctcctgcttcagcctcccaggtagcagggactacaggcgcactctaccatgtccagctaatttttgtatttttagtagagatggggtttcaccatgttggccaggctggtctcaaactcttgaccttgtgatctgcccacctcggcctcccaaagtgctgggattataggtgtgagccaccacacccagcctgtgttatatatattttatcacaattaagaaaaaatagtctctatctttgcaacagaggttatatatattttatcacaattaaaaaaaaaatagtctctatctttgcaacagaggaaacagactaggaaaaaggatgcctttgatttgatggtattccaaagctgggaggaggcacttaactactcctcttccctatacccaagaacagcccccttttaccttcttcaggttcatgccaccttcaaccagcaggaatttggggaagcaacacagaagctgcatcggccagcagctgggaaggagggaggcagcctgattcccatcaattcattagagctggaaaaccatgccaggtctctagcgcagaggccagtcgctctctacgggatgacttgaaacatctcaggcccccagggctgccccacccccttcattttcagaactcatcactgcatattgtgcaggctgtgaatcagccttctaaaatttaccccaacacccttgccctcattagagtcttctttacatgctgggtggggctgtagccgagtaccctctgcctcacttcacccctaccaggagcagtgttggatgtcacccttcacagtggggcaggcggaattgctcataatggctaagagccccaggctccaaattcaggatgcctgggttagcacctgtgtcctgagactgatttgcggagtgagcagtgccacccaagccgtctgcacagcacgtgacatgcagagagaggctgagaaatgaacgccactgtggtcactttcgctgctcctaccctcatgcccacgatgctcctgccttattgggtaacatagactcacagcggtgaaaaacgtgaggagcagagacatgtcccctccctgacatgtggtgacagagaatccctaatccttggggccacatcaaggctggaatgcacaggctctgtcacgggtgtttggtcttgtggctttgttacagcttgggcatcttattccaccaggcaagcctaagaggcctctgagaatccttccagccctagactaagaattcacattgagttaaacagctttgttcactgcaggacttctcagggcctgtacaatttaaatgttaaagcaaattgccagagaggggtagaggatgcaaacttggacccaggaagatgctgtaggattaatgttctaaggaatattctttggggagtgtcagtatccagccttcagtggggcccagagaagacttgacagtaaaagtcctcctttcatctatagaatcgaatccctgatacagccattcaccttcagaaatgagcatacgtggggacagctcacctggcaaagctggttcccatgccaggagacaattaagtaggtgtggtaggccagtgccctgcacagaatgttccccaaacgattcctggccttccacatttgaaggtggggtggctgcagctgcattgacctaatcgtcttcaaatgaggagaagcttctcactaccctactcaagacagatttctggggaagctccacctgtgttccttagagaacgtttctcttaggcctttggtttgcattgtctgtgacttggcccctgcagcgttcctgcagctaagattcaagcacctccagagaggctgattgaatcttgctggcgcctttgtcactgcccaacaaggtgcaccccatttagcccgcttcgggggcatgcagcctacacggtcgcacagggcccaagcccacaagagctctgtgcatttggtttggtgctccgctgtcgcatctggaaattcttaataatttttcaatgagggactcccgttttcattttgcactgagacttggaaagtatgtgtctggccctgaccacaggccctcttgggccatgtggtgaggtgccagtcagtgacctggaagcagagcctctgccccgctccctgccagggcacatttacattgcagagagggtcacacagccagttcaggagccttgagcccctgcagggtgcaggccacgccctcagcagaaaccacaccatgtttttgttttggaaacagagtcttgctctgtctcccaggctagagtgcagcagcgcaatctcagctcagtgcaacttccgcctcctgggttcaagtgattctcgtgcctcagcctcccgaggagctgggactacaggcgtgcgccaccacagtcggctaattttttgtgtttttagtagagatgaagtttcgctgtgttggccaggctggtcttgaactcctgacctcaggtgatccacccacgttggcctcccaaagtgctgggattacaggcgtgagccaccacgcccagctactacatttgttttagttatgaaaatctccttcgccaaaactcagccaggtttatggatcactgattagggaaaatgagaaatgttatgggtatcataaaatagatgtccagaagaagcaggctgcgtgctgttaggcagggaagatacggtggggtggacacaaggatgacctgcactgtagctccgtcacagctctcccccaccactgcctgcctgccctgccctctacagatgaaagccacacgtccccctgatggcacaggtagctgtccctgctgacacaggtggccgtcggcagcctgcaccccctggtgggtgcccccccaagctgccctgggggcctctcaggctccatgttgctcctgctggtggaagttgctgtggccagctgcccctgccctgttctgagtccctcacaggcaggctcattttagctctcttcacccacctgcagcttccaccaaattgaaccttccttacaccaagcacttacaacagaaaaagaggcctatttatttgtatttccagaccaaaaaatgttgagtggtaccagacacccaggcctctctctgtcctcccactggggctctctgtagacttggcatctttccctcagggcacgtggctcctgtccaggactgggcaggggactgaggtcaggtctcgggtgttggatgaacaggttgaggtgatttgtgggtggtggttgaggggagggacctacttggctcaacggctgcctctgacttgggagaaaatgtttgataagaagggcatccttctgactactgcgaagttacctgtgatcgaggattcagttcaaaattaagccaaacaccatcactgtgtgacctgcccgtgtcagccaaagtgactgactcctctttcccacgagaaaggaacatctcaagattaaacaagaggattctgtacaagcgctggtccttgctctgcctttctgacgctaagctcaaggttacgcagccaaagggggagcattacggaatttcccatgaacgctttcctcctgtgccatcccgccagagtgaccgggaagtgatggatccctcaggactacagacatgctggaggaaaaagttcaaagggcattgtgagctcagcctttcctcctagaaggtgctcaaggcccctcccaagagagttgctctgtcttaaataataatactgctaagttgccttcattcggcgcttattgggtacaacataaaatacaaggcactttactcccagaaaccccatcttacaagttggagaactgtgtttttgtttttgtttttgagacggagtctcgctctgtcacccaggctggagtgcagtggtgcaatctcagctcactgcaagccccgcctcccaggttcaggccattctcctgcctcagcctccccagtagctgggactacaggcgctcgccaccatgcccggctaattttttgtatttttagtagagacggggtttcaccatgttagccaggatggtctcgatcacctgcccttgtgatccgcccgcctcggcctcccaaagtgctgggattacaggcgtgagccaccgcgcccggcctggagaactgtgttttaaagaacgaagtcatttgcctgtggacacccagctgggaagttagtagagctagaattctggtccagatccacctgactctaaagccacaaggtcccacggggccaccgtgccttcctctctcagcctggtaactgtaaacccagtcaaagcggatgagggaggagtccaatggaagctaaggtcccatcactgctgctgtgcagctggaaggccctccctcagagcagctgcttgttgggtcagaggcccagtgtgaattactgggaacatcctcttaggccacgttctcaagtccccttcaccccaaatgaaagtgttggcattttctaccggccacccccaccttctgaccacaaagccatctgtaacctaacttgatcgtaattagatttttagcacataattacaagattaatggattaatcataatttatttgcaaatcattaaaaacattactcaaaaacactttccctaaagattgtttgggttgcccagggcaagataattaacgagacagaggggaaaaaatgaaaaacacacaaccgtcaatctcattaaagatgatcaaataaaccgtcaagttagctgagcaaactgtgcagcctgtggtggggctgagaaacctggtctgttccttggtgctgaattggctcttcaggcaccatgtgaatgaattactctgcctaaatactttcccatctttctttttttccggaacagcctccatttgatggtgaagatgaagacgagctatttcagtctatcatggagcacaacgtttcctatccaaaatccttgtccaaggaggctgtttctgtctgcaaaggagtaagtcgatttggataccttttgtgatcatggaccaagagctttggtaggagaaatactttccccacacttctaagagagatggcagaaacaccacaaacccacaccactgcattttggccatcgagggttggggcttggtgtcatgccccaagataaccagcaccccaactttggacagcatggattagtcttggcctgttttgaactctgcacaaaccgaaccttgtagtgttgctcctggcctggctgctttcactcaatatggtgattgaggatttagttcctcctttcatattgctatgcagtgttccactgtgtgaacacaccatcgtttccttatccattctactgggcagggcacagtggcgaaagtgaaggccaagagaatggattggaatcccaatacttcctgggactctggcccagtcacctaatgactgtaccgcacttttcattctaatccatttcataaaattgtggtggggactaccagatgtcatcagagtcccttagaaagtatgtgctctcgtctcctgtcttacttggtgtgacttagttctttctttgctacacttttcttgagctatagcatacatacagcaattggcacaaatcatcaatatgctgataaatgaatcttcacaaaatgaatccacccatgtaattgcacccagctcaagaaaccatgtttccaccaccctggaagccctctcctgtcccatctacagtcactaccccgccccaagataacctgccccccaactttggacagcatggattagtcttgcctgttttgaactctgcacaaactgaaccttacagtgttgctcctggcctggctgctttcactcaatattgtgattgaggattttgtctgcattgctgtgtggggccatagttcctcctgtcatattgctgtgcagtgttccactgtgtgaacacaccatcgtttccttatccattctacttctggtggctatttggattgttcctgctttggtttgaggctgttacaaacagaactgctgtgaaccttctggggcatgtgttttggtgaagatatgcacacactttggttgaggaaatgctctaggaatagagttgctggtcatgacttgtctagttttgaatggtcaagagttagatcacaaagctattttcaggcttagtaagatggagtacaatatacccttaacagtatctggtgagtgtgatcatttgtgaggcatttgtcacgtgtcatccaagagcaaggcacttggaagagatactgagatcgggaggaactggcttctgccttcagagagttcatagacagtgtttgtctctgtgtcctgcagtgggcaagtcggaattaactagtcgccttccttgttatagcatttatttttctaatctatgagtctttgattgataacattttggcccagacaatacgtagacatatgatgcttattatggcatcctctgtgatgctagactgtgatgctttcagcacacacaatttttagtgattgcatgcttttttttttattactagatacatgtatagcatggtgtctccaaaacagacaacgtgtgagatgtctgtttaaattcttcttccatttggccatgggttcagattgcttccttgttcccttgtcttgaaaaccaccataggaagggctattcttgccaatgtcatttttgtgagttggcttcacttcgtacaagccactgagtgtcttggtcagctctctgagatgctgtccaggcgtccacaaagtcagggctgtaggcagagctaggcaaatggaaggtgctgtctgtgggaagcccttgacatccattgttctccttttctccttttcctttctagctgatgaccaaacacccagccaagcggctgggctgtgggcctgagggggagagggacgtgagagagcatgccttcttccggaggatcgactgggaaaaactggagaacagggagatccagccaccattcaagcccaaagtggtgagtccagaaaagcagcctgttttcggaaccccatgtccccaaattctgggagtatcccactcacctcttttcttggagagaggaggccggtgcccctggcttgtacagggtgaggaaacgggccaggtttcagccttgtcctcagtcctgtggcctcagcagccgggattcctgctgccttcagagagtaaggaccgataaggcagggaggggaaccctgtgcacacttcatcctccagctggacagctgcagagcacccccgcacgactagggagtgagggcagctgtgctttaggtctggactttgtggactcgcacccagcagggccgtattcacagccttcagtcctcagcaggactcaggcttcgtgtctgtctctggttttcctgggtttgcctggcaccgaagggagctctgaagcacaaccccgtcctagccagcaactaggcagggcctgggccccgccccctcttccaccactgcctccactgcggggagtgagtgtcagccaccaattctaatgttgtcagcttttttcacactctccctgtttgattcccatttttttcatttatttaaacactgtatgccaggccctgttctgagtgccttacgaatattaattcactcaatcatcccagcagccctgtgagatgggtactatggtccccagtttgcagtggaggaaacagtcacagagaggctgagtaacttgccagaagacacacagctgatagatggtgaaaccaggacgagtctttgtcctcacctactgcaccatcgctccatctcagcaactgccctgacgctgatgctgtgggccctaattgttgattgcggccagcaagtgcctttcatgtttatatctctagaggtaaactgagagcctttaagaagtcagcctgctcactcaccacctgccactttgcagagcctccaagggcgtcctgtttctaagggccgggcggactgtgccttccagctctgccaccatcttggccagcatcaggcagctccccattgtgcctctgcccggggactgcagagagctgctttatgccacagtcagtttcagaagcatcgccctgttggtttcgctcaaatgtgtctcctctgacaggtgccccatgagcaggccaggggacccacctggggtggcacagttgccaactgggtggcacacagccttattcttagagcagcaacttcctcaccatgtgtgcctctgtgtcctctaccccaagaataaaactgctgttggtgagcccactggattttatttttcgaagatatttttagcacacactgaagaaaaactaaaattaatcaggtcagttgacttcctcctgaatcatcgtttcaaataaggcccttttgtatctgacacccccgccttttctttagtcagccctgcacactgatttcaggggggtctcacgggctcctgcccctcaacatacaaaacccggtctggaggtttttgggggtggggagagtgattaatggtgctgcaagtggtctcagtagaaaattctgttagggattatttttttttcctcttctgcctttaatatttatttgttgtcttaaaatatgaaggttatgcaacagcatcttgaacacagcttagtttctttataggaacaacgtagagatgcgtactgaccccgccttgagggttgggcaaaatccaattacctgtcagtcactttccagaaagcgatgagttgcagcaaaaccaaccataaaacatgtctttttctatttattgccacgttatggcagaagagagtgtttatttgcatagtctcccacattttgtggatactcggccctaagctcggatatagggaagacaacagggcgacttggctccgcaggcaagaatgtgaactgttctctgtggtccacggaaatcacaggaagcaaaattgtacccatggcaggcagctgagttaggagcagtgtttatttatattttattcctggagcgctactgtttgctggttttttttttttttaaattattatactttaagttgtagggtacatgtgcacaatgtgcaggtttgttacatatgtatacatgtgccatgtcggtgtgctgcacccattaactcgtcatttagcattaggtatatctcctaatgctgtccctcccccctcccttttgtttgttttttaactgaatgctcgttaaaattaagaaggaaggataaattgcccctggctgtgaagaaatagcccctgaactcacaaacggaggcagaaattgtcgacccaggccctaaaactggaggtttcatgcaaaaggccccgcttggtaaaagctctggccagaaggaaggaagagatttctcaggcagaagcccgtgttctgctggaaaacctgtgcacaaaagaggaaggagctagaaagaatacagacagacaggaaatggacccacagagggaacaacgacagtgaagatagaagcacgtggctgcagggagacccgtagacgctgtgttcaaaagcggagagcgtcaagggcagagagataaatggggcaagctctggttcctggaagggcagcgatgtgcctcttgagagctgtttcctgtagtccttgccccgtgccaggcagccgagtgaggctcatcgcagcatgtcatgcaagggctggcaccaccgccttcagcggtctctgaggactgcactctgttcagtggtgacacgctggggcagagacaccacgccaagagccattccagtggctggagaggacatttagaacagcaaaaagcaaccaaagtcgaagctgcacaatacgctctggttaatacaaacagcaggagagaactagcggcgtagaaaagttattctgggatgtggtgttccagcttccttggtgaaaaatgtactgtagtttcctgatccagagctaactgaaaagtgaaatgtgtttacagagctgagcattctctaacgggtcattttgttatttcaaagagagatgtagcaatgccagcctaaatagtgctgctggagaaacgatcaggcaaatgtcacacagctagcgactctcaccgtgagcccatttctgagtggctctcgcctctcagcagttcttataatcctggctcaccaaccttttctgtcttggtgaagtctgcctgatggttttttagcaagcgctggtgagtcagtttccctgagacttgcaggcttaaggacaggtagctgttctcacgtgcggtgatgctcctggctcccatggaattaaacctttgcttactaccaaataccagtagcgggacttcaggttctcacagttatttgcaaactgcttctacagatcagattgagcttgtaggatcaggagtctatcatctttgttttattaatttttaaattttttgaacctccaatgaaagagtcttccagaatcactgacttccctaaggagggtagaagcattccactgctggacagccacagagcttatcagggaatcatggttcctctagtgtgctgtcttaatccctcttcctgactgccagagtgacttgactgaagttaacctttagaccgcagtgccatgcaaaatgcgatcccagcgcaaaaagcatctcacaatgccgtgatccatcaggaggttagcacgggactttccatctcacggcgacattaagatcaagatctgcagtacagctgtgggctggattctgtataaggtcacacgtaaaggagaacagaaagaggagagtgaccagcatcgagtgtgtgggacagtggccatctcccttagcagtggccaccttccctggcagtggccatctcccctggtggtggcagggtcccatggcggtggtcatctctcctggcagtggcaagcctggaggctgagatgtgagggaagaacctgcccctgtggcagtcaacagtgggagagtcctgtcctggacagagccatgtctgtccctaaaaagctaccatgtgccaccgtgaagatgatgattttctggaagatgggacaatcacttctcagggatcattttgtaaaaacaaaagcaaagacaaccacagacagcagtgctgtgagccctggacacaggcagccaacaactagctcttcctctttatgagcaaaacacaaaacgagctggtttcggggatctcttcaaggaagcacaatgtgaagcatcctctgctccccggacatgaggacggtcagctcattgaggaccgtcagctcagtgaggaccgtcagctcagtgagggccatcagttcagcctgatgttctcaacaacaaacccgagtcatcaaaaagaggcctgtaggccaggcgtggtggctcacgcctgtaatcccagcactttgggaggtcgaggcaggtggatctcctgaggtcaggagtccgagaccaacctggccaacatggtgaaaccccatctctactaaaaatacaaaaattagctgggcatggtagcacacacctgtaatcccagctacttgggaggctgagacaggagaatcgcttgaacctgggaggcggaagttgcagtgagcccagattgcgtcattgcactacagcctgggcgacaagaatgaaactccgtctcaaaaaaaaaaaaaaaaaaaaaaaaaaccggaatgttcagaagagtctaggtaaggagaaattttaagtttaaaacagatgtcgcctctggaaagggtaatcttcagtgactgaaggagcagtggatgtccaccctacctcccagcgtcaggtgagcgtggaggcactgtggggaggagggtacagccagcagcttggcccagcaaccagaaggctcaccgagggaaggaaagcactttcggctttgccagaaaaataaaagctccaggattctgatccaccgtcactttgaattttgtagctttttattctgatttagaattaatgtgaatgaaatggccaagaacagccttcaaatttccactcatcctgcttgtaatcagtagcagtttatacaaataccaggagcataaggttaattgatttttctttttttagttctagccgttggcaccaaggagcagaatagctagttcataggcaagccagaatcattcactgtacttaaatggttattagagagggagaaattaatctataatgttaacacaagaaatgtattccagagtggttaggcagagcacattggaaatagacctttcacagatggccattttttttgtgaaattactttaagtattctgttttttaaaaggcagaaaaatagaactttcttcaggacattgtctccaatgacccacagcaagagccaaagagaataagaacattgaggacatccctgtagtgagaacacacaatcggggttccttttcccagtcaccacaaagtccttcatttcccagtgccattagcttgtttagagagcttgatgatcatttaattatcgaagctggtgcaaggatccttttttttttttaattttattttgaaataatttccaatttcagacttgtggaagggccaggaaagtaatttaaagaactcctgtattcctttacccaggttccctaaatgtgaacattttagcatgttcgtgttatattgttttttttgttttttggggggggttttttgttttttttttttttgagacggagtttcgctctatcacccaggctggagtgcagtggcgcgatatcagctcactgcaacctccacctcccaggttcaagcaattctcctgcctcagcctcctgagtagctgggattgcaggcacctgccaccatgcctggctaattttttttatatttttagtagagatggggttttgccatgttggccaggctggtctcaaactcctgacctcaagtgatctgactgcctcggcctcccaaagtgctgagattacaggctgacctcggtatcattctttttctatatctctgtctgtgtgtaggtacagacatacacatctgttaggttggagcaaaagtaattgcggtttttgccgttacttttcattttttttgccattacttttgcaccaaccttaatatatacttatttttttctgaaccatttgagagtaagttgcagagttaatgcttctttacacctagataattccatgtgtatttcctgaacataaggacatctcctggtactatgttcttttaataattactccagcaagctaggtatgtagtgcaggggctctgcaggtaaaaggaggagggagggtccctggcatggctgtgtcacagatcagataccataggcagcttgggccacatctcatcagttctctagggtggcaggcagcttcattctcttggcctttctgttgggccagtaacaatgatgccaattaaaattgagatctcaagatgggaaggtttgtcaacaacatacaaacactaaccagccattggagactacagaagtcacatcatgctgtatctaggtttgatttaagcctctaaactagtctaagacagcaccttttacttggctaattagaggcaagcagtttttcctattctttaatcattactctctcaaatacttttctgcttagcagagaaattggaagaaatgagacatttaaactaataatataaataagcatcactactgcaagcctctgggagcttcaatgatgagtgacggcataaatacagaccctgtgtacatcaaagtgtatgaattgacaggtttccattgttggcagtgaaggtttccaacaacgatggccattacaacttttcttggaaaaagagctttaaatcctctaaatctggccattaacataaagaccaaatggagtacatgtttttattccatagattacagcccatgataagccagaaccttcaccctcatacacacgtggctctcacacctacaggaatcccctcatttaatgtgtggcttatggcctctgtctatcagcaaactcatcaacggaatcagccttcctccagaagagagttttccctttctgagataatgctgcagtgctgtaggtgagctgagtactgtttaattttgtcagagaaaccaaagactatatgaagttggcaggaggtgaaaggggtcccaatcccttagaaaaaattactattaacatgctctctctatatggtgaaatgaacagttaagtggtagagaagggcataaatgaaaagatatctccccaactactggtcctactcttcatgatcttttctgtaaccttctagaatgtttctgtatgtataaacgtatacacagatgaggttgtgctgtgttaaacacaccttgcgtctttcacgtagcaatgtatccgacaggtgtttccgcatcagctcacgtgggtttatagcattctttgcgtgtccattcccgattctggacttgcaaggccaggaactgactattctccaaatcctctcctttgtccgttcttattctccagactttgtgtaccaaaatgcactggcttcagtgggcctccaggtcttcggtgagcacgtttccagaaccttgggtgactaaatgagcaaactaaccccactttataacccttaaccgtgtgcccctgcttgtgttggtcatgcacgtagcccgttccctgagcatgctaatcttcagagaaagggcagaccaatggccagacccctttgctggatagctccttagtatggacattacctcccaggaagcccaagtgaaatgcaccagcccatttctgctgttatttaacttaaaagaagacgctgtgcaaccacaagtcagagagctgtgcagatggtggcgatgcggttgctaaggcgctccactgtaccccagcactgggacctgaatacaagtgagggttcccctacgatgaagtacctcctgcatttggtcatcgtaaggggtagctcccacctcgttaggtttcctttctccatagtcttgcaacatccctttactctttatttgttctgcatctttcctcttcttctgggttttgtttggttttgctttttaacagcagtgttttgagctactcatatttcccataattcccatagctgagaccatggggttgtattctacatgactgagacgccgaggtaaagggcaggggtgagaccaacacgtgtattgctcatgctcagaggcctctcccaggtaagaatcagccacgaagccaactcctgcattgcatctcagtctcccccacaccctatcacagaatgaaaggggctgtgagcaatgtgtttgccacacaaggctccagtgggggcacactgcaatcccagattccacccagagtccgtgtcattcatgttttgtaacatctttaccaatgcctgatttctcttgggtccgttgcattcattgaagtttgaccaaatgggtaggaatatcaaaaacgacaaaggagttcattcctgaatccagagatcagaaagagggaggtagcttattaataacgttccttcgtccctcagagatcgatcacatgccttttacatgctagtgcttgcttcgcagggtgtaccctatgtctgtcctgcctcctcgctgaggaagggcctcatgcccactagttccctggatcctcacaacagcctgggaaggtggatggtcacatcaccatcttaccttcgcagagagatgcactgagtttgccaaagctatatacattggggctcttgatctctggccacatccttctcccctctgtgtccccactttcccttgggtgccgacatcgcctggtctcagggagttcagcagtcacacgctgactggttgggtctgaccaccccagtgccctcttcccctttatctctgtcccatacccatcgtgtggtacgtcacatcccagagggcaaaagcctcagtcggcaaaaggcgcgggtgacctttggaggtggagacagtgcgcacccagcccagttttgctcacaaggtataaatgttacttttagtggccatgtgctgttgggtggcctacagctctgaggccatggacagccacacctgcccgctgtcacagactgctgtagaggctgcccttccaatggaggtggtgatccacctgcctgcctcatccctgaggagtggcgggaggctgcctgcagtcatcttttactcattcacttggcgttcatgcagtcatgctaggtgccccctcagccctttagcctctttgcttcttcttgctccctgctcagctccaagatggcacccgaggccattgcccatcaagctcatggtgatgagtaaggttagatcattgatagtaggaagaatctcttccacattaggaatgcagtaccttcttgaatctactgcttttcctttctccaaggatccaaaaatctctggttttccttatctttttcagtaggcggtggtggtggtggtggtggtggtggtgatggtgatggtggtggtggtggtggtgacggtggtggtggtggtgacggtggtggtggtggtggtggtggtggtggtggtgacggtggtggtggtggtggtgacggtggtgacggtggtggtgatggtggtgacggtggtggtggtgatggtggtggtggtggtggtggtgatggtggtggtggtggtggtggtggtggtggtggtggtggtggtggtgatggtggtggtggtggtggtggtggtggtggtggtggtggtggtggtgatggtggtggtggtggtgatggtgatggtggtggtgatggtggtggtggtggtggtggtgatggtggtggtggtggtggtggtggtggtggtggtggtggtgatggtggtggtggtggtgatggtggtggtggtggtggtggtgatggtggtggtggtgatggtggtggtggtggtggtggtggtggtggtggtggtggtggtgatggtggtggtggtggtggtggtggtggtggtggtggtggtgatggtggtggtggtggtggtggtggtggtggtggtggtggtggtggtgatggtggtggtggtggtggtggtggtggtggtggtggtggtggtggtggtggtggtggtggtggtggtggtggtggtgatggtgatggtggtggtggtggtggtggtggtggtggtggtggtggtggtggtggtggtgatggtgacggtggtggtggtggtggtggtggtggtggtgacggtggtggtggtggtggtggtggtggtggtgatggtggtggtggtggtggtgatggtggtggtggtgatggtggtggtggtggtggtggtggtggtgatggtggtggtggtggtggtggtggtggtggtggtggtgatggtggtggtggtggtggtgatggtggtggtggtgatggtggtggtggtgatggtggtggtggtggtggtggtggtggtgatggtggtggtggtggtggtgatggtggtggtggtggtgatggtggtggtggtggtggtgatggtggtggtggtgatggtggtggtggtgatggtggtggtggtgatggtggtggtggtgatggtggtggtggtggtggtggtggtgatggtaatggtggtggtgatggtggtggtagtgacggtggtggtggtggtggtggtgatggtggtggtggtgatggtggtggtggtgatggtggtggtggtggtggtggtggtgatggtaatggtggtggtgatggtggtggtagtgacggtggtggtggtggtggtggtaatggtggtggtggtggtgatgagggtagttttccacattaacatcttgcaaaacaagtagttcaagatcttctccagtttgacttatagtagattgtctatttccagggctacttttgctaagagctgtggaaggctcatttataatgcattggcagaccttctatggtggaaaaggagacgatgtttctcaccaggccgaatctggagtagaaatagctgtgctgccccctgcctcttggtgggggaaggggacttctctgtggtttgatctccctcagaataaaaagttctcctgagtctcgtagctgatctaaccctcaggtcatcctgcagcccttccaggctttcttccggtttcttgctaagacacacccatggctcatttctgtcccgtggttgatgtggctgaacttcagtggttcagtttctactgttcgccctcggcctgtgcctgcctcttatctctccaccgaagtgaaccaatttaagaaaagctttcatttgttaaagtgagatttctccctctttgagttcagggaaaattccaaagagatttacagtgagaaagaagaggaaggtgtttccagcagtgagcagttttgagaccagaagccacacagcagcactcagtgtgactgcagggcagcaactgggttgatctaggctccacaacttcccctttagctctgcagacctcagcacaggcggagcacgagcccttaaccaggaagggatttttgccccattttatcacagtacttagctttttgagcagtgggcaccctcaggagtgacccttctctggacaccagctttggaattggatgtcctcaagcctccctctccaggcttctcagtggggaggtttctgtggtcccctttttagagcttgggaaatctccttttagtttgctttttaatttttccttggcagtaaagccatggcttttggaaacgtcccattggacgatgattcatgaatgccataaagacaggactaaaaggaaagggtcagacctgtgcactctttttgcagaacacattgataaatttagagcaggacagacatccagcctagacgtctatctgtgcagccctaaattcatcaacgtgtcctgtgaaatggggagagaacattttactttgctttgctcatccttttagggactcagtccttttattagattttttccagaaattccttcttgctcatctttgcatggttagtgagtatcaagagaagcacagatgatctctcattaaaggagcacacatcccagcctctgggagccctgactgttgattcacttgaattcttccaggcaataagcattgatgaatcaggttccaaaaggatgttcccaatgccgactctactgagctgtcacacttgctccaaatgcttttgccttgtgacttctgccgcttctccattctccgctctcacatacggctgctcctgcctgattccctagtttggcttcatgtctgccctcactctgatcttaggacctactcagcctcacacagtagtcttgttatatccctgagtttctcagcagcaggtactgttgacatcttgagccagtcattctttggggcgggggcagtgtcctgggccttgcaggatgttccacaccatccctggcctctgcccccagatgccaggcttgtcccacccaagtcatgatgaccaaaaatgggttccctgggggaagaatcatccctggttgagaaccactggtataaccagaggagggctatttctttggctgttgtcatctgaatgtggaattccaaggaaagttggtttctgtttgtttaactgatgaattaagtacagactcccgattaatttctaggaagaaacagcatgcccttatttatttttcaaagagcctttctccgtgtttgcaaatggcctgtgcacatagggtgatgtgaattgcagattctgcctctgctgaccttggctttgaggtactttgtgctcttccaaggaaatacaccatggaaacgtggggtgtgagagtggaagctttgccagcccacatgtgggaggcaggacggatgtgacagtaagcctcatgtctgtatggctccacagagtaacttgaaagcccacaggcagcccctgcctctcatcccctctgccccaccacacacatcacccacatactcaccattcattgtggtgtgaaatctccttgggtgaagagtagatggttgcttattaaaatggaaataagcccagaggctggacgcggtggctcacacctgtaatcccagtactttgggaggccaaggccagcagattgcttgagcccaggagttcgagaccagcctgagcaacatggtgaaaccctgtcaatacaaaaaatgcaaaaaatagtcaggtgtggtggtgcgcacccgcagtcccagctactcaggaggctgaggtgggaggaacggttgagctcaggtgttgaggctgcagtgagtcgtgctcccaccactgcacaccagcctgggtgacagagtgagaccctgtctcaaaaaagaaaaaaaaattaataagcccagaaaggaaagctgtttgtcataaagaccttactttgaatttatgacatgctttccacctcaacaggtacttaggagcaggttttatttgatgaaaagtaggtgggaaaagggtaatgaaagtagcttcgtcgctgggcgtggtggctcatgcctgtaatcccagctactcgggaggctgaggcaggagaatcacttgaacccaggaggcagaggttacagtgagccgaggtcacgccactgcactctagtctgggcgacagagcaagactccatctcaaaaaaaaaaacgaaagtaggttctcaagcacacctcctagaagataaagtgtgaaaaaagagctgagaaagcacagcccgtgagactcaactgccttataaaaacactagcagcacgtgctggcctctcgcctcggctgggttctgtgcaaaaccccatacatttcaccttcctgacagccttgggcaggaggtgtgattgttctcccagtgttacagatgagcaaacttggtggaccccacttcacagttaatccagagctattctctgttagagacccaaggatgcctggttagtttgaaatgtgtgctagctcagagttaattcatattggccctgtggtgctagcagcaggtccaagggcagtaattggcagcatcttgaaaatcattcttaggatccttagtgaaactcccagctcttcctgcttcagagtcaccctgggctcccggggacttcaacacgccactacccttgtgggtggctgacaaggtgaagagaacactccttccccacttttggggtcaggctaccaagccgtgctgcctaagcggctgtgtgtctcagcgaccccagtgcaacagttctgcctggagtggaccctggaggagaggaacagccgagacagcaggcctctccctgcctccccagggcgccatgcaaacatcctccagcctgagaccaccctgcaaataagctccagtcagtcacccagcctgcccgctggccagctctgtctaggtgtgctaaatcctagctgggccaggtgcaaatctcccagccttgccgccacacctacctcatatcgcttgaagcttaatttaggggctggggttgctggagcagcccagtaggaaggcaaggataacacagtttttacttcactacaaatattgcggcaaaaaaacagatgtggggcagtaactcaccccgtcgcttggtccaggggtaactgcctgcagccccagccgacatcctggcctttcaacacggagctgtgactgacggccctgcgtgcgtggcttccgtgctctcagctccgcttgctcggtgaggtggacgtgaggggacaggggctgtccccttgttgctgcctcattgccagccgtgcaattcccacccagggcttctgttcggggtgtttcagggtttacagttgggtaactcgttgttgtctgctgtgcctggcttttcaatccaataggcctgcaagtcctccgagattcctcctcctaaccagcccggagttccccagggccgtgcccctccccagagagggccctcggagagctgctcccgcattgtcatgttgactgacctttccttctttttgtcttttctccacagtgtggcaaaggagcagagaactttgacaagttcttcacacgaggacagcccgtcttaacaccacctgatcagctggttattgctaacatagaccagtctgattttgaagggttctcgtatgtcaacccccagtttgtgcaccccatcttacagagtgcagtatgaaactcaccagcgagaacaaacacctccccagcccccagccctccccgcagtgggaagtgaatccttaaccctaaaattttaaggccacggccttgtgtctgattccatatggaggcctgaaaattgtagggttattagtccaaatgtgatcaactgttcagggtctctctcttacaaccaagaacattatcttagtggaagatggtacgtcatgctcagtgtccagtttaattctgtagaagttacgtctggctctaggttaacccttcctagaaagcaagcagactgttgccccattttgggtacaatttgatatactttccataccctccatctgtggatttttcagcattggaatcccccaaccagagatgttaaagtgagcctgtcccaggaaacatctccacccaagacgtctttggaatccaagaacaggaagccaagagagtgagcagggagggattgggggtgggggaggcctcaaaataccgactgcgtccattctctgcctccatggaaacagcccctagaatctgaaaggccgggataaacctaatcactgttcccaaacattgacaaatcctaacccaaccatggtccagcagttaccagtttaaacaaaaaaacctcagatgagtgttgggtgaatctgtcatctggtaccctccttggttgataactgtcttgatacttttcattctttgtaagaggccaaatcgtctaaggacgttgctgaacaagcgtgtgaaatcatttcagatcaaggataagccagtgtgtacatatgttcattttaatctctgggagattatttttccatccagggtgccatcagtaatcatgccactactcaccagtgttgttcaccaacacccacccccacacacaccaacattttgctgcctaccttgttatccttctcaagaagctgaagtgtacgccctctccccttttgtgcttatttatttaataggctgcagtgtcgcttatgaaagtacgatgtacagtaacttaatggaagtgctgactctagcatcagcctctaccgattgattttcctcccttctctagccctggatgtccacttagggataaaaagaatatggttttggttcccatttctagttcacgttgaatgacaggcctggagctgtagaatcaggaaacccggatgcctaacagctcaaagatgttttgttaatagaaggattttaatacgttttgcaaatgcatcatgcaatgaattttgcatgtttataataaaccttaataacaagtgaatctatattattgatataatcgtatcaagtataaagagagtattataataattttataagacacaattgtgctctatttgtgcaggttcttgtttctaatcctcttttctaattaagttttagctgaatcccttgcttctgtgctttccctccctgcacatgggcactgtatcagatagattactttttaaatgtagataaaatttcaaaaatgaatggctagtttacgtgatagattaggctcttactacatatgtgtgtgtatatatatgtatttgattctacctgcaaacaaatttttattggtgaggactatttttgagctgacactccctcttagtttcttcatgtcacctttcgtcctggttcctccgccactcttcctcttggggacaacaggaagtgtctgattccagtctgcctagtacgttggtacacacgtggcattgccgcagcacctgggctgacctttgtgtgtgcgtgtgtgtgtgtttccttcttcccttcagcctgtgactgttgctgactccaggggtgggagggatggggagactcccctcttgctgtgtgtactggacacgcaggaagcatgctgtcttgctgcctctgcaacgacctgtcgtttgctccagcatgcacaaacttcgtgagaccaacacagccgtgccctgcaggcaccagcacgtgcttttcagaggctgcggactttcttccagccattgtggcattggcctttccagtcttgggaggagcgcgctgctttggtgagacacccccatgcaaggtcctcagagtagccgggttctaccacaaacagaaacagaatgaaagtagctgtcagtccttgtagagagccgctctgtttcctcccagaagcatctcccagctaagctcgcattatttttctcctctggctgtttgcctgaagttcacagaacacacaaccatgaaaggctttttgaggtgagaggcccaggtggtcctggcaaccctgagtagaaggagagacggggtagggaacgggcccggccagaaaagaaccatttcttctgccatcttttatgcaccatagacatcgagactccagggggtcctggctcccctgtccctgcagccctgcaggtcagtgcatgatctgggttcgtgtcctgaccaggtgctcctcctttgatccgaggggaaagggactggtttatagaaagagcctaggagacaaaagggccagtccccctgcccagaatggagcagcagcaggacagacccccacgaggccccccagagaggaggaagatcccacggaggaacacatgaggttagggacccttgttcagcaccccaaacagcctgcctgtttaaagcaggcagcaggcttaggccttccctgcaaccccaacacccacaagtttgtttctctaggaaacacattcactgtctcagctggctgttactctctcagaccatatggcaaagttttccaagaaaatgccccgacaggggtgcccagcacactgcctgagggacaacagacatcagaacaaacccccagagagaaacagtcaaaatcagggcccggtgcagtgttgtcatgtggaacctgctttatccattgctgagtgttgaatgtgggtaatggttagggctttccagatctcagcagccaaagacagttattgttggaagactgtcatgtagataaccatgagcaatggctcgcctcagaatcagttcataaaattctatggtactggccccttcgtgggtattgtgtgaaatgagatggtggcgaggggtgcgctgtggaactgccgcagccacgcaggaggtccctgggggatgctttgggaagtccttgcccctgagcactgcctgattgccagggcctgtggaggtctaggccgcctggcagaatctagcaccgtccgaatccccgcaggacccatggagctatgaccacaccaggccattcaaatggctctgcattatcttcccttggaaggtggccactcctcggtggcagggcctttccctgaggctgcaggccgtgggctggcagcccgtctcttggcatttcaattgaaggtcaccaggtgctgggtttgaaaggaagtcactggagtgctgccaggggccgccctccaaggttaatgagaggcccacatccaggcaagaactaattcaaaaggcagatcagaaaccacaggagtcaaaattattgctccggcagtgcttcccttcctttcatccactggcctcgtgtggtccatgcagggccactgtctgccctttctgatgccacgtattaggctttcttactcagaattttgatagaaaaccatggggccaagagctctggaagcctggccggaaagaccaaggttcatgcagcccaacaaatgattgttgagcacctctcggagccaaagtccttaggcgagtgtggtgacttcctggaaggaggatgcagacttccagagagcccccccaacggacgtgctgagaagggagagggaggcgggggctgtagtcaggaaggagccagagaagaacagggtttgggtgcatccagaaatatgcctgcagtaggagggagaggaaggggtgccaccgtcaacggcttcccatcggaggtggttggtgcagatggaagtttctgtctgctggccctcaagagagtgttttgccagggacacagtctgttcctcctcagaaaacaccccccaaatgctaacaacatccccaccagctgctagaagcccctttcccctccccaccttgaagtagctcatagttctctgggcagagccagaccatccagtgtaccccagaggccagtaggttcctgcccattttcctctctggcttcctgccaagaattatggcagctgaggatgaatggagaagtaaaaacaactaacaccgcacaactaacaactaacaccgcagttcccacctgggttccacttagcaggagacatttcggagggttttttttgtttttgttcctgttttttttttttttgctggaatttgttttctcagtactgaaaagagaaaaagtgacaatcttgtatttttaaaagcctcggaaaggtgataccatctgacagtcattttctcacgttggtcttctaaagtcacctatttcttgtgtgtgcacatcacaccatttcctgtttctttataacccgacaagggtaggagtgcctgtttcccctgctgggcacaccagacaatcgtaatcacaaaacagacactgagccaggggcccaaagggtgtgatcatgagagttaccgggacagcagtaggcatgacagtcaccaggaaggacaagggtgctctgttgttagtggccacacaccaatttgacaaggagtgttgcgaaatttttatttatttatttatttattttgagatggagtttcactcttgttgcccaggctggagtgcggtggtacaatctcggctcactgcaacctccacctcccaggttcaagcgattctcctgcctcagcctcccaagtacctgggactacaggtgcgtgccaccacacccagctaaattttgtgtttttagtagagatggggtttcaccatgttggccaggatggtcttgaacccctgacctcatgatctgcctgcctcggcctcccaaagtgctgggattacaggcatgagccaccacgcccagccaaaatatttttttaaagtcattttccttaagctgcttgggctacatgtgaaatacactggacggtcaacattcctgtctcctcccatttgggctgatgcagcagatccagggaatgttacctgtttctgctgctagaagatccaggaaattgggaaggttacctgacgcacacatggatgaaggccatcatctagaaatggggtcaaccacaattgtgttaattccgtagtgtcagggattcttcgggaaggtcaacagtatgaaggattctgacccctgtgcctcccatttatgtgatcaggtgacagttaataaccgtggaggtcacactcagccatccaacagccttacagtgaccctacacaaaagcccccaaattccaaagactttttcttaacctaaaggaagaaattatttgttaattccagtagagcaactgaatatactgggctatttgtacttttttatagagaactttaataataattctttaaaaatgagtttttagaacaaagcaactgacgatttcctaagattccaatgccctggagcttgtaggaggacttagcctgggtcagctggagcacccccgacctgatctcccactgccagattttcccatgctcctagggtatggagtccacgtgggaatgactgcaagttcaggtggaacttggccgactgatgctctgcgagtttttaatagacactggggacaactgcttaaggtttagaaacttccaaaccacaggaaagacatttttagtgtcccccatccagaggcagccctggaataggattcccaggggtttctgggacccctttccttgctccgtgaggctctgtggccatcttttggcaggaggaggatgcttccttggctctgtgcccagacccgcctggtccccaggtctctcaccttgggtgaagattcagagatgccctgtaaggattttgcccactgggcaactcagaaatacttcgatctcccaagatataagaggcagcagcaaacgtgcctattgacgtctgtttcatagttaccacttacgcgagtagacagaactcggcttttcagaaaataggtgtcaagtccactttataagaacctttttttctaaaataagataaaaggtggctttgcattttctgattaaacgactgtgtctttgtcacctctgcttaactttaggagtatccattcctgtgattgtagacttttgttgatattcttcctggaagaatatcattcttttcttgaagggttggtttactagaatattcaaaatcaatcatgaaggcagttactattttgagtctaaaggttttctaaaaattaacctcacatcccttctgttagggtctttcagaatatcttttataaacagaagcatttgaagtcattgcttttgctacatgatttgtgtgtgtgaaggacataccacgtttaaatcattaattgaaaaacatcatataagccccaactttgtttggaggaagagacggaggttgaggtttttccttctgtataagcacctactgacaaaatgtagaggccattcaaccgtcaaacaccatttggttatatcgcagaggagacggatgtgtaaattactgcattgctttttttttcagtttgtataacctctaatctccgtttgcatgatacgctttgttagaaacattaattgtagtttggaagcaagtgtgtatgaataaagataatgatcattc

SEQ ID NO: 608 - DNA, 19179 bp, Homo sapiens
gatgacgcaaaccgggaacagcggctgagcctgcgcttcggaagcatggatgtgcgcctgcgctgcgctagggcgcggcgggcggtttgaattttgcttacagagtcccgtctcaccatcctgggcttccaacggagactgcggtatccgcagctggagacccagcggcgagtagccttttgctcccggacggacttgaggttggagtctgtgtgttggggaccctgcctttggaagcgcccgaggtagctgcttggcagctgggggccgcggaccgcgccgggcttgggggaggacggggctggaggctgggttggatgctttagaccctccccttctctctcaccggcggagtgggtgggaaactggttctttcccatttctcggcctccttaccgatcccaaactgtaaagccccaacccctcacagcacaggaaaaatgattacctgggcccatttctttgacagtgtaacacatttttaaaaaatgtgtccttattttgcgtgtttaaagaaaataccaatgttgtctttatatacaaatagtgcgtttgtcctcctgaatccttaaggaaaggacccaggcttatcctctttcccctggtttgggatccatcgatggcctaaggctctaagacaagtcagtacggtaccgtggttagaaactgaatgttgtagaaatgaaagaaattgctcttgaatttttgtgcttaaccttcaaagacatgtgatttacttgacattgaccattcttggatttcgaaagtgaacagaaatttgtgtggcttttcttgttacgaatatgtttatgtttttttcttcagaggcttaaaggatggcctcgtcagatctggaacaattatgctctcatgttaatgaaaagattggcaatattaagaaaaccttatcattaagaaactgtggtaagtaaaacagattccactgactttgtatatacaaaatgcattttgattattccactctgaatgatatctttgcttggttaagtgactgcatcttaggtaattttagatttttgcataacgattttttaaatagtccaatgtcattttgaatattgtggaggatactaaaaatgtaaggtacattgaacaatgaactgaatattcattagaattatttacttatgtttttctgagacacataggccaatggtgagatttgaaggttatgtggcatccatggttctacagctaaatagagatacagtcatgcgttccttaatgatggagatgtgttctgacaaaagcgttacatgattttgtcgttgtgcaaacatcacatcatagaatgtacgtaaatgtacacaaacctagatggtatagcctactacatatctaggctatatagcctattgctcctaggcaacaaacccgtatagcatgtgactgtactgaataccttaggcaagtgtaacacaatggtgagtatttgtgtatctaaacatagaaaagatacagtaaaagattaaaaatggaacacctgtataggccacttaccattgatggagcttgcagaactggaagttgctgtgggtgagacagtgactgtgagggcctaggacatcactgtatactactgtaggctttataagtactatacacttatgctacactaaatttataaaaaatgaaaaactttcttcaataatacattaaccttagcttactataacttttttacttaataaacttcttagtttggcttagcttttttattcttttctaatagcttaaaacaaatacattgtacaggtgtacaaaaatatttttatatctttatgagctttttttctatttttttttaactttttaaaatttttttgtcaaaaacgaatacacacacacacacacattagcctaggcctatgcagggtcaggatcatcaacatctgtcttccacattcacatcttgttccactagaaggtcatcggggcagtaccacacatggagcagtcatctgtgataacaatgccttctggaatatctcctgagggatctgcctgaggctgttttacagttaactttttttttttaataggtagaaggagtacactctaaaataacaatacaaagtattgtatagtaaataacataaactagtaaccatttattatcaattattatgtactatacataattgtatgtgctgtacttttgtaatactggcattagagtttgtttacaccagcatcaccacaaacatgtgaataatgcattgtaccatgatgttatgatggctccgatgtcacaaggcaataggaatgtttcagctccgttataatcttatggggccactgtcatatttatggtccattgttgactgaatcactgttatgtggcacattattaaaaggcaagttaaaaaaactgatgtagagctccataggggtaaaagtagttcataacccatcttagagcctgctttggaggaagcttattactctatatcactgggaaataactaattgaaaatgaaataaattatttaagcatccatgaacttggagattttaagtatatttgaaaatattttgacgtgctgaaattggatgatgcaatgaaagttcagagaaacagatgatccttgtcaaatctaaaatgtctaaagaattacatactccctaaccttatctgggagggtaacggtttattggcagacagaattccatgtgctgggaaggttgtgttgaacttgtattgtagtttgtattatgaattggtagtttgaaaactttctcaaatatgaaattataatgttagataggccatttcgaattatacctcccctctcagggacgttgatattctcagtcctgtattgataactactaataaaggagcctcatacattttacagtttatggttcacatactctggaaagttaaagctaaagggactgggttcatcttaaggagccccctgacctcacacctgaggaaactgagactctcggaagtcaggtggctggcccaggtccctcagctcatgagtacttggttgggcgacagtttctgtttcttgattcccatgttagtactctttctattttgttgccatttttattgaagtaatttgtaaaagacttttagatgtttaataatgagtcttgtttaaattcactttctgaggttatgattagtcatggataaacaaatataatttggagatctatacaactatcaagccttgaattcacatgacccaccaaagcataggcctggctgaagcagtcagacccatgagatccttacacagttgtcaactgtcattttgtatggggggataataatttgtgtggctccatagcctataaaataaagtctggtagtttgtttgctactttggcttctgtaactgactagattactacataaaaaacagtgaccagacacacacctgtaatcccagcactttgggaggccaaggcaggcggatcgcttgagcttaggagtttgagaccagcctagtaacatagtaagaccctgtctctacacaaaataaaaaatgagccaggtgtggtggcgtttacctgtagtcccagctattcaggaggctgaggcaggaggattgcttgagcctggtaggttgaggctgcagtgagctccgatggtgccactgaactccagcctgggtgacagagaaagaccctgtctcaaaaaaaaaaaaaaaaaaaaaagtggtaaacaacaccctaaaatttaggtgactaaaagttgagataccagtgtatggggaagaaatactgtgttcaactaattctactgaaattattctcagagacatcagtactctcatttacttattaattagttttacttgttatgagctgagtgtcaaatgcaagtagtgttgctctattagatagaatgatatactcatgatgatgatgaatggcagttagcatttactgagtattacgttctacatgcagggctaagcccatcttatatgtactttcacctatcttcacagtaatgaggtaggtacttggtgtctctgacttcaggccttctacctggttcactctactgcctccttaatctacacatattgccaaagtctgcttttacttatgtgtatgtcattgttagatagctggaaatgcagatgggaagcttcaattatgaaggtagtttttcttctgtgcttttaatctgcccttaaattttttaaaaaactacttcttttatttctagggaggaagggactctgattttctcacctagagaggggtgctaggaggtgggattgggaccatgagaatatactactttataaatgtcttatgtttgtttttgccaggtacccagggttatcaccagcttgtgactttttatgttactttgtctgcttaggggtggttttgaatagtgtggatagtgttaatatgaattccaaatccatattacaaattctgaaagagagtttcacctcaacctcactcccaccccttccacacacacactgaagggcctgtctaaaacataagcttatttctctggtgagtgattacaactttcactgaaaatatattcataaagaagagtcctagcctcgtttgagattctcacttccaacaccctgtgttttaaagccccaaaaccttggatcttatccctattaaaatcaaatatattcaattgctgagattgacaacctcctgtccagcattgctccacactcctcagattagggctgctgcagcctcagctcacacaccctgcctggtatgagggggaaccacagttccctcttcatattggaacccctggaaatttgcctttttctcatgaaagcttagctgtggacgtagaaggatgcttgttttacctcgcatttctaagtgttttaataagtggaagaatttgccagaaacaaaagacgcaggagagacattgtccttgcctctcgcctccttctgttccatactacttagaaatgaggtttcaggattgtccatggagtcattttctaggggctaaagcagtagacctttttccacccctctctaaggtacagctatctattctaagagttcgcatgagtacttatagctactgcttttctatacactttgttttctattttatttttgtttataacaggccaggaacctaccttgaaaactgtattaaataaaataggagatgagatcattgtaataaatgaacttctaaataaattggaattggaaattcagtatcaagaacaaaccaacaattcactcaaggtaatgtttctctaatgaggaagcagtaaaaaagacaatacatacaaactccctaatcattaagtaatttttaaggatgctttgtttataatgttttttgtttataaattattaatggtacagtatgccatttatgttttattttcctagtatagtggaatttggagctccacagctgctactttctgctgatggccagtggaattgaactttactaaaaaggagagtttgctaataattcttggtagctttaatttaaacaatgatgttctagtagagtggtatgtaaagaacacctgctttgggtgaggagatatggattcttaccttggtggtccttggtactctctgccaccctgagaaagctattttacctgttggggtttcaagaacctcatctgaaaaaataatggatcatattgaactgtttcttagctcccttatatgtctatatttctatatttttataaaaggtaatataagggttctcaggtaaagaaaaacttgagcctcattcacatgcacattttattctaaacaagccttcaaattgagttcagctaataaaagtgctggtgcacttcctgagggggaaataatctgtaccataattacctcacattgttagagctggggaattgctcagtgggattgaacaagggacctccctgaccccattcagccttataatccttaaagtctgtaaagattgttcagctataggaatgggcatgattatgcctatcactctaatagtcaaaatggaattggtatccatgaatgtcattcacctcttcaaggaaaagacattatataaattcaaaacagaaaccaataccggcatttcagttctaacctgcccaagaatgtccagggttaggtgtgggcctagagaatgctcaactcagaactgaaggctatttggaatttctgttcacattgtgattgggagccagatggcgggaatccaaaggcacaaaatattttccttattaaaatgtgtatgagttcatagcctcaagttctagtaaaagttagagaccaaaacaccccagctttcaagtagaaattttcattaagctggcatgtaggtagcccacagtggaagtcatcctaaagcagcatctcatgcttgccagctgggtatattaccatgctgtgataatatggttgctgttacacaggtaacactggggagcatttggtaagccaacaaacgcaatttatgagaatgaaaaacataagttctttatatatttcttagttatctcccaagattaaagtatttgagaaagacttaactttagtcctgctttgtaattgcaatgtgattatagtgattgttccctgaaaaaaatccagtagagaaaaatattaccaccatccaaaaacagctctagaaaccaattttttattgctggattcattgctttttcacttcattctgcattttcggtactccagtcaatgtggtttttttttttttttttttttgagacgagcctttctctgtcgcccaggctggagtgcagtggcgcgatctcagctcactgcagcctcctcctcccaggttcaagcagttctcccccctcagcctcctgagtagctgggactataggcgcgtgccaccacgcccggctaaatttttgtatttttagtagagatggggtttcacagtgttagtggggatggtctcgatctcctgacctcatgatccacccgccttagcctcccaaggtgctgggattacaggcatgagccaccgcgtccagccacagtcactgtgattatggttcactgttttccctgctctttagaatatcttaaaacacacatggggaggacagagacttatttgtgagcacttttaaattttaggaactctgtgaatctcttgaagaagattacaaagacatagaacatcttaaagaaaacgttccttcccatttgcctcaagtaacagtaacccagagctggtaagtgtatttataattattcttgctatctggatttataaacccatgaaaacaagttcttcaaagccttttgttctttcatatacttgcagttttgtcagcgatgatctagttttttgtcacctatactaaaaacagtatttccatgttcaccagttttcttatcttggtgtctctgaggaaaatctaacacttctttcccagtttgccaagggcaagtctctctagcctctcttttttcactcatttctttccctgagagcagtttgtcaactgacgtttgttccttgacattttaggcaggttaattttttgttatgagaataggacattgagtagtgttcttgatctctgcctactagattctggtagcatccctccatcccacccattcacgacaatgaaaaatgtctccagacattgccaaatgcctctgagggcaaaatcttccccgaccattgagaaccactgcctttgggtaaaaataagcttaaggaagttaccattttaaaaatagctaaagaggctgggcacagtggctcacgcctataatcctagcattttgggaagccaaggcaggcagattgcttgagcccaggagtttgagactagcctgggcaacatggtgaaaccccatctctgctaaaaatacaaaaaattagccagacacagtggcacacccctgtagtcccagctactcagggagctgaggcgggaggattgcttgagtctggcaggtcaaggctgcggtgagccctgatggtgctactgcactccaggctgggcgacagagtaagaccctgcctcaaaataaataaataaataaaagccaaaggaacaataagcttagctcttttttcccctcaaatgtccatcctctctctcttcccccttacaaggtgtgtctgtgcttctgctttttccccgaggccctaacacctggcttttggctgtcattgccaccacacctagggtggttgaaggtcatgaagaggtcaaaaatccctcgtcagccctggttctacttctaagatttcattttgcataccacctttttgtttttgaaattctgttttctgccctgccactgtgctttcttagttgtcagcccacttctctgacttggctgcctcctttttctctccccttttttaaattatagatctctcctacctgctttactcattcttacccaactccactgttaatgctctcaaatgtccagctctagccttgatatgacatctagttccagcgatttaatggcctgctattttctcctcaaattttccatcttgaagacctggctctcttgtttctcttgttccccacatatcctcccatcacctcggtgaggacttggcatctttatcctgtcttgctctttctcagccattacctgtcattggacatccagtaagaatttgatcaggggaataggaggaattttcttctaagctgactatggcctagcctcaactctcagggataggtgagagcagaacctttctgtagttgaaaatggttattttcagctgataaacacagcagggcataagggagccaatcaggtgcttcctcaacacatggtcaagacaaacaagtacaggtacgattcagccagtctcacagtggaatctcatatgttaggattcacagaaggattatcatgcattgggcatctttatcttgacagcgtgcagcgtggccgagtcacaccacctcagtgaggctggttgccatctgtgtctggcatttgactgtcatcttgggatcttgcttcctgcctttctggggattcccttggcttgctcctgaggccatcctcccactcataattccagggctttgcttaacttctaagctttatattatgttacatttcttgttacctttttattatacaaataatacatgttgctagaaagtgtttgttgtcagaaaataaaactcatctgtaatttaccattcagataagatagggtatagctttccagattttacttaactacacataataacaggtataagaaatattacaggtatttcttatacttgttattatgtgtagttatagcagccccctactgtttcttatatctggtgtcgtctttcctatgtcttgacttgctgctggcaacatccctggcagttaaggaacctagaagctatagtgtgtttctagactttgttgctagtgggacaggagctatattagtcggcttctcactcgctgtaaaaattgggcagattgaatccaggggtgacccatgatcattgctggcaactaaaatgactccgcaatacacagggactgacatgagcaaccatcaggataaattagaataaatagaagtctaagataactgatgtttccagattcagagttagggacgtcaggaagacaagctgttaaggggttagaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaattaaaaaaaaaaaaaaaaaaaggaaaaaaaaaaaaaagagaagctattaagccgtaaagctgttaacttactgactttgaggagctggtgggacaactgatgaagatatcatgttacacgtaaataaatgtagctatattactgaagatttgggaacttaatttttcaacatttccttcaccgtttaatgttcatgaacaatagacatagggatagaaaaaaatgttggcaataagattataacaggatgagttacgtatttaatattattttcagttgggaaaactgtcagtatgctgcttatttctgaaaattgcctgtatgtatgtacatctgtattctgtagtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtaagtatttaagataaataatgttcaaccccttaataaacataaatgatcgtttaaataataaagcttaattatattaattgtaatatgctatgttcaaatattgatcttttaaaaaagtttcacattatactatgaaaatgcagtaaattttttgaagatttttgttgtaaaaccccttcatagagagatctagagatggatcaattcattgcttaagtcctctgttggacctttttgtgttacagatttaccaatcatattatagaagtagcctcagttttgtggtaattttaaggaaatcgagtgtgttgtgtagaattgagaatgagaatggacagtgttgtgtttggtttccgtttgtgcattgcaccccgcacttgtttgagcctgtgctatattccaggccctgggtcactcagaatagaggaatgaataagacaaaatgcttcccccaaagaggggggcgggtctcccttgccttttacatatggcaataatggggaaccaatgatgaaaatcgacatttttaaactcataattccagggctttgctaaacttctaagcttcatgttatgttacatttcttgttacctttttattatacgaataatacatgttactagaaagtgtttgttgtcagaaagtaaaactcatctgtaattctaccattagataagatagggtatagctttccagattttatttgactatacatatgtaacaggtatttcttatacctgttattatagcaatgtagttatactgtaaatacaacttactatccttttattgtgataatttttctatcattaatagtcatataatatatagctatccaataacttgtagcatttcctcattacatatttgggttgactttattgttataaataatggtacaatgaaatatcttttagacaaggctgttttgcaatttttttatttccttgggatagtcttaggaggagagtccctgaggcaaagatcatgattattttgcttctagagagtttttcataccagttcattttggttgttgttttatttaataaagtatatttcttagaacctttgttagatttacagaaaaattgagcagatagtacagtgttctcataccgcttctcccctgcacacagttttccctagtaatagagcattggtatgacatatctgttacagttgtcaaaccaatattgatacattactattaactaccatccttagtctatgttaggatttattctgtgttgtaccatctatgggttttgacaaacgtataatgtcatgtgtctaccattacggtatcatacagaagaatttcactatcctaaaaagtttcactgtcctaaaagtgccttgtatcccacctctttctatctcccactgaaccccagaatgttatatggttagagtcatacagtatgtagccttctctgactggcttcttttacttagaaataaggatttatgatcccttgtacctttttgtggtttgatagctcatttctttttaacactaaatagtactccattgtatggatgtattggtttgtttattcattcacctattgaagcaatcttagttccttccagtttggtgcaactatgaataaagcgctaaaaacgttcatgtgcaggtttcgtgtagacataagttttcaactcatttgggtaaatacttaggagtgtaactgctgagtcacgtaagagtatgttcagttttgtaaaaacctgccaatggctataccattttgcattcccaccagcaatgacagaacattcctcttgctccacatactctttatcatttggtattgtcagtgttctggattttagccactctaataggtgtatagtggtatctaattattttactttacaattccctagtgacatttgacattgagcatcttttcagcaagtactgcagtcctctgctctaccagctgagctatcgaaggaagcactgagcatcttttcatattgatatacttattttccatttgcatatcttctttgatgagatatctgttcaggtcttgagcctgtttttaaagtgggttgtttgttttcttgtcattgaattttaagagttctttgcatatctttcttcctctcctctagtagtctcattacctgtatgttatactttttttgattgcctcacagttcttgggttttctgttcttttttgtatttctctttgcattttagtttgggaagtatctattgacgttatctattgatgtatcttcaagttcgctgattctttctttagctgagtctagtctgctgatggagcccatcaaaggcattcttcatttctgttagagttctttatttctagcatttccttttgattcttctgtagaatttccatctctgctttgtctgtctattcttgcattttatcctttttccattagagtccttagcatattaaacatagttatttgagttagtggtttgatacttccaaaatctctgtcatttctcaatctgcttctgatgcttgtgatgctctcagcctgtatttttatcttatgcctagtaatttttgttaaaagctggacaagatgtgtctggataataggaactgaagtaaataggcttttagtgtgagattttatgttgatacgtctaggagctgggctatgtttaatggttgctacggttgtaaatgtcagaagcttcaatttcttctagttcccatttcttttgtttgttttgatttgttttgtttttgagatggagtcttgctctgtcgcccaggctggagtgcattggcacgatctcagctcactgcaagctccgcctcccaggttcacgccattctcctgcctcagcctccagagtagctaggactacaggcgcccgccgccaccatgccaggctaattttttgtatttttagtagagacggggtttcaccatgttagccaggatggtctccatctcctgacctcgtgatccacccgcctcagcctcccaaagtgctgggattacaggcatgagccactgtgcctggccctagttcccatttcttttgtctcctctgttgtctttgggtttccttagaaattttttcttaatagattctgtgtcttgtagcttgctaagtgttagttcactaatacgttcctgtaaccttgttgtagtggtggtaaggtgttggagaggagaagcattctataatcttatgattaaatctcaggctttttaggggtactgcatctctggcctgtgaccttctaaggtgtttcttagctagacggggctgaaatcatctaactacccttcccctaggtcagataaggttctggtcaagtagttttccttgagggcaggtctttgttttggataacagaactgctctacttttccttggcctatttcaaaataattactttttccttcctcttgctgatgctcaagagaatttttctctgatcttcattttaaaaacttggggggaaggcaggggtggttcctggaagtaaaactcatggaagtatgggggggctccctaaactggatccccaggagtttttaactctcaagctagttcaaactgagccttagcagtttgtccgttactatttaaatgttcctacagttactcactccagtggcttctgtccctaggaagctgtcattctctgcatttgtttgtctctcctgttttgggggcagtgtttggccctgtgacctcaattctctgaaaagagttaccagctttcagtttgctcctgttgtgaggatgggagtgacagtttccaagctcttgacacgtcagagtgctacataccagtttttactcctgttggtagtgtgtgagaaagcccaacctaatctcacacctgctagtgttacctcctacttaaaaattgctaccaattagccacttgaaaaatacctggctctttcacaactccaagactagtgatgacgttgacattgctctttagtctttttctgggggggagagggtcattttgtcatttcctttacctttctttttttttttttttttttttttttactttttttgtttttgagacagtctcactctgtcccacaggctggagtgcagtggcatgatctcggctcactgcaacctctgcctcctgggctcaagcaattctcatggttcagcctcccaagtagctgggaccacaggcgtgtgccaccacacccagctaatttttctacttttagtagagatggggtttcagccatgttggccaggctggtctcaaactcctgacctcaagtgatccacctgcctcggcctcccaaagtgctgagattacaggtgtgagccaccacactagcagtcatttcctttattgacagctttattttcatgaaaactgtttgatgctctgatgctattcagctttgatctttgttattgttgctcattggctgagctaatgtgaagagctaatgtggctgtgaggaacagtggagtagaggatttttggaaaatgcttccataaagagctattggaaggaaattagaatggtcatggtagagtattcatttttcaactaggggttatttaatgaatgagaaatgaagttagaagattagggtgaaaaaatcatgttttccaagcatagagtttttatttactttaaaacaaatggtgctgagagtagagttaaagtggaaaacattgaaggagattagggatgactattgaggaaatcaaggtggtagttgagaagatttgaaggaatacataagtgcattgtggagagctggggtataagagtttgtagaaattgtggttagaaaaaacaggacagcaaaaatgaatttagaaaagagaggaataatgaaaatgagtgtttttttggaaatatgaacattttcttttaaataaacttccatatcattgtatcaaggaagttttgactagaaagctgctactttgaatagaaatgaaggacagagcttaacctactgaacttacaatttgttgaagagacaaattgaagcagatcatcaagttttgtttttggtgtgttcaaaacattcaaaattgagagtctcctgtttttatattgtaagactccatggtgactgggaggacggacaagagggaggttgaagagtagaattcagagtgaaagagagtgctctaagggaacttgagctagggcatagaaaacatcatggctatgctttggttctcctctgcccaggcagcttccagtcactcactcctatatatcccctaccccatcagttctcctttgtcttaattttcattgtcaactttgttgtggtcttctttgttgcccttcatcttcccttcctcctcctcctttttttctctttctttctctgaacaagtaatagtttttgtatagcactagagtgctataagttgtataatttattaatatttaagtttttcctttgctcacatttaaaactgtttaaataaactgatatgttgcagttaatcagtccatttgaatcagaatttgagagcttatttaaaattataatatcagttctccataggtaaacaatagaggttaataattagagaaggtaagcaccaatatgttgtcatctctatttaattattcagctgtctggtttatttggaagttgatataagattgtttttataaagggtactgtagttttactgttgtacaaagtcatcatacttatgtttttcaaggaaagtaattttgtatgatgattctttaaaacaataattagccatatacttttttacaggtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtaaaatggcagcatatatgtgtgtacatgtgaactgttcagagtataactaaatcacgagaaatgtagctagttctagaaaattctaaatctagagtgttaattcccaaccaggagcagttatcctaccaggagacattttaccatgtctggagacatttttggttgttacagctgggtgctcctggcatctagtaggtagaggccagggatgctgctataacagccggcagtgcacaggatagcacccacaaaataaattctctggctcacagtgtctgtagtgctgagcctgagaaacattgctttagagtctattgtgaaactatgcccaatgttttaggaaattgaatagtaatgataatagctagtcctgttgatatagctacttactgtatggcagagagtgtgccaagagcttcaatccttacaacacccgtatcacttactgttattactcccaatttgtagactaggcaaagagagcttaacttacttgtccaaggtcatccagttaaatgataacactgttacgggttttattcttataaccactatgtcacattgcctcttgaaaagtgaattgttcaagcgataccaacagatagctagtgacctaataaatatcatgcatgcaacttctgttgatagaataattattattttagcaagaatactagttcttggttttattggatactaacagtaaaaacgactaataccattcatattcacaacttaatgtattaaagactcttttgcaagttggccttataaaaattagcactaatatctttatttttaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttgagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattcttgtttcttataaaaataaaacttttttggataaagcttatttcttgtttttttctttttctttttttttttttttgagacagtctcgctctttcacccaggccggactgcagcggcgctatctcggctcactgcaaactctgcctcccaggttcacgccatcctcctgcctcagcctcctgagtagctgggactacaggcacctgccaccacgcccagctaattttttgtatttttagtagagatggggtttcaccgtgttagccaggatggtctcgatctcctgacctcatgatccgcccacctcggcctcccaaagtgctgggattacaggcgtgagccaccgcgcccggccaacttatatattttcaagattcacctcctctcaccaaatatttaactacctgctgaatacgcctctgtactaggcacataatggaactaaaaaatgctcatgtccagtttttgtgttgagtgaacaatgctgcagaccctaataagattgggtacagatcggcatgcgcctgtagtcccagctactcaggagaattgcttgaacctaggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacacaagtaaa

SEQ ID NO: 609 - DNA, 82394 bp, Homo sapiens
gcagtggctgcttggcttggcagtggtcgcttggcttggcgtggcagtgatcgcttggcttggcatttctggcttagcggtcctcctttcgcagattggaaaccgcgggctatcctgctgggaggttgtggccgaggcagtagctcgctactgatggtctcctggggtggagaaaagcggggaggggctgaggggtctccgaagccggcagtctacgccacgaggaaaaccggtagcgtcaggagccaggaggaccagtggtacttgggctacccgggggaccagtggtcctcgggcttctcctacagctggtggaaaaacagcgtcggcagcgagagcaagcacggtgagggcgccttagaccagccccagcacgatgtccgcctggaagatcttggcgagctccacagagctgcccggtcgggcgacgtccctggggtggagcacgtcttggttcctggagacactggcgtggacaagagggataggaagaagaggtaatggccaggcgaaggatgcgggcgcgccgtcctgtcggggacactggctttctggtgcccgcaggccccacggcacccgggatggggaaacgtcagaggggtcaggggcccaggcctcttagtgagacgggatcaaatataaaggattattactattgcaaaagtgttggtctactttacaggagttttctttaaaaatattgcacttcccaactgtgtttatccattttctcaatttattcatcaaacataagggccgggcgcggtggctcacgcctgtaataccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccagaaggcggagcttgcagtgagcggagatcgcgccacagcactcccgcctgggcgacagaacgagactccgtctcaaaaaaaaaaaaaaaaaaacataaactgaatacctattatacagcagacatattctactgtcgctcaggttccttccatccttaagaacttcatgttggccgggctcggtggctcatgcctgtaatcccagcactttgggaggccgaggagggcagatcacgaggtcagaagttcgagaccagcctgaccgacatggtgaaaccccgcatgttatgcttttgtctcagcctagacttagctaaaaccttcatgacaaattatcctttaggccctcggggttcagttcaaataatgttgcagaaagagatgagtttccttttctcattgctaccagatctgtatgctgaggacccttttcttagatcgtggaatgtcccatattatcctttcccagatttgtggcaggaagccatcaccagaattctgagtctcaagcatgttagttggatttaacagagctaagtctcatccatgactcatgaatatccatgtataaaatgagagctttggcagggtgcagtggctcatgcctgtaatcccagcaatttgggaggctaaggtgggcggatcacgaggtcaggtgattgagagcatcctggctaacacggtgaaaccccgtcactactaaaaaatacaaaaaaaaatagccgggcgtggtggtgggtgcctgtagtcccagctactcaggaggctaaggcaggagaatggcatgaacccgggaggcggagcttgcagtgagccgagatcgcgccactgcactccagcctgggtgacagagcgagactcagtctaaaacaaacaaacaaacaaaacttgcttcagcagcaaacatatactaaaattggaacaaaatggagagaaattagcatggcccctgcctgcataaggatgatgcacagatttttgaagtggtccatattttgcgcagtcactagaagttcatttgactatttgctgactagttccaaagacagtgtgagtcaaagcaaactgggtatcacctaatattaaaattgtgatttttcactacaaaaatatgcagtaaggtgatcaatggagctgagtaacacgtgggatgttgtgtgcaaatatattgtcagtatgtatctcagaaatgagagaatgtcaacttgcatgtctttcatggaactgaaaaaaaaaagtagaattttgttttccatgtcagttggagatgaacatggggattgagcatccttctaacaaagatctgccgattcagagtttgagtctgtatggaacagtagtccaagctaggtcttgacatctattagctttctccccttggcgtgattgatgagctcagtaatagtggacagtgttgctatctagtttgatgaaataatatatttataagtaaatttagttacaaactatgaactagctgtgatgccccaaattataagccacaaagaatagaactaataaaactagaacttaataacagttttggaaaactgcaacatttgaatattagaacctctggaaaaaatacacattgggttttatttgtgattccaaaaccatttccgcaataaagctcaagaacaaattatttcattgcttcactgtttctctgagcatttacaaaacgttttcttgttaaatctttaacaacctagtgaaataaggcagtaaaatccgtgctttttagaagaatacattgagcctaagagaagcaacttgtcagagaataaatagctgctggtaatagagctaggatgctttccattatgccaagctaatgtgagttaatttactgaactatactcccttcaattcatgagtacttcatctttttttcttcttcagaagcttaaagagaagttggtagaactcacaaattgaagtatatgggataattaaagttctgatattaactctgatattgtttgaaatactctaaaaatttaatatatttggtatttttcatttgttttaaaatagtaatttcatttattacatttttatccatagcattcagcaactagttcctgaatataaggaaaaacagacacctgaaagtcttcctcaaaataacaatccaggtaagacttctgatagtgaattatttttggtggtcctaccataggtaaaaaagaagtaagagtcaggaagttttgatcatgaaagagcagttttaaaaaatctttatttctttgttgataggttagatttcttggtaggttagatgtcacaattatttaaaaagttaattataggtcatttattttttcaaacaatctggtctgaaaaaaaattaattatagtccctaaaatcctatgtgatatttttgtataaataagaaaaagatttttttttttttttgagacagagtctcgctgttgcccaggctggagtgcagtggcacgatctcggctcactgcaggctccaccccctggggttcatgccattctcttgcctcagcctgcagagtagctgggactacaggcgcccgccaccccgcctggctaattttttgtatttttagtagagacggggtttcaccatgttagccaggatggtctcgatctcctgacctcgtgatccatctgcctcgacctcccaaagtgctgggattacaggcgtgagccaccgcgcccggccaagaaaaagatatttttgagttagtaagttgtatgttttctttatagtcacattataatgaattagacttattatgaaattggaacttctatttaatttttaaaataaatgacttatgtttagtaaatgaatatcaatcacaattgacccttaacaatgtggaatttagggatgcttgattccctctgcagtcaaacatctgtgtataacttttgactcccccaagaacgtaactactaatagctaactgttgaccagcagccttattgataacataaatagtcaattaagatatgtttggtatggtatatgtattaatatgctgtattcttacaataaaggaagctaggaaaataaactgttaagaaaatcataaggcagaaaaaatacgcttactgttcattaaatgcaagtggatcattatataactcttcatcatagtcttcaagttgagcaggctaaggagaaggaggaagaggaagattggtcttcgctgtctcaggtggtagaagtgggagaaaatctgctcataagtagacccctgcagttcaaatccgtgttgttcaaaggctaactatattacatagtgatttgtgtcactaaaagaaattagtttcaaaactggaaactcagcaatacctttctggcaccataaacaaatagcaataagaactgtgaaatggccaggtgtgctgcccacacctgtagtcccagcaagttgggaggcctaggtgggaggatcgcttgtgtccagaagttccagaccagcctgggtgacatagtgagaccacatctctacaaaagcaaatacaaaattagctgggtgttttggtgcacacctgtaatcccagctacttgggagactgagatgggaggatcgcttgagcctgggagtcaaggctgtagtgagctgtgatcatgatcacaacctggatgacagagtgagaccctgtctcagaaaaaaacaaaaacaaaaacacaaacaaaaccctgccaaacatacccaatgtgcactaatactaatgggaaattatttttcaaagataccttctgagtgcagaagtcagaaaagcaattccttgttgagaagaacaggtcatgttacatacttataaaccaacaaggtgtcgctattattgactttcccccaatttgaaatcgaatgaggtatatttacttcattagaacaagatgtgtttttctacctgctggttaattgctatgttaacagtaattttgttagaacaagatatgcagttaccattagccaaaagattatcataataaatattcaaatagcccaactctaggctcaacaaattataatgaaagtataaaaatgtttcacaataacaaaaaatgcttctgtgcttccaagatgttatgcctaatgcattggacaatctgaactgtaagaggacacctttaatttagtacatattaatcaaagaacttctctaagttaggttttgcacgttatgggagacaaacatgaaatagacatagttttggtctttgaggtgctcataatagaatagagctttctctatttaatttctgtgtttttttcaacagaattttcaaggaaatcatttattcatttgtccacttcacaaataattatcaaatgtcttttagtactaagcattttttttctaatgttacagaatacagacatttaaaaatactgttggggccagcacagtggtgcatgcctgtaatctcaccactttgggaggctgagatgggaggatcacttgagcccagaagttcgagaccagcccgggcaacatgacaagacctcatctctactaaatttttaaaaaaacaataaaacattagctgggcatggtgccaggtgcctgtacttccagctacttgggaggctgaggtgggaggattgcttgagcctgggtgtttgaggctacagtgagctatgatcatgccactgcactcgtgtctgggtaacagagtgagaccctgtctcaaaaaagaaaaaaaacaaaccaacaaaacccaggagcttgttattatcattgtcactttaattatttgatgaattatttattcagtgcctactactgtgttagatgccctctggaaccgtatagtgatcatttattatgttaaatatgtgccagacactttatgtggtgaggaatgaaagctgtaaaaaagtgagtaagatttaaggtaggcatgaagagtgagtagaacttttctaggtaaagaggcagaaggatgatgtgggcagaagattgtgtgtttcacagaaggagcagcgagtgcaaaagtaagatgcttgagtgaactttgcagggtttatgagcagttcagttttgccagtgcaaaacatatgagatgtgaatggttgggaatgaagtgaatacctaaggcaagctcatgacagacttttttttgagacagagtctcactctgtcacccaggctggagtgcagtggcgttctcttggctcactgcaacctccgcctcctgagttcaagtgattctcgtgcctcagcctcccaggtagctgggattacaggcgccagccaccatgcccagctgatttttgtattttcagtagagacagggtttcggcatgtttgacaggctggtctcaaactcctgacctcaagtgatccacccaccttggcctctcaagtgctgggattacagacgtgagccaccactccctgcccagactttttaatactatagaaatgagtagatctcgggccgggcatggtggcttatgcctataatcccagcattttgggaggccaaggagggcagatcacaaggtcaggagattgagaccatcctggccaacatggtgaaacctgtctctactaaaaatacacatgaaaaattagctggacatggtggagcgtgcctatggtcccagctactcaggaggctgaggcaggagaatcacttgaaccttggaggcagaggctgcagtgagccaagatcgcaccactgcactgcagcctgagtgacagagcaagactctgtctcaaaaaaaaaaaagaaagaaaagaaaaagaaaaaaagaaatgagtagaacttttcctgtaggccatgggaaatttaccaggtggaatgcattgggctgtaaatactaggtgacctaactaacaatggctaaaacagtagggaccagagttattttgatggttcagtgataacacgatgttttgttcatgtctgttttcatggctgactaattagcaacagctccaaacatcatggtctcaccgacaatatctgaaggctgaaagggtggcttttctttacatgtttcttttagttagggagaagactcagaagggtgcagttgacttcctgtaacattttattggctgggtcctaccacatgctcattcctaaaccaggcactggggaagcaaatgtaattactatgatgagcttagaataatcatttcttcttttggagtggggagggctattggcatgataaatatccaaatagattcgtgtttctccagcaagacagaacagggaatcgctattgggtagggagacagcaatgtttactgtaggaacacattggagtggggagtcacatgattagatttgagtattagggcaatctggttatggtataaagcagggattggcaagcattttctgtacagggctttttcatgtggtctgtcattcctactcaaccctaccattgaagtatgaaaacagtcataaaaaggcaagcaaatacacatgactgagctccggtaaaactttatttacaaaactataaggcagactggatttgctccatggcctgtagtttgctgacccctcatatggagagcagctggaagataaccacataaagagacagggaaacaaaagaaacatttgcatttatcagagctatagtttccttgtgctgtcctcagactagtgtcagtctgttgtgaggttttcacccatccatggtgaaatcactaaggttaaggagctcagttattcatttaaaaatgttggtctttttcttggcatgatgcctttttcatttattttacttaaactttttttaatttaagaaataacattaatagttgttttttccctataaaagccactacttaagagcccatgtttaactaggaaatataaacataaaataaacgtgtcacagtggaaatataaagcagatgcagaaaagaggtacagttaatatgatttagtgattgttgaatgtaaaaagataggggatagggagaaatctcagatgattctcaggtttctggcttgtgccctagcatttaacctggacacgagggagtaggcagttttcaggtgtatagaggagagcagcaggtcagcagtcacgactaacagttttctctgcattgctgagtttactgaaatgtccatgtgggatattttcagtaggtaattggataaatttttatggctggagatggagctctgaggttggagttgcagacttggaataactgaggcaaagttgtagatctgagtgagcttgtccatgatgggaaaggtatagaatgagcagagggccagtgacagaaccctgggaatatcagcatttcccagaggaattaggaaagaagcctgagccgtggctaaagaaaaagaggagaggaatcataaagtgatgttgcaaaaatttacaaaggtgagaatttcaaggagggagtatcaattctaaccagtaagattactaaaaagtaaagtgagttaagcttttaaaagccttcagtggcactgtcttctaaagaacaatcatagagttgtggggttcgctgtttatgtgatcagtacttctgatgttcaaatgtggaagaatacacctaccaagatcctacctaacttttgtaactgcagcagctccctgtacaggatcagggaaaatggtcaagactggtgagttaatgtaccaccattttcctagaattgtctaaacctaaggtcatatgtgaggaaaagtgtagtctttcttaactgcttttttgtggaaatgcttgtttggtactcaagtccttgataggctcttctgaatgcattcccaaacaaacatctgacagcaacaacgggaagccaccaccagatacacgtatatatccttcctctgacatggaatcataatacagccatgttgtgacacaatttcaggttttgattagaaatagtttacaggccagcagtttagacaaactgacattttaaaaatattttattgcaggaaactaatataatgtcctggagaaaaaaataaagtgaaatgctgaatataccagttctcagtacttggggttttggtcacatcaggagaaaagtcagtgcctgactccttttgttagtgcagttcccttttcatttaccctcttgtgatatttctgctcttactgcttccttttgaattccattcctaaagaaaatactattagaacacatttcaaatgcacttctttatatctgcaccacaatgacacaatgatgatggtctgccaagattttaagtgtcttctgggttgtcaaatacaaattgttttatctgacatagtttaaatgtgaagtgcttttctggtattacatttcttcagaaattggtaatctgtgatttaactagaatatgtggtcaattggattaccacacttttaaccatctatacataagatgtctcttctcccggccagataagttaaaagtcctgttgatccttactgatcagttccactatttgcagggtttttttggacttttgttgttgttgttgttgagacggagtctcgctcttccacccaggcgggactgcagtggcgctatctcggctcactgcaagctccgcctcccgggttcacgccattctcctgcctcagcctcctgagtagctgggattacaggtgcccgccaccgcgcctggctaaatttttgtatttttagtagggacgaggtttcaccgtgttagccaggatggtctcgatctcctgacctcgtgatccacccgcctcggcctcccagagtgctgggattacaggcgtgagccaccgcgcccggcctggactttttttttgaacgggtgtgattatagcacactgcagctttagttcctagcctcaagcaattgttctgcctcagcctcctgagtaggtggaacaacagatgtgtgctactgcacctggcctgctgcacaattattataaaaatgaattaaatcctacctagtgggagaaaattgactgtgatcttataattttttgttccagaaacttttatactgtagaatatattgtcagtcattaagattttctatttttaattgagttaaaataggattgttgctttttaaaattactttctgacatcattgtttcatgcatttttaatgcctttagtccggtggatatagaagtacaggaatctccaaggcaaatgtcaaaaaaaaaaataagcagattagggaaaggtattctgtgaaattaccttctgattgtagtcacatgaaacacatcaacttaaacaataaaaaattgtataatgtaattgtatcaggggttcccaagacccccttcactgaggtttggtaattcactgagaaggactcacaggactcagcagatagtcatacttggggctttgatttattacatttaatacagcaaaaagacacaaagcaacatttgagaaaggaaaaggtgcatgtgtcaaagtctggaggaagccaggcacaagctacaggagtcatctcctgtgtagctagcaggatatgcttaattcccccagcctcaaattttgacgacacatgtgcaatgttgtctaccttaccagagtttcattagaggctcagcacccatgttttcgatggaggctagtcacataggcaacctctcctctccctcacatgtaacaaaactctagactcccaggaggaaattaactgttcatagtaaaccacatttgcacaaacagtttaggcacagtgagccactcccttcttctaagttagggaatgctgggaaccctcccaaattcaaggtcccaaacaccagccaaggactagccttgcaagcaagcctttctaaggatgggtgtctcatgcctgctatatgaaatctttgctgcccagcagctatgcccctgagtaaatttttggtgttatcttaacattttatataatacaatagcaaataatatgatagaccataacatggtactggtttcagctgcatcattcatattaaatagcaaggctgcttacagttttgacatttggtgaatacttaacaggtattggtacataagttactatggcaatattaagtaattataatctgtccttcttatctgattaacctttcagtaaaattgtgggataaagtaggcataataagttctgatttgaaattagaataaaaattgtctttcattttattttcatggatggaccagttttgattcatattgtactaaatccctgtttacaattatgaaataagatcagatattcaatcatttttgtgaattttttttgcctaagtatacaattaaaattaattgctttatgtgtttttatatgcttcaatttgggagatagtactcgtattctgttaccttgatctttagtgatttgcaattttcaaggtgactctgtctttttataatttagggtaatagcaagttcagtgagtatgtgctttaaaattaataatattattttctgagcagttttagattcacagcaaaattgagaaggtacagagattttccatattccccatgacccctgacatatgaatagcctccctcattatcagtaccccccatcagagttcatcagagttacagttgaggaatctaccttgacagacacatcacccccaaggtccacagtctacgttagggttcactcttggtgttgtacattctatggtgttggacaaatgtgtgatggcatgtatatacccttgtagtatcacagacaaaatagtttcactgccctaaatatcctctgtcctccactgtttcgtctcttcctctccactggtttctggcaaccattggtctttttggtgtctcagtagttttgctttttccagactagtcatatagttggaataaaacagtggtggatatctttttgaatatttaaacaataaagttccatggtaatttgattctgtcattttagatgttctttgtccttgcgtttgttttcctcatgttgtgttcatcagaacaggatctgatggcatatgatttgacgtgctgagaaagcgtgatttctgtagacgtttgccatgtaacggggagggtggggaaaatggcatcatgcagtattccacagcactaactggaccatcatgctctaggagatgggtccagatagactctagcgatgggacgggataatctcaagagctggactttataaaactagaatcacaaagtcttgcatacttaccttgcacttaaaaagatcaggcagtgaacactacaggtgaataaatatgttcctctctggttctcttccttttagggatgagcttgaaaacagtctatattattagaatatggctcatctacaactaaatgctctgtcatggaaatgccagtgtttttctttacaataaatgaaaaataattttgttttcaccagagagagtaacaactgttggcacattctggcaggttgagtgagctgatagttctgttcatatatatttttcataccaggtagtattccctggcaacctgccaccactgtggcagtgtttcttcttaagcttctcactgaatgaatggtgtggctcagagtgaataagctctttaagggagtgatctttccagtggttctgtccataggaggtaaaatgggaggtgaatttgagccttgtttgtactagggaaaatagctagaactcagtaaacattgccagcatctgccccagaagaggattagtgagagtgagtacattgatctcccttgagctcttctccactggcagctgaaaagtctttgcaaagatccttatccctggtctcttccctatgttttgccacataacacagcacagcacccatagacctacataacaaaatgtacagttttccccccttatccatgggggatatgttccaagacccccagtgaatgcctggaactgtggatagtactgaaccctagatatgcaatgtcaggatagaaggaagaggataagagcaaaagggggaataaagaatgtggaaggcagagagtacagagagtaaatgaagggaaaagaagcaagtggatatgatggagggtggtaaaatgagataatacttcaaaagaagagtggggtattagaaaggtggaaagaatataaggtgaacgtgcagcaccaaaacttatcagataagacaaactttacttgccaatatgttagttgtgctttaagtttaattatttcatcatagtgtggctatactgatgattttaagccagtcagatattctggtcagcaaatcatatgtgtgtgtgttttgattatcagaaatgaagaaagcaattaattacccttaataactatatggtggacacagtcttttaaaacattgattctgaaactttttggcctggggttcattttatatgattaaatattattgcctagaggtaaccaacaccctgaattaagaatttattatgtccattcccttttaaaacattttattacatatgtgtatggtcataaataatatgtagaatttgttttcatgtcctaaaattgtatataaattgttttacactctacatattttgcaactttcttttgtctggtcacattacatttttgaggtcagtccttattgacacaggaagctctggttttctatcaaatgactggatctcaaactctcttcataatgataaataaataattaaaataaagaaaaattattgcaaattccaaagagcttttatttaagtcggttgtgtcttttgttatttactattttagaaataaaaactaaaatattttaaaaacaagcatgcagccgggcgtggtggctcacgcctgtagtgccagcactttgggaggccgaggcgggcggatcacgaagtcaggagatcgagacgagaccatcctggctaacacggtgaaaccccgtctctactaaaaatacaaaaaattagccaggcgtggtggagggcgccggtagtcccagctactcgggaggctgaggcagagaatggtgtgaacccgggaggcggagcttgcagtgagccaagattgcgccattgcactccagcctgggtgacagagcgagactccgtctcaaaaaataaaaaaaaaaatttaaatcccaacaattttgtttatatagtaaaaaggaaaatatttttgttatgtattcctttcctgtctcgtggcactgtgtgctatttggacctagtgtggtcctagactaatcctgttctcacatgggaacagttagagcccttaacagctcttattttgcaaataaatgtatgaaatttatccaagtatttgaaaggaaattctgaagatagtggtgcattgaggaaagaccatctcattataattaaaatagttttaaaagtatatttattatgagtttttgtaaatcctgtgtctctacaatacatacatacaatgctgtcatgtatatttaagcttaaaatggttagacataaattctgttttaaaagatttatatccacgaagaatcttaatgggaagcaaaatatgtaatagagactgctgagtgaataaaagtaagtaatagtaaacggtaaaaatgtagaaaagtgagagatgatagttaattaaacttacctgaatgaattgtaagcataggacatgtaaaatgtaataatcctgaatgcatagtgtgttgtgggagagagcaggatgtgggactgtttctgtgaagaaagcatgtatacaagttagtcaaattattgtgttatttacatcctaaaaatgaaaacttcattttcggatttttcagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggggttgtacttctctcagggaatgatactctccatgacctgtgccaatcacagctaccagaaaacaaagagagcaaagaaggtaacaaagaagcatagagaattcagtcctagagtgcctctgcttggctgcatagagctatagttctgacttaaaaaaactttttctggtaaaatgtgctttgtgtttactcaccttttgcactgaacagaataccttttggcaggatatttgtgttcttcctttaaccaaagcaacatctagataacagagaattaggggaaagcaggattttctttaggaagtaggattatatttagaatatagggactaagtatgtttagggactaacataggattatatttaggataacttagtagagacctaaagattgctgactcaaacacaatgtggtttctttgctttatttttacagctctgaattcacagctgttagttataactatatgcactataatttaaaagacaccttcccacacctgcaatctcagcactttaggaggccgaggtgggtggatcacgaggtcagtagttcgagaccagcctggccaatatggtgaaaccccatctctactaaaaatacaaaaaaaactagccaggcatggtggtgaatgcctgtagtcccagctactcaggaggctgaagcaggagaatcgctggaacccagaaggtggaggttgcagtgagccgagattgcgccactgcactccaacccgggcaatagaggaagactccgtctcaaaaaacaaaaacaaaaacaaaaaaacaccttccaaaagcaaatattaagtgacttcctatcgtttctatgactttatgtattatagaattgactttccaagtcagtaattaatgagacttattgagaatttgctgcatagtatctccttggctgtgtccacatgagctaccaccttgcgttaataaatgtgttcgctagggatgttggttttggcattgacagtgttctatcaccaatgcaaataagaccagggaccactcttgagaacattaatgtccaagcatcttaaagttatacgtaaggctttcataatgtgattctgctcagctctccatctttagccctttcccccgtgtgccccttctctggccttactgaactgctggtcctgtcctgctgacccatccttcgactgcaggcaaacacatacactctttcaggcctctttctgccttttgttgctgcctgtcatgctctcactctttcctgtcccctaccccttctaattaggctagcctcactctttaagcctcagctcgggcaggatctctagaaaagtcatctctgacatgctttcttttcactctttaaatcctagtgcctagcacatagcaagactcaatacataattgctgagtaaaatagataatgactctttgtacaaagatgattttcaagattgttccctacagtcaaggagcagagggaatagacatgtaaagcaataattgacaattcgggtggtggagatgcagtagaaaaatcagtaaagttctagggcagccctaaggaaggagatacctagatacctgtttacctggggaaagatgaggatgagggtcaacttcacctagcagtctgttttttattttatgtattttatttatttatttttagcagtctgttttaaaagatgaaaatattaatacatttgtcagaataatacagggaaccatttcggatgttaggaagaggttgtacaccaataaaggtgtccacagtcattttggaaatcattaataaggtactattatgaaatggagaacagtatgcagcattgcctgataatattgctactgcattccaaaattttgttttgtttgtgatggctttgttcattgatgttgggtggatgaatctgtgagtgaatcttcaacatgattgtatttctttaacctggtggcatctagtgtctcccagaaagtggtttgttgaagttttggagaattagaattatttcttaaagaagtaagtattccactaaagatcaagcttcatttaaactctcaatttatgaaataaaatgaaatgtaatttaaaatctatttttataaagactatgtcttttatctaactgttctaagtagtttaactgaacgtttggattttgcagcagaacaagacttggagctgacatcagaggaagagcaagaaagacttaaaggatgcgaaaataagcagccacaagtgtggaaacatttaaactaaaatctaaatttctggtttaatactcttttctttgctttaatatgctagcccaaatgaaattacctctcagactagcctttgagaatcaatagatccttacttaatatttaattttaaatacatttaaactagttataaaacacaatattgttagaatctatcataacttatagttaatctttacccttggagtagaggcaaacattccagaattttgtttgctcttccattcttacaatatccttatgggataaagaaggtaatgtcaattattgacttatattattaagcaacagaaattatgaacaatttaacagtgatggccactaagttggattcatggtataggagtaatcatggccagtggctcaaattttgcagttttatattgccagttactaatgcctaggttaaagatgtggcctttcattgacttcacggtctacattcagtgagagtggggttatgaaatcaacccaactgcctattaagggaatcataccttgcagaatgggatctttggtgttagggtacaaacaataactttctaactttttagatgcagaaacttagtaagaattatctttaaagttttagttagtgttattaggggaccgtagtatatattagaactgaactgaagaagatagtctagatatataaccctatgatgttacagtatataatttgaattaaaacttaagaatttgcttttgtttctgattggtgttgattcgggctcctaataatttgaagattgcctaccctccagttagtaatctatagaacttacatgtagtaatatatagtacttacatgtagtaatatgtagtacttacatgtactgtaggggctcacttttcaagtgaggaagcctttgtaacactagaaatcatctgctaattcatttttggtagatttaacacataatgaattaagtttattccaaacaaacagtgacaaagttaagtttgctggttcatatttttctcctcctttcagctaagacaattttttttaacttcttagttacaagccagtgatttgggagtagccaaacctagatgaagaagtttaacagttaaattttcattttaattatttgtgaatttttctttgtttatacctgttatttaaggacaaagctatttttaaaacatgtagcccaacagagaagacacccaagaaacaaaacaagcaaattaatcttccacttttgcatctgcagaaaacgtctcaagaaccagaaatggctaaggattgtgatagagaggatatacctatatatccagtacttcctcatgtgcaaaaatctgaggaaatgcggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtgaaggatattccctttaatttgacaaataacatacctggttgtgaggaagaagatgcatctgaaatatctgtctcagtggtattcgagacatttcctgaacaaaaagaacccagtctcaaaaatatcatccattcatactaccatccgtactctgggtcccaggaacatgtttgccagtcatcttctaagcttcatttacatgaaaataaattagactgcgacaatgataacaaaccaggcattggacatatttttagtacagataagaactttcataatgatgcaagcactaagaaagcaaggaacccagaagtggttacggttgaaatgaaagaagaccaagagtttgatttgcaaatgacaaaaaatatgaaccaaaatagtgacagtggcagtacaaataactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaaaatgttcaacttcataaagaggtagggttttacttgctgccactctttgttttttctctcaattatctggtccattctgattttccacttaggaaaagcatatgaaaatcatacagtttggttgtctaaatctgtaattgtgtgtagaaacagatgatttctaagtaataggagtttaggaaaactttctcataatctttgtttcttaattgacctaagtctctctgtcagtcttccaagtggcgtatggattgtgaaactcatgtagccatatatcatgtgaccttcagaaccaggagaggcgtcaagaaaattgctaaaggaaatgtgatgagcttgagggctttttccttttaccgacttaaagatgagttgtgtctaacaataagatgggaatacagtagaaaggaagcaatgactaagaagagatataaaaatgtatctagcaggcgtggtggcaaacacctgtagtctcagctactagggagcctaaggcaggaggatcatttgaggccaggcattctgggccgtagtgtgctatgccgatcaggtgttcacactaagttcggcatcaatatggtgacctcctgggagcggggcaccaccagatttgctaaagaagggtgaaccagcccaggtcggaaatggagcaggtcataagtaactcctgtgctgatcagtagtgggatcgtgcctgtgaatagctactgcattccagcctgggcaacatagtgagacctcatctcttactaaaaaaagaaaagaaaagaaaaagaaagtatccagccctgagagctgcagcaaatattcctggccaatgaatctgtttattgtgcttttcaggtttatctgtttaactcaaactgttggaacttagaattgcatcatgaccactttaaatatttttcaacaacaagtatatacactttaatatatttgttaatataactactctccactgtttctgttgaatcagacctttatgttatgttgcttaataaagtacagtaagttttggcacatatattttttccatgtaagtagcataaatgctcagccaaacacttagtatatgatgccaaagtagaaagctgagtcttctacattgattagggcaggcctcccaccctcctctaaggcattaaattattttacccaagtcacacttttaacctatctgattactttgctgaatttgtctgattcagcattatggaattgtactgtctcttttggtgccacaaaatgctaggtaatggcacttcaggggctttggatcaatcattttaatcttttttggctttagcccagttatcaatagagagtgagctaaagtagattcttatactgtatatcctccagctataaacttttatggctattgaatgtgaaatttggggagcatctcatttcgagaattccaccctagctcagcagtttcactctgctttttgtgttgtgccagacttgtatttcagtaagcaccttcaccttttcgatatcccaggattcaaatgaaaaaaaaaaaaaaaaaaaagacaaaagttagtgggggaaaagaatagcttagtgcagaaaagggaaagcttcctttcttttcctaaaaccccacagtgttgtatcctctcaatctggctgttgaatatgaaagtcaagtggcaaagacagaagaagacatgctttgtgtctttatcttcttatttccatgtttgtgccagtcaaatgaggtaaaaattcataatacatagtgaagggtggttgggaataaaagcacaaaattaagacgggccctggttgaaattttgggaaattctgtctcattcattgaaacagaaatgaagctgactttacaaaaatgttgatgataaaattataataattataattatatgatgatagttccagatgtgataaaattaaagtaagcaccaaatattttaatgactaaaattataattaaactgagtcaagtgatgatgaaatcaatgaaaacagaaaaaagttctttgtattgaataaagcaataacaatcatcctgaacatcaaactctcactcaaggttgaagaagaaatggagaagcacagaagtaatagcacagaattatcaggaaccctaactgatggtactactgttggcaatgatgatgatggactaaatcagcagattcctaggaaggaaaatggagagcatgacaggtaagcctatagcagcgtttaacaggagacaattggtcaagtgtggtggctcacgcctgtaatccagcaatttgggaggccaaggtgggtgaatcacctgaggtcaggagttcaagaccagcctgaccaacatggataaaccccatctctactaaaaatacaaaattagccaggtgtagtggtgcatgcctgtaatcccagttactcaggaggctgaggcaagagaatcgtttgaacctgggaggcgggggttgtggtgagccatgatcatgccattgcactcgagcctgggcaacaagagtaaaactccatttcaaaaaaaaaaaaaaaagcaaaaacagaaacaaaaacaaaaaacaggagacaattatgtgctatgaaatgaatcctaatttgggctaatattcatgatgaacagattttatacttttactaggatattcagccttccttggttatcagaaaaatgcaaactaacaatgagacaccatgttttccaatcatattgatattttatttaaaaaataggaagtattggcaaatgtgaagaaaaaggcgttttcatacacttgttaaatgaaattgatgaatcctttttgcagggtaatttagtagcatgtatcaaaatttcaaatatgtcacttctttaacctaacaacttcacttttgggacaagatcctacaggaaaatatgacttgtgtaaacacatacacatatgtgttaaggacatttattacatgtatgtaacatacaataggctaataggttaaatatatataatgttaagtatatatgatatatatgttaaggataattatatatgttacatatatacttatgtataaggatatttattatagcattgtaatatcaagaagttggagatagtctaaatccttagcaataaggaaatagtacaattgtcatacccagaaaataatgtagcatgcactcattttaataaaagaagttgttagaccaggagtgtactgattatttcacaattaaagtctatttaaagcctttagtttgatgacacatcttaagccagttttgttggaattctcataatatctgctgagttacaaaaggaagctagctacatgctacattgacactgtaccttgttagcaacagaattctagttattaaatttttgttttttgctgtcaatgtgtgagtgctgaaataccagatcctcaaattaatctgaatattgccaagggattgcacatggggattcatgttccgtgtcagcttttcaatatactgggtaaaacttactaaaatacaacagaggatcttagctctactgaaccaagaattggacagctctttttgtaaagagccagttagtaaatattttaggccttgtgaattataaagggcataagtgtggctgcatttcaaggaaatttccttatgaaaacaggcagtgggctggatttgctccacaagcaccaatttgttgatccttgtgctaaaaccaaggtgctgttatgcagtgaatcctctttttaaaggtaccctacatgcatgccattatcctttcttttaaaagataatgtatttcagtaggaaacacaccatatttttcaacagtagcttcatataatttagacaaatttgatttacaaaataagatgattttctgcacttgtccccttttattcttgttatagaattccatattttgactattactttgtatatttgatgagtataaaatattctagagttagatgatttttatcaagcaagaaatacttctcctgaaactgttagtcttccttggtctttatgtataagcatgagcaaaatgataatcagcttatataatctagaaatgttcaagaggtcttttggtcttataagttaatgaatttttatttaataccttcatctggcatttcaaaaatgccatatagatatgatttaaaaaaaacttttaaagggtaaaaatatagcatatagttatataagaattgaaaaatacagctaaacaagaagaaaattagatcatctacagtcatgcccctaggtatgctggccttgaaagaatggtttatactcatggattcagatttcttgtccattcactcttgagctgataccagtaattttcactcccaccactcttccaagattgttgttctcaagtttaccattgatttgtaaatctagacattgtttcttagacctcattttatttaacctgtcagcaatattggacccaatggaaaactctctcctccataacagtgtcttcacttggctttcaggatctcactcactcacctggcttttcttcctgcctttccagtccatctgtcatagtctgttttgctttcttctcatatcccaccttttacacattgatatgtcccaggactgatatgtcccaggactcagtcctcaatcttctttctcatgacttttactaccttgtgtgtgctaatgatttccaaatgcgtgtctccagcctagatctctctccttaattccagacttctataccaacctgcctacttgacatctctgtttgattggtcacgaactgttgggtatcacaaacttaccaggtccaagattggggtaccgatattctttctcatacctacccctcacatggtctttcctacttgcattaatggcaactcttgcagttgctctgctagaaactaaggtgtcatcattgactcccctctctctctgacacctcacatctaatctgtcagcagatcttgtcaggagtacctgaagaatatatccagaagccagtcatatcttccatttccaacccaccaccatctgctctctagatgcatgtaatagactgttaattggtctgttgttttttttttaaagaaacctcttttcattaatccttaactcagtggccatacttaaaacataagtcagatgatgtcattcttctgctcagatccatctgattgcctcccatttcactctgagtatgtgtcagggttcctcctcatacctagaaggcaacacacaatatgccctgttctctctctcacttaaacttctgtttcttattccctttgctgtgcttcagctacactaaacttcttgctcttcgttatctatcacagttgcttaaacaccccaggcacacctctgtactgggcagttccctgtgtttgggatgccttttcctcagatagcctcctggctttctttttccattccttcagttctttacttcaaagcccctttctcaataaggacttttctggccatcctagaattcccactatccctcctctcaaacctgtaaacatttcattttcctgctttagtttttctcctttaacactgtatattttgcctaatctatctatggttattgtgtttatttcactcccatgagtaggatgtttgtgtgcctagaaaagggcctagcttgcaataagtagctactcaataaatatttattaaatgagcaactgaagtttacccttcggtgtattgttttaaacattagattgattctcaggtaagaaaaaaaaaaaaagaaaaagaaaggtttcacatgggttcattctaacacttttgcctggaaattatatgcgtttttggattttttggctctttgtaataagctacattctttgtattaatagttttccatttagagagaaaagctcaatattgtggttactcactatttattcttttactaataatcatgatagttttacttatgataaaatggatcaaaggaattacatagttcattggtaatttataaagaaaattaaaatataagggtggtaaatttaatggacttaaaattgtttccaattgattatgaaccttcagtatttgaagttaaaagaccaagttggaatgtgttgctttctataagagagctatgctcatcaggcactctgtattctgacagagcagctgttgatcttacatagggttgcaggaggagcggacttgaagcattggcagactctcagcggcataggagggttaacatcatctggagaaacatggctatctgagtgaggctgctgtgggttggttaacactcccaggcttgtggattggagtgagtttgtgtttaattggctgtctttccgaagcaagtggtccacattgatattggttggtgagagaggccaatggtcactgatgattgactgtatttacaactggctgtgggtggttgcttgttacaaatatagctactaagtttgagacaactttaaactgcagttttctgtttaaaagttgccttccatcaactatgtttaaaatgaaaatgatttcatattccagaactatagacttaatttggaagtgtgggtcaagaggaattgtttaataattgctctcaggaagatctctttttttgatgcttagtcttaaccagaagaattcgctacatagttaaaaaacaagcaaacaaacaaacaaaaagcaattattaattttgtttcagtttttagtattttcagagacttctgctaaactcctaatctccagtgggaaatgtttgtctctttgttaatgtatgtagttatatgatagtgatattcttttttttattccttaatctttttttgttcaccttctcttccatgcaatgatagtgatataatgtgtgtttacttcataaaaaagtaattacaattttctgctggcaaatccacctttttatattaagactaagtactagactaaatatgtgggaaatttaccaaattattttattttcaaacaaacatataactaatcagaatattgctatttttgaacaatatataatgactataatgacatttaggaattttaacactaagatttttttcttcccgagacatttccttgatttctttcatgtaatatgtgcctgttatttttaaaacttggttaatctgtttaaacattattatatttaaaaacaaaacccaaaacatagcacagatctaaatatgagtttcatgtgtgagagtcattgcctgtgtgcagtggactccagctgtttttttttttttttttttttttttgagacgcagtctcgctctgtcgcccaggctggagtgcagtggcaccatctcagctcactgcaagctccgcctcctgggttcccgccattctcctgcctcagcctcccgagtagctgggactacaggcacccgccaccgcacccagctaattttttgtatttttagtagagacggggtttcaccgtggtctcgatctcctgacctcatgatccgcccgcctcggcctcccaaagtgctgggattacaggcgtgagccactgcgcccggccagctgtttttttttttcttttcttttttcgttgtgacagagtctcactctgtcaccaggctggagtgcagtggcaatctcagctcactgcaacctccagctcctggcttcaagcgattcttctgcctcagcctcccgaatagctgggactacaggtgcgccaccatgcccagctaatttttgtatttttagtagagatgggcttcaccatgttggccaggatggtcttgatccattgacctcatgatccgcccgcctcagcctcccaaagtgctgggattacaggtgtgagccaccgcacccagctgactccagctttttagtgtggcattcatcttccattcttactttctttgtgttttacacttttcctttcaagttcctaggaaacacctagactccatgggactaatctttgtgctgtcattccattctccaagtggagtagttttctctattttttccctggtgagctcctcttatattttgcctcttctgtaatgacttccttgtgctaaaatataactttccatatatcaactcttaaactacacattgtatcataattgcatattacctggtttttgaggcaggaaatatatatttctttatatgttgttgataattcataactgtgttttttgaattaatgaattgagatggggaagaattggaattttacaaaattttttttatttgttatcagtagaattattataaaacattggctttttgtagattttttaaagttgtggttctgcgttacatatgaaggaagtaaagaaaaatgaaaataaaaaatgtacctcaaaataatctctaaaataatctctgattacaccagtgtttgagaaggctaatttagtaacttgtggtctgctacaaggagatgatgacagcagtttaagtgaaatagatgaggttgaaagaagttaaaatgtataagttctttatttctctgagaaggaatattcccagtggttactttttctggaaatagaaaatagtgtagtctgccaaagctagagaatactcaactatatcaatgctgaaagactgattatgatgagggctggtaactttgacaaggagcagtttcaataaataattgctgtggaatcctgactgtagtggataagcatagataccccttgagggaaccgttattgggaaaggcaacagagaaatgagtgataactgaagaagaatgtgggattcaagggaattttctttcttttttatttcaaaatagaagcttttagagtgtgtttgtatgctgctgggaatgatagggacaaggataacatgtttatgagatttaattttgtatgtctaagtgtttgaaagctcggttcattatcttttgtaggtttttagcaaactaattgtccttaaagtgtttattcatgtagagttttatggtaagagtttgttccttcagcattggttcagaaatgtaacatattagcataactgaacctgtgaatggtgacctaaaatttaaactatcatatgcagattgtttttaattatgaaataataaacatgcaaacacttaggccatactgaatagaatttaaacatccctgatgaataggtatgatctgctgaggtactctaaaatgtcaggagtatcaactttacagttgtttagattctggggagaaggggagggttttgtttaagtactttagaaaagctaactgttgacagtctatcagattattacttctggattataaagttttgttttttttgttttttttgtttttttttttttgagacagagtcttgctctttcacccaggctagagtgcagtggcacaatcttagctcactgcaatctccacttcccagattcaagcgattctcctgtctcagcctcctgagtagctgggattgcaggcgcccgccaccgtgcccagctaatttttgtatttgtagtagagacggggtttcatcatcttgggaaagctggtcttgaactcctgacctcgtgatccatccaccttggcctcccaaagtgctgagattacaggcgtgagccactgcacctggcctataaagttttttttaaaaatatttaatcaagttgacctacaatggattataaagttctgaagtatcaaaaccatgtttcccttgaccaacattgccatcagcatgtattgtgtgctcaatgagtatttatttgttgaatgcgtgaatgaatgggtgaatacatgaatgaatacctgttgatggatttcattaaaaatactttttagttttttgaaagtagttttctaaacttgcctctgtataaagtttttttattagaaaaaattgcaagattctgacattatttatagttgtagtcagaaatggaatgacaatgtgggttcatctgctatcatctctctttaaaacacttgaaaataaatgttaccttcacagcatatcatgaagcacatgtttttgaggcagaattcttgggtttgagttctggatctgctactgaccagctgtatgggctgaggacagtcacttggcccttctgtgcctattttctttctttataaaattcttaatatgttactgacctcacagaattgttatgaggattatatgagtttgacacatggacagtgctcagaatgatgcacagtacctgcatagtaagtccagaaaaagcttactaatatcatcattaaaaaagggtttcccttatataagaatgtgagtaatattttccaaataggttttagtgcccgtaaaagcttgtttttattgaaaaggacaacaatgagaagaccctggtatatttatttttatcacgtaatgcaggtaacatatttttttcttttggttttactatgagaaatcttgacctaaatttaattctttgtaattatattagtagtagtaaatttctttatcccttaatgttgctgtttctgtttatagtttaatgtccgttgtagaaaattactgcattttacattacctgtaaaaaaattacctatacacttgatgaatagaagtaacacaaatgcagacattttatatgataaaacagtagtgttagatattctttgtattttaaatctttgctatttttctaagaggaattgtttttttttttttcaggcctgcagataaaacatctaatgaaaagaacgaggtattgtaaaaaaggaaatgatctaaaatattgttttaaaaaaacaagttctaaaaggtaaaaatgaaaaaaacaagatgttttgttgtaaggctgtttgcttagaaaaagtgatgaagaaacagtaaccgttgataatggtaccttttaagaacaatctgttgctttaagaagtacctgtatttttgctcatacaaaaaaaatggagaaataccgcttctgtacctttagtatatgctataaatctttcgaggacattttgaaacagtattatttatcttataggtcaaaaaccaaatatatcctgaggctgactttgctgactcaatggagccatctgaaatagcctcggaggattgtgaattgtctcactctgtttatgagaattttatgttgctgattgaacaacttagaatggagtataaaggtaggaccactgcataaatgcaaggccttttgatgtatcctgcagtaatgtgtgtatacattgctgagaactgatgtgtgatagtgaagctcatctcagaaatacgctcagtgttaaaatagagaactagcttatactctacgccaaagagctatgataactccactgtacttctctcagtgtgagtggcattcccagtctttttgttgactctttctctcctattccttcccccaatgtcaggttaccatttttttctccacctggaatgctgcgagaatcttaggaatcttagaactgttttcccaaataccccacctcctaaaaccatggtctactctgcaatcataatgacaaatttttaaaaatttggatctgatcatgttactcctttgcttataactcagctactacttcttattgctgtaaggttagagatctgaatcctctagctttatcctgcatcgtttttactcttctctttctctgtgtcccactctgtgtcttatatgtttgttccagcactgatagcttcagtgaggtataactgatatatgatagactgcacgtatataaaatatacaatcgtgtgcacatttgaaaccaccataatcaggagagttaacatgttcatcatccataaaagtctcttcttgtccctttgtctttctttattaagaaactgctaaattgttttccaaagtatttgtattgattttgcattccaaccagaggtatacgacatttcttgttgttctgtatcatcacaagctcttattattgctgtttttaaattttgaaattttagccattctgatgggtgtgtattatgcatatcattatggttttaatgtgcattaccctaaggactaataatgttgagcatcttgtatatgcttatttgccacctgtgaactgtcttttccaatctgggtagcttatgaacatttaaaattgagattcgattcaatcagcttttttacatacaccaaagatagtcaaaccttttcattttcaaactgttatcttactaaacatagtaaatattttaaacttgtgatgaaatggtctctgtcacagccaatcaactctgccattgtagtatgagaccagccatagacaatacatatgttaaaaaacacaactgcattccattaaaactttatttgcaaaaataagaagctgccccgcaggttggattttacccatccctattatgtgatcatgattgtgaatacagacagttttacttcttcttttcaactcaggtagcttttatttccttttctttcctaactgcactggcttcagtgcaatgctgactagaatagtgaaaggagacattcctgtattgttcccgatcttacagggaaagcattcagttattcatcatgacacatgttagttgtaggtttatcagagatgctctttatcatgctgatggcgttcccttgtattctttagttactgagaggggttttttttttttaaatcaggaatgaatgttgtattttatcaaatgcctctatctactgagatgatcatatggttcttctcttttagttttttaatgtggtgaatacttatattttaatgtcaaacaaaccgtgtatttagggatacaccccacttgtttatgatgtattatccttctaatgtatcattggatttgatttgccaaagctttatttagagcgttttaaaagactattttttagagtagttttagcttcacagcaaaattgaaagtaaggcacagagattatccctgtactccctgcccccacacgtgcatagcctccacaattatcaatatcctcaccagagtgctacacttgatctcattgatgttcctgaattgataatcataatcacccaaagtccatagtttatattagggttcattctcggtgtcttatattctgtgaatttggacaaaagtataaggacatgtatttatcattgtagtattatccaaagtaatttcagagctttaaaactcctttgtgcttcatctgttcatcttttcccaccttccctccccaactcttggcaaccactgactttttttactgtgtctgtagttttgccttttccaaaatgtcatttagttggtatcagacagcgtgtagcctttagactggcatctttcacttggtaatatgcctttgtggttccttcatgtcttctcatggcatgatagctcattatcgcatggctgtaccagaagttgttcactcacctaaaggaggatatcttggttttttgagaaactggttacatttttacgtccatgttcatgagggagtcagattttggttcagggtaatgctagagggacagaatgagttgtatttctcctctattttttttttgagggcagggggagaggtcatgtaaaattgttatattgcttcttaaatatttggtagaattcaccagcatagctatctgggcctggagttttctttctaggaaggctttacttatgctttcttttatagatataggacagttcatgttattccttcttaaattggaccttggtaatttttgtttttcaaggcaagtgtccattttatcaaagttgtcatgtttagtcacataaagcttaccttattatatttgtattcttttagtatctgtagaatctataaaaatgtcatgttactatgtttctgaagttagtaatttgcatcttcttttttatgatcaacctggctagagttttatcacttttattgacctcctcaaagtgtgtggttttattgatttttttcctattgtttttccgttttattggtttcatctttgatgttttggtctgttcggcctgctataacaaaataccatagactgggtagcttataaacaacagaaatagatttctcacaaaagtccaagatctaggtgctggcagatttggtgtctggtgagagaccaattcctggttcatagatctcttttttccccctgtgtcctcacatggcagaacaggtgaatgagccctctggggtctatatatataagggcactaatcccactaatgagggcttggctcccatgagctaattacctccacaaagccccaccttctgataacatcacctctgtgattaagtttcagcatatgagttctgggaggatgcaaatgtcagacaataccagatgcttattgtatcatttcctctgcttgctttgagtttaatttgttcttcttcttttttagtttcttctctttttttagtttcttaagataaaagtcaagaccattgacttgagagtcttctaatatagacattaagtgctaaaaaattttaagtactgttgtagctgtgttccacaaatcctgatatgtagtattttcattttcattcagttcaaaatactctctaatttctctttgcatcgtgtctttgacctagggttatttagatgtgtattactttgttttaaaatatttgaatattttgatgagatattttgttactaatttgtgatttgattgccatgtggtcagggaacatactttgtatgacttaaatctttctgacttaattctttcattaagattgattgcaggccgggtgcagtggctcacgcctgtaatcccagcactttgggaggctgaggcggatggatcacgaggtcaggagatcgagaccatcctgaccaatacggtgaaactctgtctctactaaaaatacaaaaaattagccgggcgtggtggcaggctgaggcaggagaatggcatgaacccgggaggcggagcttgcagtgagccgagatcccgccactgcactccagcctaggcgacagagcgagactccgtctcaaaaaaaaaaaaaaaaagattgattgcagaacctagaatgtggtctgtttggtaagtgctcactgggtacttgagaagcatggtgttgttcaagtgtgctccattcttgctgatttgcagctcccttgttttatcacttattgagtaagtgatattcaaatctcagatgtacttgtgaatttgtctatttcgtctattgatttttgcctcatatattttgaagctgttattaggtgcacaaacatttgagattacacgttcttgattaactgaattttttttttttttttttgtatttttagtagagacgggatttcaccatgttagccaggatggtctcgatttcctgacctcgtgatccacctgcctcggcctcccaaagtgctaggattacaggcatgagccaccgcgcccagccgattaactgaacttttaaaagtcattaggaaatgactgtttatagctggtaatttttttttttttttttggtgtgaaatctactttggtattaacatagccatttcttctcaggcttcttttgtcaactcttagcctgatatatctttttccattcttttgaacaatttatgtttttacatttaaagtgctttttttaataggaagcatggagtaggttcttgcctttttatccagtctgacaatctgccttttaattgagatttttaggccagttccatttataatgtgcttattgatacagtgaaatttgtctgtcatcaagctgtttgatttccattggtccccccagttctttgttctcttctttttctgctttcttctcaattagtccagtaatttttatgatttatttttatctcccttttatggcttattagcgataactatttttttctatcttagcagttgcactacaatttatagtatatgattttaacatcacagtccatcttcaaaaaatattatggcatatcatatatggcataagaaaattatgaatgaaaacccaaacattgtatgttctcacttgtaagtgggagctatgctatgaggatgcaggggcataaaaatgatacaggttggggacttgtggggaaagagtgggaggggggtgagggacaaaagactacggattggatccagtgtatgctgcttgggtgatgggtgcgccaaaatctcagaaaccaccactaaagaacttattcatgtaaccaaggaccacctgttaccccaaaagctattgaaattttttaaaaaagaaaattggaatagtatactttcatttcctctctcccagccagatacttctggatttgtaggattatagttttctttacatttagaaagttttggccattctttttttatttttctgtctctctttttccctctttggggacttattcctgcttgaagttttctcatagttcactgatgtctcaaatttatgaatcttctctttggtgatgtctaatctgtgttcacctccatccattttagctttcattcctgacattgtaatttgaatctctacaagtgtagtttgctttaaagaaaaatcttccatgcctctgcctgtctgcttgagcttaattttaatatacagttgagttccatatgaacagcttgatctttctgatcttgcttttatgattggtctaatttcctgctcctgaggcaagatctttgtgatgactctattcattgccatgcgaagtctgagttttcccagcatcactcatgggaatggacactctttttggcacatcgtgaacaccagacatgtttctttccagtgttttttagatgtttttttccccttgatctggggcggttttctggcacacatgtgctgtttgttactctgctagatacccaggaggtatttttgcaaatcttcagtgttctttccctgtactttgtctcctttccggtgttctgttttgtgatctctgtgtgccttggctttaccagactctcagcttcatcatctcatctcagggaatctggtggactctatgtcagttttttctctctgtgcggtagcctggaaactccgtgaaggcagggagctggagtgttggatgaatttcctttgtttcctgtcttacggggatcattgtcttcattacctgaagtccactgcctggtaaatcattgtataatatattttgtctgttttctttttggttgtttcaggccagaaggtaaatcagtacttgctgtccattgtggccagaagcagattccagcagagcttcagcacctgctgtcgactggcaagaatgcttttctacccctttgcttaactgcttccttctcacccttcatttctcagtgtagccatctgttcctcaggggaatcttccctgggcccattatagatcaaattcttctgtgtgatcatagaactctgttttcttacaccatatatctgaatttataattgtcatttttgttgtgtttgttccttacttcacttaaggctaaatgagagtagaggtcttatctgttttatctgcagagcttagtagaatgtctcccactttgtaggcactcagtgcatatgtgttcaatgtatgaaggagacaatgttaaaaatgcacagttttttaatacctaaaagtactcatatattttatttctaccttttctccctgacacagattctgctagcctaccaagaatccaagaaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgaggtatgatgttctagttctaaagaaatatttatactaaagacaatatatcagaatttttgtaactgctgacttaccttctgcagattaatgggggagaaacctttttggtcttgtgggatatgaaattcttggaaataataaaacaaattattaactgtgaactcttctaataaataaatgtatattctttgcaatctaaatggccatatagaagtccaccatataaaatcttgttactcatttaacaaattgtaatttgggttttaaaattatcttgtatttataattaatgatgtaaggaacatcttttatcgttactattatttgtagacacagggtctctgtgcctggaactggagttcactggtgtgatcatacctccctgcagccttgaactccatcctcctgcctcagcgtcctaagtagttgggactccaggtgcacattctcatgcttggctaactttttaagtgttttgtagagacggggtatcactatgttgctcaggatgatctccaattcccaacctcaagcattacttctgcaaaattggcctcccaaatcattagtatgacagacatgagccatcatgcccagcccagaacattttttatataaatgtttttctacattcctaaactgtttgctttgaataaattctccaatatagaattattggttgaaatataggaactttttaaaaagacctctgatcaacatttcttaatttttcacaagaatgtttgtgttaatttatagttcaagcaacagagcatgaactggtcacttttctaaacccaaagtaattttcaaaaaatttatacagttttattctttttgaaaacttttttttaatttcatagctttaggtatacaagtggtttttggttaaatggatgaattgtatggtggtgaagtctgggattttagtgtgcctatcacccgagtagtacacattgtacctcagtaggtagtttctcatccctcatcctcctcccacactctcccacttctgattctccgatgtccattatactactctgtctgcatttgtgcacccatagcttaactccctattatgagtgagaatgtggttttatttggctttccattcctgagttagttcacttagaataatggcctccagtcccttccaagttgctgcaaaagacattatttcattcttcttatggctgagtagtactccatgacatatatataccacatattatttattccattcattggttgatggacacttaggttgattccgtatcttcgcagttgtgaaatgtgctgcaatagacatacgtttgcaggtgttttttttttgatataatgatttcttttcctttgggtagatacccagtaggggattgttggattgaatggtagctctattttagttgtttgagaaatctgtctactgtttttcatagaggttgtactaatttacatttccaccagcagtgtataagcatttccttttcaccacatctgcaccaacatctattgttttttgactttttaataatgagcattctggctggagtaaggtgatatctccttgttgttttagtttgtatttctgtgaatattagtgctgttgagcatttttaaatatgttttttggccatttgtgcatcttcttttgaaaaatgttcatgtcatttgtgtactttttgatgggattatttgcattttcttgctgatttgtttgtcctttgtcagatgcatagtttgcaaatattttctcctatgctgtaggttctcttactctgatgattatttcttttgctgtgcagaagccttttcttttcttttcttttcttttcttttttttttttgaggcagagtttcactcttgttgcccaggctggagtataatggcgtgatctcggctcatggctacctctgcctcccgggttcaagctattctcctgcctcagcctcctgagtagctgtgattaaaggcattgccaccatacctggctaattttgtatttttagtaagacaaggtttctccctgttggtcaggctggtcttgaactcctgacctcaggtgattctcccaccttggcctccatgtcactgcactccagcctgggtgacagagcaagactctgtctcaaaaaaaaaaaaaaaaaaaaaaatatatatatatatatatatatatatgtttttggttaaatggatgaagtgtatggtggtgaactctgggattttagtgtgcccatcacctgagtagtacacattgtacctcagtaggtagtttcatatatatatacacacacattttttttttttggtagacatgaggtctcattatgttgcccaggctagtctcaaacttctgggctcaagtcattctcctgccttggcctcccaaagtaccaggattacagatgtgagccacatgttaggcctaatccatcttgagttaatttttatatatgttgagagatagggatccagtttcattcttctacatgtggctattcaattttcccaacaccatttattgaatagggtgttctttgcccagtttatgtctttgtacgctttgtgaaaggtcagttggttatacatatttggctttatttctaggttctctattctgttccattggtctacgtatgtacttttttatacaagtaccatgctgttttggttactttagccttgtcatatggttttagatctggtaatgtgatgtctctggcttcgttctttttgcttgggattgctttggctattcaggctcgtttttgattccctgtgaattttaggggtactttctctaattctgtgaagaatgacagtggtatgttaataggaattgcatggaatctgtagattgctttggttaatatgatcattttcactatattgattcttctaatctatgaacatagggcatatttccatttgtttgtgtcatctatgatttccttcagcagtgctttctaattctccttttagagatctttcacctccttggttaagtatattcctaggtttttgttgttgttgttgttgttgcagctgttgtaaaagggattaggttcttgattagattctcaccttggtcgttcttgatgtttactagtgctcctgatttgtgtacattgattttgtaacatgagacttttactgatttcattgattaaatctaggagtctttagggttttctaagctaaaacagagatagtttgactttgtcttttccaatttggatgccctttatttatttctcttacctgattgctctggctaggacttcccagttttattctaaatatgcacgaaataagtaaaatggacagtaattgatgattattttattccatatctctcatatgcagataaaattaattccaaattcattgttgaaacacatattatcctttacttttaaactaaatattagatcctgtcttgttccaaaaagggattttaaaattggtgatgaaatacttaagaatcaagaagataagttgaaagtgttacccaaaagagaaacataaaaaggatggggtaacagttatagacagcttaggctagtcttggattatagtaatctgcagatacatgttgtgtgaatgacatctgaaggtgttatcttacactgtaaatcatttttatgactacacatacactattccatgaagacgaaaatgcatttctagtgaatttctaaacttgtttgtaaacagtaacttcttttaaattaactctaaatgatctaattaattttcaacttgcataacgtgaaaaagaagtaattttcaacttgtaactttactgaaaaatttcaaatatgcttttccataatatttaccagggttactagtaacagaaacttaccagttaatggaatatttctttcctcactacctctcaaatatatatgtcccttggaagagatcgaagtgagaaattaaaaacatgagaactagaaaggaaacaagagcataggagtttttatgaggataataaacccacatgggaagagccagatcacagaataaacttttttattttttaacaaaacacattttaatgtaatccatgtttaactgcagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggtaaattaatctttggtgtaaacttcatttttctaactttatgtttcatcggtattacttataattttttgccttcatgtatatcatttaggtttaaaataaaccaaaactgttatttcctcttaagaatgaactatgacatttatagataaaattatttactgtaaaccttgtcatctaatagatgctcagtctgtgtttttagagtggaggataagttgagtttaattactaatatagctgttcatttacacattttttatgttaaaatacaggctaaatagctttgaaactataaggacactagttaaatgttttgaaagaaattttatttcacaatgctgtatcttctcgtagttaagaactgtttttcctctttgacagatttagctgtcatgtatgcaattaagatttgagtgattcttgagggataaaagttcttgtgttttaacaggctacttctttttaaccgttttataagagaggctctgctcttaaccttttagattttctttttcagtgctattagaccaaaacctccatgtcatctctaggttgtgcaggagagaaacgatgcccagaagcaactttctgaagaacaggatgccagaatattacaagatcagattctgacgagtaaacaaaaggaactagaaatggctcagaagaaaaggaatcctgaggtattttctttagtcattttcaaatatatttttgtatgtgaatatatttttaaaaaacaactctgtgcaacttggaaagtacaatggatttttgaactacacacacacacacacacacacacacacacacacacacatttgggggtggtgatggtggttctggcatttttggctcattgaataaagtcatgttcttaattcaactccatttgtttgcaagagtcaagtagtgacattcacagtggccttatccaaaggagaaacatttgttatttttcatagaattaatgatctttccacaatctcaaaatccttgctactaacaacagacgttctagttttcagacattatttcatcttcctaatatattaatggagaggttagattattatttccacttgcagtaaggatgaaatgtatagccagttcagaggccgtacttcagaagccgtttcccttacttttgaggagagtaacagtttgctccaagtagtgtctcatttcagtgcaaagagctttgaaaacaatgatatgccataatataaacttggtgataatttattggtaagtgttttttcttagaaaaatagttcagtgtgtgggagactgaggcgggtggatcacgaggtcaggagatcaagaccatcctggctaacgcggtgaaaccccatctctactaaaaatacaaaaaaaattagccaggcgtggtggcgggaacctgtagtcccagctactcgggaggctgaggcaggagaatggcatgaaccctaggtggcggagcttgcagtcagccgaaattgggccactgccctccagcctgggtgacagtgcgagactccgtctcaaaaaaaaaaaaagagaaaagaaaaatagttcagtgtatttcaccttgtttcatgcttatttctgtttcagacattataaagaggaaacgtaagttattgtaataacagataatctcatgattttctaagaaaagctctgtaacttctttttttaccactggtgttttgaaataagcgtcttttatatttatatatttacaacacagaagtaattgtggtttggtggaagagcactagaagtaaagtaagggaacctagggaaaatcctgcaacttgcatattttttgacctctcctttcagaattgtgatataaatgagttcagtgatacatgtacaagtgcttggtacaaggccaggtgcagcggctcacgcctgtaatcccagcactttgggaggccgaggtgggtggatcacttgagcccaggagttccagaccagcctgggcagcatggcgaaaccccatctctacaaaaagtacaaatacatttagctgcgtgtgggggtgtgtgcctctagttcagctacccaggaggccgaagtgggaggatcacctgagcccgggaggccaaggctacagtgagtcttgattgcgtcactgccctctaacctgagtgatggagtggagaccctatctcgaaaaaaaaaaaaagcctaatataatgcttagatttagcatttatgaataaatgtaattcttatataaccgatgagaaaaatgttagaaaaataaatagctatagaatattctcaggaaaaaaagaacttcaagaacgttggaacatttcctctgtccagatatatgcaaagctacagcttttactatagggtggtgtataggttagatgtcagagtgtaaagccaattttttaatgtagtcaaatttattagtctttaatgcctttgagtttgttgtaatttggagaccgtcttttccaattctgagatgcttaaaaattctctagttatttatgttctacattcatggattcattgtcttcaaataaacttatgaagttttgggaatttatgctctatgaggtttgaagtttcgatagaatatttttttccagttggatatccacttatggcaatcttttcattgtatacatgtataggttatttaatttcagagaaaatcataatctgtcattttattgagtgctactgaatgtttcctttcttacttagatttctcataggcatcagaaagaaaaggatctctttcatgaaaattgcatgttgcaggaagaaattgccttgctgagactggaaatagatacaataaaaaatcagaacaagcaaaaggaaaagaaatattttgaggacattgaggttgtgaaagaaaagaatgataaccttcaaaaaattataaaacgaaatgaggaaacattaacagaaacaatactccagtacagtggacagctgaacaatctgacagctgagaacaaaatgctcaattctgaactggagaatgggaaagagaaccaagaaagactagaaatagaaatggaatcataccgttgtagactggctgctgctgtacatgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaagcaaactgaagaaatacattgccaagcaggaatctgtagaggagagattatctcaactacaaagtgaaaatatgttgcttcgacagcaactggatgatgttcacaagaaagctaacagtcaagaaaagacaatcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaagtaagtattaagaaagataaaatatttttcaaccttcctgaaagaaaatgtaaagtaatatttggttatggctaaatgttgtatctagttgaatataaaatgtatagatcataaatgtatttgctgtatcagcctagaaatgtaccagtgaaaaagaagttaaacctgaaagatgctttactttgcataaagaaattgtgtcacctatgaaattttaagttcagttacagtgttaataggtacagactaatactcatgatgtagtcttatgctgctgaaatgatcattgcaatgcctttatgtggccatgttttaataccatgatgaagcagataaacagaaatgctcatacctgacatgagtattttgaaattaagattcagtggggagggttgctttgaccgttaattccagatttcccaggtgaactgaagtatactgctgtatctcataatacttttccttcagtaattttgtaatgtatttaagttggtataattttatttttattcatatcaatttgacttaaatctgagacgatttcagtctcaaattacttgttatgaccgctcaattctttaaaggcatttactttttttttttttttttttttttttgagatggaatcttgctctgtaagttttgtatttttagtagagacggagttttgccatgttggcaaggctggtctggaactcctgacctcaggtgatccgcccgccttggcctcccaaagtgctgggattagaggcgtgagccactgtgcccggcctaaaggcatttactttttattaaatcataatttgggacagatgtgaatttcagcaaagccatgttacatttaatcttaccactggtatttatcatttactttgaatgtttttacaaagaatttgctcataattttcatttcaaggctcactgcctatcattcggatataactgatagtacaaaggtaactgtggctatctgtgatttatttgtttggcattgagtcccattttcaaactaatcagaagtggcaggattcacatatagcaggaatggactgaatcggtgagacagttgtaggagctgagatcaggagggaggtagaggccaggttacctagggcctcaaaggccattggaattttacttgtattgtgagatagaaatcttttagaaggatctgagcaggcaattgaatatgcaaggaactctgaggttgatttgagcttctaataaaaaacagagaaaacattttaccagtgtgggatgtaccaccagcagccccacccacgtatcaaattctttttgagacttcagtaggttgttaagcactgcagatgtttcagggaagagtgagtagtgggctgaatctattgcctaagttaacagaaaaccgatttggcaggaagataacaccttctttgtccttaactaaattcagtaataaacaagaatgtgtgcacatgaggaaaagaaggcgaatcatatatgtgttgatgtttttcaaagtatatgagttagagttaaatcttactaccataatttaataataaggtgatttataaatcagtaacaaaaaataccttcacaggtagttatgagagaattccagcaagaatggaccgatctcctaaaacaacaacctacgtcagaggctacctcacgttgtcacattaatttagatgagacacaggattcaaagaagaaattgggtcaaatcagaagtgaagtatgtatgaaacataacatgtcaacagttaatctataggtggtgaaataatgtcagatgttttaggatactgattgcagtggatagctttcttttgtatttttattataattcattttattacaatttaattatctttataatacacttgtttcttaccatctggctttcattctgtccttttctcctcataagtacattttaaaaataaggatcatttccaaagatccttaggaaaattgggaattattcagtattcctcacagaagttgagaggctttttttttttcctgtgaagtagtatttttttagtgatttctctattgccatggtgaggcaagccagattaaattataggataatgtttaatagaatgttccagaaaattgtcttatttcttatctttacttttgtgaatgggtacagaatctgtgtatatttatttcatgaatttcaggataactggtacagaaaggccatagtactgttctccaaaatgcaaatgttttaatttacaaactacttgaaatgttaggtacttcctttattttcctttcattttaaatatattgtgcttttttacaaatcatgtatagtatgtacatccaaagtagagaattaagagatatatctagattctaccactgaatttttaaaaacaagtttactgagagagaattctcataccatacagtttacccattgaacgtgtacaattcatggtctcttaatatattcacagagttgcataaccatcaccatcatcaattgtaggacattttcatgaccctgaaaagaatcagcaatctattttgtttccatagattagcccattctggacaccacgtatcaattggatcacacaatgtgtggtggtcttttgtgactggcttcttctacttagcataacatttttaaggttcattgtgttgtaacatgtatcagtatttaatttcatcttattgctgagtaattttccactgtatggacataccactaatttatttagccattcatcagttgatggacctttgggttgtttccatgttttggctattattaatcatgctgctgtgaacttttatttacaagtttttgtgtttgtatatgtattcctttctcttgggtatatacatatgagttgaatttctgggtcatatggtaacactatgcttaacattttgaggagcttccagtctgctttccaaagtggttgcaccattttacattcccatcagcattgtatgagggttctaatttctccacatccttgccaacatttttcatatttttgattgaaaaaggattccaacctagaggtatgaagtggtacctcattgtggttttgattcacatttccctaatgatgaatgactttaagcctctttttatgtgcttatgagccacttgtatatcttctctggagaaatatctgttcaaatcttttgcccacattaaaattgggttgtcctaaatttctgaattttaagagttctttatataccctaggtgtaagtcccttatcagatatgtttccaaatattttcaatggctttcctttttattttcttttttatgatttattatgtttttaaaatttatataattttaaattgtagagagaaggtctcactatgttgtccaggctggttttgaactcctgagctcaagcaatcctcccacctcggcctcccaagtgttgggattataggtgtaagccaccatgcccagcctccttttcactttcttgatggtctctgttcaagcacagaagtttcacattttgatgaagtccagttaattttttgtttgtttgttttgcagtcacaaagatttatggctatgttttcttctaggaattttatagttttagttcttacatttagcggttctattttgttacttttagatatgacatttggtgaagtccacctttattcttttgcatgtggatataccgttttcccagaaccatttgttgaaaaatctattcatttctcatttaattttttttacacctttgttgaaaatcagttgaccataaaagtgtgggtttgtttttggattctcagttctaatatattgagctatgtctatccttatgccagtagcaaatcacattttaggaaaattcattttcagtcctgttgcttattaccagttgtcttatgtaagaatagaaattcaagtagtagaatgtctttaatttcactttttgcttcttgaaggagtgtatggccagcttatgccttgctgactccatgacatgatgagagtcaggcttatgaagacagatcccattaattttttttctccagtcataccttttgtctctcacccagtgcctctctcttcattcccatttccatcaaatcttggtcacaggatatgctgactccgtctactatttactgcattatgtttttattaactcattgtaagtcatagagtcatgtgtagattttaactatctatgaagggcaagattaagtctaggctgtcatctttcctcattggaaattgagctaattcatcatgttgcagtttacagttagatactcttttgacccagcacccggttctcttgtacactcccggagctgaatcctcttcttggcacagatactacattctcagaaaccagagttccctgcatttacctccttttgcttaaatagagatgcatagctatgcttttatagttcaatacataattcattgaataaatacttcaacccattcaaagaacaacttccaggagtgcagcaactggaaatcaggtcatgtccaggcatttatcagaaacaaatggttgaattagttgtatgaatttcaaaatttcagagccaatttgtatgatatggagaagcattttgatacaacataaagatgagatgctcttcccttctccatacaaatgagcttgaagtaaggtaaaggggaaattgcatttaatagcttaacactcaaaggacactacatttttacttctgagattgttaaaactgattccataatattttgttaattttctcagtgaggtaatggaaatgaagattgaatcctagattgactaataaatatccaaagctgcttatcacttttagaatttcagttcattgaaatcaggtacaatgtctgatttttggttattaatcaaatatttctggttttttcaactttatacttcaaattatatatctccttcgttcttcatcttccttatttcataactcgggggacaaattctaaaagcctcactggcttagtcatcagaatttgtaatcgaaaggaactttttctaaacttcctctgcagtagttcttacatccttctcctggttgtctgctgcttcccattagagttgtttgtcattaataaattaacctcaacattttttagatcttactttaaaggagactaatttctactgggtatgttattctatttcttgttgtctccttgtttaaatttatttttctggttattttttcctaacaaattacccaaagttgagtggctaagaacaacattcgtttagttcaccaatctgtggcttgggaaaaccttggctgggacagcttgcctctgctcccttcagcttcacttgggataaatcaaaggctgagggactggaatcatctgaaggtttgttcactaagatgtctgttgctgatggtggctattggttggaactttagctggggcaggttgcccaaatatctacattggaactcctaggctctctttgtggcctaagcttcctcacaacatgggggctggggtccaagggtgagcagtctgcggtagagagcctcttctaacttaatgttcgaagccacatggttatcacttttaacactttctgttcattagaagcaagtcactaagtttcacctatagtctatatataggatgaatgattttgcttttatttttattgatgtattttttttttagacatggtgtcttattatgttacccaggccggccttgacctccatgtctcaagaattcttcctgcctctgcctcccaagtagctgagaccacaggaatgtgacaccacacctggcttcctttgattttttgtggacctgtataattgtacatatttatggtatacacagtgatattttgatatgtgtaaacaatgtataatggtcaaatcaggctaattaatatattccatcacctcaaacatttaccatttctttgtgttgtgaactttcaaaatcctctcctctagctttttaaatattagctagccaagccaggtgtagtggcacacacctgtaatcccagctgtttgggaggctgaggcaggagaatggcttgaaccccggaggcggagattgcagtgagctgagattgcaccactgcacgccaagcctgggtgacagagcaagactctgtctcaaaaaaaaaaaaatattagttaaccatattcaccctacaatgcaacagaacactagaattcattcctcctatgtaactgtaatcttgtatccattaaccagcctctccccatcttctactcccctttacctttctcagcctctaatacccacagttctactctctacttccgtgaacgtttttttaaattttagctcccacatgagtgaaaacatacagtagttatttttctgtgcttgaattatttcacttagtgtcacttaatggcctcatccatgctgtaaatgatatgattttattctttttttatggctgaatagtattccactgtggacatataccacattttctttactcatcaaccacattgatctgttgatgaacatttaggttgattctgtatcttggttgttgtgaatagtgctgcaatcaacatgggaatactggtatccctttgatacgctgattttctttcttttggataaatacttagtagtgggattgttggatcatatgacacttctatttttagctttttaagaaacttccatggttatactagtttacattccctccacgagcataagagttttctttttctctccaacctcgccaggattttttacttctggtttctttgttttttgttttttgatttttttgatagtagccattctgtggtgagacgatatcttatttgggattttgttttcattttcctgttagtgatgttgagtacttttccatacatttgtggacattcgtatgtcttctttttagaaatgtctatttaaattctttctccacatttcaggggggattattaacaatttttactgttgagttgtttgagttcctggcatattctagatattagacctttctcagatgaatagatttgtaaatattttctcccagtctacaattgttggttgtttccttcactttgttgattgtttcctttgctgtgaagaaacctaattttaatatagctttacttatgtatttttgtttttatacctgtgcttttttttgcatatgcccgtgataacttagctataaaatctttgccttgaccaatgtcctgaagcattttccatatattttcttgtagtagttttataattttggatctcatgtttaagtctttaatctattttgagttgatttttgtatatggtgaaagatagggacctggtttcattcttctttttacagatacccacttttcccagccccatttgttgaagagagggttctttccccaatgtatgtttttgatacttttgttgaaaatcaggtgtctgtaaatatgtggatttatttctgcattctctgttccattggtttaattttctatttttataccaagaccttgttcttttggttactgtaaccttgtaatatattttgaagtcaggtggagtgatgcctccagctctgttcttttccctcaggcttggcttgtatagtctagcttttttgcagttccatatgaattttaggattgttttttccatttctgtgaagagggttattggtgtttttttgttgcaagttataaagggcattttatttttatcttattctttctctttcttaactttcagattcagggagtacatgtgcaggtttgttacacaggtatattgcataatgcttaggtttagggtgcagttgaacctatcacccaggtaatgagcatagtacctggcatgtcatttttcaatcattgtccaacccagtcccccttcttatagtccccactgtctattgctcccatctttatgtccatgtgtacccagtgtttagctcccacttataagtgagaacatgtagtatttggttttctgtttctgcatcagtttgcttaggataatggcctccagctgcatccatgttgctgcaaagggcagtattttgttctttttatagttgcatagtattccatattgtatatgtgctacattttcttaatccagtgcatcattgatgagcttctggttttattccatatctttgctattgtgaatagtgctgcagtgaacattgggtgcatgtgtctttttggtagaatgattttttggtggtgggaagtggatatttaaccaactaatgggattgctgggttgaatggcagttctacttttagttccgtgagagaaacctccaaactgctttccacagtggctgaacgaatttaccattttctcccaaaagtgtattagaattccctttttgctgtagcagctctgccaaaatctgggttgttgttgcttattttttgactttttagtaatagccattatgtctggtgtgagatggtatgtcattgtggctttgatttgcttttctctgatgatcagtgatgatgagcattttttcatatgtttgctctccacttttatgtctttttttgagaagtgtctgttaatgtattttgcccgcttttatatatttttttaaattcttgtttgttgatttaagttccttataggttctggatattagaactttgttcaatgcatagcttgtaaatacattctttcattatttaggttgcctatttagtctcttgaatggttccttttcctatgcagaagctcctttgtttaactaggtcccaatttttcttttcttttttttttttctttaacaaaatttttatttaataaatggttaaaatcgcagtgccaaaaatacattcacatttagcaatttcactgaaaggaagaaactacagaatgcacggtttcagaaagctattttaagttatttacaaataaagtatctaaaactcaaaaacaggctctatatgctatatctcgtttatcccttcccgaacaaaatttctgttatttgggcaaattcttaaaccatggtttaaaccgtaatggttacaaaccacaaacacatccatccaaagactgaaaccgtttttatccggtcagtggcaaaactgttgaaagggcaatagttgaagctgttgggttttatatagtgtgaactctgataaatattcctaccaggactaaaacacagcacactttgcaggcatggctgactcacaaaggttgtaacaaacaagaactactcttcactcgacaccatggctcagaggccaacgagaagcacgagtgactgacagctcctctgcttacaaacgaatgaaacccaaagtggatgtcgttctcacagcactgaaagtgcttcaggactcacactgatccaatactaactttcttccctattttacacatatttttctactgtccagtggaaatcattttctgttttggctaaacaacaaatactagtttataacaggaatggtaaaatctgtgagaattctgctcaatttaatacaagatcactactttctttagaatggtttctgcgtgtttctatgtcaccctctgtagttttagcttccagtttcctggtaaggaataagttctccttcccagtcacactcggggtcatttacacgtttctgggatgccctcgctcgtccatggaggccaggtgcgtgcagtgactcactctgcctcttccctcttctcaggaccagttcccgaaccttctgccttgcagatcctcctgtttccgccacactctagcgctcggaagtgagctcctggatcatacagctgcaaggctggccggtccttgtttgccagtcgctcttttctgggtgctggactgtcgtcacacctctgcgctcttcccagtctctccatggcctcccccggagccccgctgtcctggctccccttcttccctctgtcttggccaggtcctttcccccatctctgctcatcctcactccctctggaaagccggtcaggctcgtggtgagctctgtgcctcctgccatcatccacatggtgtctttgtgcttcagattcttgttcttgagatctctccacatccctgtgctctttatcactgccgctgtgtgacgtctcctggggctcctccagcgagccttccacgggcctggcttttacgactgcaccgggggcacaggattcctgcttgccacctccagtatcaatctcctctcctctttcttttggtttctctgtggttggttcctctcccttttctggtttcttaagaagcttaatccttacttctttctctgcaattttcttctgtttatctgtctctctttttttttttgcatctttcttcttctcttcttcttcttttttcctcttcccgcaaacgtttcttttctaactctctcctcctccgttcttctcgcttctcttctcgaattctctgcttttctaattttctatttttaatatattccaaaagaggtgtggttcttctagcaatgagctctcttgtcttcgcctccatctcccccagcagagtctcagggttggcactggccttctcttcctccacacagtaggtttctaaaaacttcttatattctggatctttgctgtcaaggaagatatatcccatcaaaacgatctctaaaaagaaggatgtcatcaggattcctaaaattaatgtatgctcttgagtagagatgaggataaagactcaggtcggcggcgaagaactcgaagtagtcgtgtgctggcaacgggcgcagctgctcctccagctgctccttggtgaggcccggaggcaggcggcggatgaccagctgcggggagcgcggccgttcccacaggggcggagcgtggacaaggagctcaaaaggcaccgcgtaccgcgctgggaggcccggcccccgcccctccctcctctccctcccctccctcccctctaggtcccaatttttcattttgacttttgttgcaattgcttttgagggcttattcataaattattttcagaggctgatttctaatagtgtatttcttaggttttcttgtaggatttttatagttagaggtcttacttttaagaatgtaattcagctttcattaatttttgtatgtggtgatagctaggggtcaagtttcattcttctgtgtatggataaccagtcatcccagcaccatttattgaatagggagtcctttccccattgcatatttgtgtcggctttgtcaaagacccaatggttgtaggcgtgtggctttatttctgggctctctgttctgttccattggtctatgtgtctgtttttgtgccagtaccgtgctgatttgtttagtgtagcgtttgtttactgtagtatagtttgaagttgggtaatgtgatgcatcaggcttggttctctttgcttaggatggctctgggtgtttgggctcttttctggttccatatgaagttttagaatagttatttctaatgctgtgaaaaatgacattagtagtttgataggaatggtattgaatctgtagactgctttgggcagtatggccattttaatgcgattgatttttccaattcatgagcatggaatgttttgccattttttttggtgtcatctatttggtgtcatgattttttttcagcagtgttttgtagttctccttgtaaccacctttcatctctgtagttagatgcattcctaagtattttgcttttttgtgtgtggctattataaattggattacattcttgatttgtctctcagcttgaactttattggtatatagaaatgctatggatatttttacattgatttttgtgtcctgactgaagtcatttatcagttccaggataaattggcaaactctttagagttttttaggtacagaatcatatcatcagcaaagagagatagtttggcttcttttcctttttggatgccttttctttctttctttttcctgattgctctggctaggagttccagtactatgttgaatacatacagtgagagtgggcatctttgtcttgttccagttggcaaggggaatgcttccaactatttttgttcttttttctttaatttttttctttactattttatagagacaaggtctcactgtgttgcccagcctggtctcagactcctggcctcaagtgattctcctgtcttcgcctcccaacatgctggggttacaagcatgagccactgcacttagcccccacttccagcttttgcccattctgtatggttttagctgtgggtttgttatagagtggcctttattattttgaggtctgtttctttgatgcctaatttgttgggtgtttttttcatgaagggatgatggacgttattgaaagcttttttgcatcttttgagttgatcatatggtttttcgttttcattctgtttatgtggtgaaacacatttattgatttgtgtactttgaaccaattgcatcacaaaaataaagctgacttgattgtggtgaagtaagtttttgatgtgtttgctggattttgtttgctgatattttattgaggactttggtgtctacattcattggggatattgggctgtagttttctttattcattgtgtctttgctggcttttagtatcaagatgatgctggcatcatacaatgagttagggagaagtatctcctcaatattttggaatagtttcattaggtttgttaacagctcttctttgtatgtctggtagaaattggctatgagtcagtctgatctgaatctgtttttggctagttggttttttattactgattcaatttcagagcttgttatttgtctgttcatgatttcaatttcctcgtggttcaatctttgttggtttccaaggatttatccatttctcctagatattctagtttgtgtgtatacagtggtgttcattgtagtctctgaggatcttttgtattactgtgggattggttgtaatgtcatctttgttgtttctgattgtgcttatttagatgttctctgttatttatttatttatttatttatttatctagctagtagcctgtcggtatttttatcccttcaaaaagccaacttttggtttcaccgatcctttgtatggatttttgggcctcaagttttctcagttatgctctaattttagttatttcttttctgttgccagctttggggttattttgtccttgttttttagttcctctcggcacagtgtcagattgttaattacagatctgtctaacttttcaacatatttgttttgcactataagctttcctcttatgctgcttttgctgtatcccagaagttttggtatgatgtttctttttgcttattacaaatcattgtttgatttctgcctgaaattctttcttttcccaaagtcatttaggagccagttgtttgatttccatgtgattgtgtggttttcagagatcttcttggtattcatttctatttttattgcactgtagtccaagagaatggtgttgtgtgatttcattttttaaaaatttatcatgacttgctttatggtcaaacatgttgttgatcttggagtatgttctttgtgcagatgagaaaaaagtgtattctgtagttgttgggtggagtattctgtagatgtctgttaggtccaattagtcaagtgttaaatttaagcccagaatttctttgttagttttttgtctcaatgatttgccttaacactatcaatgaaatgttgaagatccccactgttattgtgtgactgagtcttttggtaggtctggaagtacttggttgtttttgaatgtgggtgctccagtgttgggtgggtatgtatttaggatagggatgtcttcttggcgaagtgagtcctttatcattgtgtaatgcccttcttcatccttttttggctgttgttggtttaaagtctgttttatctaagaataacaaccccttgctttttgcattttatttgcatgacagatctttgtctatctctttactcagagcctgtgggtgccattacatgtgagatgtgtcttttgaatatagcagactgttgattcttattggtttgtttttttttaattcaacttgccactctgtgccttttaagtgaggcatttagaccattgaattcagtattaatatttatatgtgagattttgattccgccatgatgtttttagctgtttgctttgtactctcgattgtgtagttgtgtaatagggtctgtgggctatgtacttaggtgtgtttttgtggtagtgggtattgttctttcttttccatatttagaactccttaagaatctcttgtaagtctggtctagcggtaatgaatttctttagtgtttgtctggaaaagattgtatttctctgtcactgatgaggcttagattggagtggtatgaagttcttggctgaaatttctttaaggatgctgacaacaggccccactttctggcttataaggttttgccggaaagaggtcagcttttcacctgatgcagctgttatagctgcctgtgagatttttcctttcgtgttgaccttggaaagtctgatgggctgtgtatcttggggatggttgtagaggttctctgaatttcttgaatttttccatcaacctctgtaatgagattggggaaatttcatggactatatcctcagatatgttttccatgttgcttcctctctctccttctctttcagccatgccaatgagtcatagattagtgtctttacaaaatcccacattcctcagatgttttgttcatttttaaaatggttttttctttatttttgtctgactgggctgactcaaaagacaggtctttgagctctgtaatccttccctccgcttggtctcatctggttttgaagctccctcctgtgttgaattttgcagctccagaagttcagtttgattctttttaaaaatggctctgtcgtgtttcaacttttggatggttatactggcttccttggattggatttcaactttctctttaatctcattgagctttgttgccattgagattctgaatcacatgtctgtgataaagcatgtcattacactttaatctggtgagaatttatagctggggagctagtgtgattttttggaggtaatgaaatgctctgatttgttgaattgctagagttcttgtgctgattattcctcctctgaaaatgctgatgtttctttatcgttttgaaattcctgtcatttggatgggaatttttgtttttatgttcttttttttctcttgagggtttgtggtgtgtattgtgtatagttgattggcctttttttctgggtggtttcagatggccaggactctacacaggttccttccttgtggctacttccctgcattgggtttcacagatgtgtgttgaaggtatatcatgatttttgtttggtggtgtaattcagtctgcaatccaggagatggtgctctagagtacgggctggcatgcctcttttctgtttcagcgtgttggcagcagtgctctggggaagggggagaagtaggattgggaaggcgagagataaccccctcaccaaatcagttcctggaacttgggagagccccctccaatcactgatgccacacctgaattttgagggctgcacacctcccacccttagggcagcggcccaagccaaaagttaggttgccgagagacctacaactctctggggacgtgctggttgtctgggcttggtagagtcagagcaggttgtagagtatgtctgcggatctgcgggtcgtctgttgatataatgtgggtcaaggggggaggatccccgggcagggctgtggttctgtgggtgtgcacctggtgtgatgcgtgcagcccagggttttttgcccagcagatggctgtggggagcacttagctggcactcacccaaccaggcctccctccagtgtctgcccccagggcaggcccaactaggtagttttgtcccccagccttccgtgcccagatcaactggactgttagctgtttcaggcagtggtgctccctcaggcagaggctgtggacagacaggttacacccttcctggacagatcttgtagaacagggtccccaacctccaggtggcagaccagtactggtctgtggcctgttaggaactgggccgcacagcaggaggtgaggggagggctggtgagtgagcattaccacgtgagcttcgcctcttgtcacatcagcagcggcattagattctcataggagcgcgagccgtgttgtgaactgtgcacgtgagggacctaggttgcgtgctccttatgagaatctaatgcctgacgatctgaggtggaacagttccatcgcgaaaccatccccaccccaccgtctgtggaaaaattgttttccacaatgccagcacctggtgccaaaaaggttggggactgctgttgcagagggagcacacccggctcccacactggcatatgaacttgggccctctcttctcggcattgtgagagagaaagctactcctcttcttgagctcaggccacagataccagctcagtatacttgagcagtgtgcttgaatcctgggggtattgagaccaggttcatgactttgtcttctggtctcatggggttgagctttggctgtgctgagggtgggggctgaactgctcccaggcctccggcaaagcactcagatggggcagtggaggctgtgctgtgtgcttacccttgcgtgagtagctaggcaggggccttgggaggggctggtggacaagaaggtacacagaccagatatgctgcagtcccatggtaaatgcagccctactgtcttctggcctggcagtaagcaggagctagagtcactcagagcaagatggagagccttgggggatgggtgcctatggtcatgttttgctgcagccgtaccaggtgcgaaaccttctgggctgtatgcgggtttgagctctgcctctgcctattcgccagccggttcctcttgccagttcagatgtctgtgtgggtccagggatctccgggagctagtatcccagagttcgttggtgggagtgtggtgctgcacagttccttcacccaccccttccttagtttctggattgggaggtaatcctagtgcttggtgactctgtgcaggcttcccagatttattcctcttcagccttgatgcctgcattacctatcaaatttcagtgttttctctccaaagacctactccaagtgtgataatttacttgatattttggtttctctctcgcagagaggcatttcctggctgcatgtggtgaccatcttgtcttcccctaaaaacatcaaaattggtatttaatagagcttgcgttcagtctgtagactgctttcagtaataaggtcatttaaccaatattcttccagtccgtgagcatgcaatatctttccatgtttgtgtcctctacaatttcttttgtcggtgttttgtagttttttttttttttttttgtaaagctctttacaaaatctctctggttaactttattctgagccattttattattttgtagctagaatagtgggacggccttcttgatgtctttttatgctagttgattattagtgtatagaaatgttacacatgctattggcattatttttgtatgctgattttgtggcctgcacctttgctgaattctttagttctaacaggcttttttggtggcgtgtttatggttttctgtatatgagatcaggtcatgtgcacagggagacaatttgactttctgttttccaatctggatcccctttatttctctgacaatttttgtatctgcatccttcagggatattggcatgtagttttcttttgttgttgtgtctttgtctgggtttggccttagagtaatactgacctttagaataaactaggaagattttggaataatttataaaaaattgctgttagtttttccttaaaagtttagtagaattcagagtaacttacccagttttagacctttctttgttggtaaactttattactgattcaattacattaccgttattggtctgtccaggtttccttttcttcttggttcattcttgctggttatgcacttccaggaatgtatccattttccatacgtttccagtttgttggcatatagttgttcataatagtctctcatgactccatgtatttctttgctatctccttttatgtttccctctttatttacttgagttttctcttttttcttgttaatgtagtttgcagttttgctttattagtctacctcgttcagttctgccctgcctttatcatttctttccttctactacatttgagttttgggtctgttcttgcttttttggtttcttcaggtgtattgttaggttgtttatttgaagtctttctcttttttggatgtagctgttaattgctataaattgccctcttagtgcttcttttgtcactttctatagggattgattttttttccccattttcatttgtttcaagatattttaaattttttttcttaatttattgattggcccagttgttcattcaggagcatgctgtttaatttccatgcatttgtacagtttacaaagtttttgtcgttactgatttccatttttattccattgtggtttgagaagatatttgatatgagcttttaaactcaatatatggtctattctggagaatgttctatgtgctaatgagaagaatgtgtattctgcagcttcttaatacagtgttctgtaagtgtctgctaggtccatgtggtctatagtgcaggttcattttgatgtttctttgttgattttctgtttagatgatcccttcaatgctgaaagtcagactatggagtccccatctattattgtactggaggctatctgtctctttagtttcagtgatgtttgccttatatatctgtgtgctcaggtattgagtatatatacctttatgactgctgtatcctcttgctgaattgatcctgttattattatataatgcccttctctttctcttttatttatttttttttttttttacttaagatctattttgtctgatataaatatagctacttctgtgtgcttttggtttccatttgcatggaatatccttccttcctttcacttgcagtctatgtgtctttacaggtaaagtgagtttcttgtagacagcatattatttggtctttttttgtaatccattcattctatctatatctttaattggggaatttaaatcatgtatattcaaagtttttatgataggtgaggacttactcctttcattttattaattgtttagtgattgttttgtctatcatttgttcctatcttcctcttttattgtttacctctacaatttgctggttttctgtagtgataatgtttgattcctttctctttttcagttctgtacctgctctaccagtgagtcttacagttttttgattttcatggtggtagacattgtctttttgcttccagattgaggactcctgtaagcatttcttgtaggatcagtctagtggtgatgcattccttcaggttttgcttgtctgagatgttatttctttttcagttttatttatttattggagacagagtctcactctgttgccctggctggagttcagtggcatgatctcagcttactgcaacctctgcctcccaggttcaagcaattcttgtgcctcagcctcctgagtagctgggactacaggcatgagccaccatgcctagctaatttgtatatttttcgtagagacagggttttgccaaattgcccaggctggtcttgaactcctgagctcaagcaatcccccaaccttggcctcccaaagtgctaggattacagggatgaaccactgcacctggcccctctttttcagttttaaaggatagctttgctaggtataatattcttgacaggcagtctttttcttcccgcatattaaatatatcatgtcattctctcctatcctctaaggtttctgctgacaaatatgctatttgatatggattcccttgtatgtgacttggtgtttttctcttgctctttgtctttgacttttgacatttgactctgatgtgccgcagagaagacattttttattgtatttctttggggatctttgagacatctgtatccagatgtttgcatctctcacaagacttggtagtttttcagctattatttcattagataggttttctgtgccttttcccatctcttctatttctgcaactcccaatatccgaaaaaattttggctcatgatggtccatatattacatacactgtcttcattctttttcttttcttttttttctttttgctttttgtttgcctggcctcatataaagacctctcttcaagttcagaaattcattcttctccttgatctagtctattgccaacattctcagttgtttttattttatgtattgaattctcagttccaggatttctgtttggttccttttaatgctatctttttcattgttgaatttcttatttagatcataaattgttttcctgattcatttgtattacctatctttcctatcaggaatctttcctgattcctttgtattattgtgtatctcactatgtttccttaagatcattattttgaattttataggttttgttttctttgggatctgttactggagaattactctgttcctttggaggtgtcatgtttctttgatttttcatacttcttgtgtccttaatgttgataactgtgcagctggtataacagtcacttcatctagttttaggggttgacttttttctgtagatgtatctatgttgttggttgaatatggtgctctggcattgatgatgggtgggtgcattggtgtggtctccatatacttatgctttcttctgctgtaatcaacatcagcgtctgtaagttcctcagtggcttacggtgtggttgttagtagcaggggatgctgtggtgaggccttgatggtgatggggaggacagcaggccggtcctcaggcacattgatggcatacacaaggatgtatgtgtgattggcagcaccaggccatgcttcccagtttttgtggcagtgggttacctgagtgggctggcccttgggcctccaggtggtgtgtgctgggatcagaggtggcaatagcaggccaggccacaggaccttggtgacacttgtggcactggagatgacagtagcagctgggggccggaccttggatcccttggtagcatgcatgggcactggtagtggtgaaagcaggctgcatgggcatttctctggccccctatgaggaacatttaggtgggtacctaaggcagtgtgtggagcaggcttgtccacaggttaactgaagacacgtgcaggaacctttgccagtggctggtgaggcagccctgtctttatgctcctggatgccatgtgcaggtgccggtggggcagtaggactctccttggtattagtggtagacggggcctgggtaaaggcacagaggcctgggtggggtggactgctcctcagggtcctggacagtgtatgtgagcactgatagcaacaatagcagcagcaagcaaagtggccttgtcttcaggctctcatatggctcacatgggcgccacccctggtgggtttgacaggcttgttctcaggctcctgcatggtacactcgagtgggccagtcctccggcctcctaaaggtatgtacaggtatgcacagcactgcccctgaaggggatagggctgctggtggtggcagtggtgtcagtcaggtggctcctaggctctagacagcacatacttaggatccctttgacctagagtagtttccctggtgggctattaggtgaccacctatttccacaggtatatggtgctgtgggactagggatttgggggaatcagtcctagttttgagatgatcctggctgggctggctacctcagttccctttcctcctgtcatcagaggatccctatcaatttcctgctgaattccagtatactctctttgatgttttcctcaaggtgtggttacctacttgctgttttggtttttctttttgaaagaggtgagtgctgggtattcccagtcagccatctcgatgatgtctctgtctatgctgtgcatattaaggaatgtatagacatgttttaaaacctgcacaactgaccctataactataatttaaaagatttctaccacttgaaaaacacactaatttctaattattacctctcaccccacacacaggttttatttaatatggcagcagactcaggcttaaagtgcaagatcctaacctcccaccacacacacacaagtttcatttaatatggcagcaagctcaggcttgaagtgcaagaccctaccatctttatcacagatggtagggatgcaccctgggttgtggtttctgcggtataaccccttgagtgcatttcttgtcaacacaaagacgtaagaactaaagggacaacttgtctaccactcacccacccagcattctcctaaactgccagagaccctcctattgaacagagagaaaatgggagtcacaaagggaatattagaccatagaaattctgaaatacagcctgatgtgtgcttccacttacttgatttggacttcatgggaaccatcctctgtggctttttgtgataccttcttggctctttgttgtatccttttcataagcaatgacctgtgttttcagctaagtagtttcttcagccagcttcctccctgtagaacctcttaggtcctaaggcctctcttcatttttactgtcttgttgtcttttaagccaagctagcaagcagtgctattgttactataattctcttagagtctcttgtgaattttacttgagttcttgtcattggaaaaaccacttgtcccaatctctttgagataagcacttcaccttgtgcttcctgtgaaggaagcacactgttctgtgtagtaggacagtgccttaagatgcttatacccttaagatctttaagggaatttgaggcaccaccttaaatctttctaaggtcttaaaatagggccttacactgacagtcttggcttcaccttcagactttctcctggcggcaccctggatttgatcttatctcagaggccatttatttcagcaatacagatgctcctcagattaggatgggtttatgtctggatggcatttgcatttgttatgtctgatatttgcaatttataggccatcataaattgcaaatatcagaagttatgggtgggttttccatttacgataatttccacttacagtgactttatcctgatgtaaccacccctgtaagccaaaaggcttacacatatcatttcattactcaacacatatcattttcacagtattataaaaagtcagaaaatggtgagtcgaaccatgctaagtcaaggactgtctatatttgggaatctgacatgtggagaggctataaaaaggatactgaacctagaaagtcctggttcttttatatgtagtagtctttctttagcttatctcttgcattggttttactttcagcggctgtgtagtaacagtgccctttccttcaggttcccgtatcgtcttcttcactatccttgaagcccttcctaccagcttcttcgaggaccatcaggcttccactaacagtctctttaaaactcttcttgtttttgtgcttattcttctgtaggtccttttagcttctgattagctcctggtccaatggtagtcctacatgttttagtagtttttgttgtgttgttgttgtgcaatctatatgtagtgtcaatatctgtatcagttatttcttggtatataagaaaatgcagtgtctcaaaacaacatctattttgttcacaatctgcagttttaggcaaggctcagtgggtccaactcactttctctttacttggcatcagctgaggtgacttaaagctggggactagaatcatctaaaggcttgtttatttacctgtgcggcattcgaagctggcttttggctgggacgttaggtagggaagtcagctcgaacacctacctacatgagggttcacggtgtggtttgggctttctcacggcatgttggctgcattttaaggacaagcgtccctagagagagagtcaggtagaagctgtgtgactttttgtaaccaactttagaagtcacacagcagttctgccacattgtgttccggagaagccggttgtcaatgccagcttgtattcaggagagggaatgtcatgggagaagtggcaagcaatttgtagatgttttaaaaccaccacttcacttacctttataaaataaaagacaatcataattatttcctctaaaggaaagcagttatttccaactcagcaccactgaaatttcagtgcaattttttgttgtcattctttaatgtgctcccttattttgtgtaaagtaacaatgaattacaagattgtgctactgaattaaggcatttttcttcagaaaaatggtatggatcatgccactgaacttttatactgggagatgtgattgcttcttaactccaagtatcattactctttgaaatgtaactcaaattagcgtaagacatttgcagttcagcaaaaggcttatggtattggaatcctttttttttttttttccaaaatgtattaattagagtcttattttcagagtcttattatgggagccatttattgactcaggcccaaataattcaatatgatgcccctaaaacttctctgcaaattatggagaatgatagtgggttaaaggaataagagactttgtgctaaaggggtaacttagagccattttaaggaggaaagccatgaaaccgtcataggaaaacagaagtctaagatcaagtccaaatgttgtgtggcaaagatgatgaaagtaaaggatgtatttttgtgaattctggtggttttaactttgtttttaattttctgagtaatccaagggtctgtattttatgaatctacaacagtataggtaacattttattgcaactgaatttatttcaaaaattattagttttggctgggcgcggtggctcacgtctgtaatctcagcactttgggaggccgaggcgagtggatcatgaggtcaggagatcgagaccatcctggctaacacggtgaaaccccatctactaaaaataaaaaataaataaataaaaaaatttagccaggggtggtggtgggcgcctgtagtcccagctactccagctacgcaggagaatggcctgaacccgggaggcagagcttgtagtgagccgagatcccgtcactgtactccagcctgggcgacagagcgagactccatctcaaaaaaaaaaaaaaaaaaaaaaatattagttttttgttagaccattctcagtctaccttcttcattaccaaactatattgttttactcatgcagattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtgaagctgaatggcataaactgttgattgaagaaagagcaaggaaggagatagaagaaaaattaaacgaagccattctcaccttgcaggttggtttatttatctgtaatgtgctttcattcatttcgctgcaaattttattttggatatatacattgtacatgttttctctactttccttacagcaatttgtttggtagacttctagaaggaaggtggtatttgtttctccatttaaatatttttgtttccatcattcttataactaaattgatcttccataagaataattctcactagagaatcatttaattactaaagccagttggcataaaacaagactaatagaaaaagtaaaaaaaaaaattgtgatttagaaattataccatactcttgaactgcttttaagttacgttgttccacttttaaaattttaacttggttctgtcattctttggagaattgttcaacaattcagattcagttattaattcagttggtactggtcataaatatgttaagcttgagcttctttctttcttcacatttttcttaaaattgttctctgaatcacgtacttaaaattgttctctgaatcactgactccaaacaaaaggaaacaaatacacagtaattattcaggttacaattacttttaaaatgttcccttttaatttattttagaaacaagcagcagtatctcatgaacagttagcacagttaagggaggataatactacttcaataaaaactcagatggaactcacagtcatagatctggaatctgaaatctccagaataaaaacttcgcaagccgactttaataaaaccaaattggaaagatataaggaactctacctagaagaagtgaaagttagagaatccttgtcaaatgaactcagtaggtaagtcaatatgcagaatcatagaaaataagttaagctcattaatttgccttcaaaagcatgacttttagtgagacaggttcatgagatttgtgggaagtgaaagctaactagatcatacaattttggaaaattgtaaattatatatagtaaatgaacttaacctttaagtaaaattgaaaatagtaaatgaacgtaacctttaaaatctttagtccaggacagttcctgtctctcctgttttttgggtttatgtggcttccccccaccccttaatattcttatatagttaacctgatctattagggtttcagctaaatatttatgaagcttcataatttagacagtgataccattataaaaattgcttgtcagtattcccttaattcaaaatactaatgaatttaattaatttctggaagacgacagctgaaaaccaaaagggtcaagtacgactactctggacacattctggcactcagtaaattcactttgcttgattgtgatcattagagggtgccttgagaagaagtgtcctgtatagtttttccaatccacataaaggcacacttgtgaagcagagaatgatcaactagggttgaagggaagtataacttactaagtgataaaaaataacaccttggtcagcctgagggggtatatggaagacagaaagggcaggccccacctctgatacatgggccgcagtgttaggagctgattgtcctccatgctgctttagttctctttgatttcagcagtcttattctccccaaggaaaagtcgccgtgaatgattcctcagtgccaaatgctcaagtttttccagataatgggtgaaatatacaagggtggtgaaaacaattgtttgaaaatgtctttgagagagagttttttagacaatctctaacaacatgtattgtttactaaatacaagtatttctagcttttatttttacttttagttttttcttgtatatatttaaggagtacaacttgatgttttgatatatttatacgcagtgaaatggttattttgtcaagcaaattaatatcttcatcatttcacatagttacccttggaatacaagtaattctaatggcatccttaagaatcgtataagtagagtcattccagatgggcaacaagtgttaactatgaagccatacatcattgatagtcttttctgtcccctccctctctttgaactacttgtttgttagaaatccctctagaaatagatgtacttctttagaacaatgttaaaactataattggatacagtaggcatgctctaacacattttcagagttaaaacacggcttatggtatattccatttactcttaatggcaacttttagaacaatcgaagtcatttaggaatcatttaggaaaaaatgaaatactaagcatttgtcttttgcaatcttcatagaactaatgagatgatagcagaggtcagtacacaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagtttagctatcttttttccttcggcgttcagatttctgatagaattcttgtatgttatttggtaaaatactcagttacttaattgtcttgtgtatggtaagtaaaagtaataattacctgtgttaataaagagaggagacagaaattttacagttattttcaagtctctggagctctcattcataagagattactcctttgttaactttatttaataaatgtaaccaaactgacacattttaaatttttttaaaaactgcatttaagttagattttaaccaaaggtttactttgatgtgctttgtcttactaattgattttagtttgtctggggttcacttttaatgggtttagtgtgcctggggtcacttttaaagtttttctgcatcatctcaggttttctacccgtcatcatatgtgaatgattggtgtccaaacactaaccacccatggatgtttattatttaaaaggacccaaggtgaacacttttatatgttatataaacctgcaacacttgattaatctgttctttaagttaaaagttttgtgattttcttacatgagtacatctgtaattgctattgcacttaatagtgttttaatcccaattttagtaaaatgtgtctgttgctatgcaatagcacagtggttttgaaatagttaaatcaaataaatatttgaatttttaaagtaaagctcacataagttttgtctctctacctggccataactttagtaattgatgactaagatggcaatggtatctagagtccttcaatagcaaatgtgaccaaacagaatcagttctattcttaataccccaaattccatgtaaagctgcacatggacatctcccctggacatgtaacaggaaccttttagttcaaccgtgtggtttcactcagagtaagagtctatttctggggatttcaaaatggatccaaaaatgacgagctgtatcaactatagagttggtaaggaaaaaaaaaaacaaaacgtagttcaactatgcttgacccagattaaggtatttgtctaacatttgtccatttttcaactgagggaaaattacaaaaactgggcacagtggcacacacctgtagtcccagctgctcctgaggctgaggcaggaagatcacttgaacccaggagttcaaatctgcagtgcgcaatgattattcctgtgagtagctacggcactgcagcattccaatctgggtaacatagcaagattctgtctcttaaaaaaattacaaaatccataaaacatttgtttgaacaacaatagataaatagttttctttgtgtatattgttgtttttaaaattttcaatcgatgcacattggcttatagttttgatgtttttatgatctccttagcgcacagaaaagtagcgcaggcccacatggaatgaacctcaaccttgttgtgtttacctggctatttcgtgtcctaacaaatcatagaagagcaaatctaaggtttcttagatagcattgtggccaaatagcttaaaagggaatgcattaaatgattgttttaatacatagattacaagagcccagctagctgatatttttaatcatattgttcgcttaggttttatttttctgaaaaaaatgagatgatcagcgtccaaatgcctcagtcacgaaattgtaccactgggtactaatgggaaatgaatgttaaatacgtctgtaaatggttaagcaagatgcaaatataatgttctcattagtactatgaaccccccaaatttgagacaagtctcaattaatttagaaagtttattttgccgaggttgaggacacacatccgtgacacagcctcaggaagtcctgatgacatgtgtccaaggtggttggggcacaacttggttttatacattttagggagacatgagacatcaatcaatatatttaagaagtacattggttcactctggaaaggcgggacaatttgaagcaaagggaggaagactggtagcggggagggggcttccaggtcacagatagatgagagacaaacagttgcactcttttgagtttctgattagcctttccaaaggagacagtcagatctgcatttatcttagtgagcagagaggtaactttgaatagaatgggaggcaggtttgccctaagcagtttccagcctgagttttccttttagcttagtgattttggaggcccaagatattttcctttcacaatacttaccagaaaaacaaggtaatgtatcattttacaagatggtgctgagagagtataaaaagcagatgtaggccgggcactgtagctcaaacctataatcccagcaccttgggaggccaaggtgggtggatcacctgaggtcaggagttcgagaccaacctccaacatggtgaaaccccgtacctaataaaaatacaaaaattagctgggcatggtggtgtgcgcctgcagtcccagttacttgggaggctgaggcaggagaatcgcttgaacctgggaggcaaaggttgcagtgagctgagattgtgctgctgcactccaacctgggcgacagagcaagactccatctcatgggtgggggaaaaaaataaataaaataaataaaagcagatgtgatgcaagggaagatttttgaggaactttttttttttaatttctgttttgtggggaagggggtgttcattttttagtatttctagataagtagaaaatttgtttgttttaaagttaatgttaatgtagtagttccaaggcatacctagtttccttgtggggcattttttgcccaatcatgttagatttactaaaagagatttaaaagcatgattatatcaagatatgagtgcttggtgcggaggctcacacgtgtaatcccagcactttgggaggccgaggcgagtgggtcacttgaggtcaggaattcgagaccagcctggacaacatggtgaaaccctgtctctgctaaaaatacaaaaattagcctggcgtggtggcaggcgcctataatcctagctactcgggaggctgaggctggagaatcgcttgaacccaggacgcagaggttgcagtgagccaagattgtgccactgcactgcagcccaggtgacagagcaagactccatctcaaaaaaaaaaaagtggaggtagttgtgaagaatgtatggtaagattagaaaagtcaaggaagaagaaactatttctataagtgttatacagtcatggttctttttcaggctgtggtggataggcagcaaatggtgctcctcattcccttctgagttcagaacacaggagtcagatagatggacatcaacacactagctctattacagactcatgataactaatgggaggatgtggctcagatgtgcagccacagtattttatcccagattaggcactaacccacagagttttaagtggagaaaacaaatgcttgacacccatcgcaggtgcatgctgcttactgcagagatgacagcagacctgaactcatgtcactgtgggcagacacatcttttgaaagagaccctgagccaagcaagcacactgtgtgctttgcccaaattcacccattaggtagatctgatatcctctcaagaggaagctataggtagagagagtctaagtcctcatttgaaacctgaggccaggaaaatgaaggttctcctatcatttatggctggatttaagtgataattgaaattaatcccatgtctttgtatgtacaaattagtgattagaagttggacagacgtgtggtagatggtaaagagaaatctgttttgtgttttcagtttttctataagtaactcacaacatggataattgacttgattgattttcctaaaccacgtcttatttggaggagaatgaatagttcttttaaggaacagttttcttaatttctgcttgcttggttcaactaaagattttctccttcaagttttctgttctgcgttttgaaaaatgggttctttataaattgagtgtcttgactggtactagccagaagttatgatattaattgttctttaaatttgattcataacttacaatttggagagctactattttttgtctcatgcttaaacattatagagcatcatgacagtttatagatgcattttctcttttttttgttgttgttgtttttgagacagagtctcactctgtctcccaggctggagagcagtggcgtgatctctgctcactgcaacctctgcctgccgggttcaagcgattctcctgcctcagcctcctgagtagctgggactacaggtgcacaccaccacgcctggctaatttttatatttttagtagagacggggtttcaccatattgtccaggctggtcttgaactcctaaccttgtgatccacccaattcagcctcccaaagtgctgagattacaggcgtgagccaccacacctggactgtctgagttatttttttatttttattattattattattatttttgatgcggagtctgactctgtcatccaggctggagtgcagtggcacgatctcggctcactgcaagctccgcctcctgggttcacgccattctcctgcctcagcctcctgagtagctgggactacaggcgcctgccaccatgcccggctaattttgtgtatttttagtagagacggggtttcattgtgttagccaggatggtcttgatcttctgaccttgtgatcctcccgtctcggcctcccaaagtgctgggattacaggtgtgagccaccgcgcccagcctgagttatttttaaaaatctgtatttcttttctgaatatgaaggaaggtgctggcatagaataactccaggctcagtgaaagatctgaagcccactcctaccttgtaactaattggttttgtgacctcaggcaagctgcaggctctctgagcctgttttgtttcttatgtaaaattaaggactttgactaaatcagtgacattcatacgtttaagtaaatctctttttttttttaagaatggaacttttttaaattgcataaaaccacattatagaaaacagaagtagtgctgcctgactaaaggaaggatcagtgctctgaagctgtgactttcttatcccttaatccttcagcatcctctgtggaaccttagatttctgtgggacatagcttgaaaaggatcatttcttgaattattacttttataaggcctggatggtaatgctgttgtcatgttacctactctataaagcctatctgtaatgtttttgtcacagaaatgttatggaaaggagtctcaaaatattggtaaacctgttagtaaaacaaaaaaattgacttgacacctaaaatttgtaaaggcattagatatcattatctttatcaccacaaactatctcagaccctgttctaggcatttagtgagagaatacctattctaaaaaaaaattaaataagagcactctagatagggacactggcaataagtttgaaatattcccacacctttcataattaagtagataactataacttgtcagatgcttaaaaaatgggtactaatttctgaaaagaaatcaaagttgtagttaaataactctaaattgttttcctagtttttaattctagacactcatgaatcaaagaaactaagattgaaaactggctctaacctgtatttatccttgcttttatgtaaattttctgaaatctttgtgtccgtatgaatgaagaaatgttaatcataatagcataatgtttttaatcttttgccagtggaactttcacatggcatcacaacaatactgctttcttcaagtatgtattaaagattctgtgctgaattaatagcaaagaacatactttgaaattattattttctaaaagtggagaatggagagttcattgtaaggaactattcattaaagtgaaaaactggttagaccttgataaagggcagagttttgataagaatgggaaagtaatgcattcattgcagaatatgacttgaattgtgtaacctctgtactgataagggaaaacatcacacttttgaaatgacatagatccaacagaccaatattaattgtacttttgtgagattaatctaaacagcataacacatatatgttctccattatctaaacttaaaataggtaggaatttatatgatatttttaatttaagctatcttcaagttaggtctagtctgtaaaagtattatttaaaggccgcattttgtaattaatgctccttaccatgataatgtctcttcttaaacgttataaataatatttgacttatttcagatgcagcagaagttgcaaaatgacctaactgcagaagtagcaggtatgttaccaaaatttatgaattaaatttagattaatatatatctgaaataaactgcaaacgacatccctttccgttcttgggctagtagatactacattaaatattctttcatatacatctaatgaaagatgtgaaaacctgaacatgtataatgaagagcatacttatgcctcatgaatcatcacgttccatagcttgaaaaaaatagctcaagaagtctggctctactcttcacttctgccatccctatggaattgtcagccagcacacagaaacggttctcagaaaacagaggcatcatcaacttctcagggttatggtagtgatttttaaggccaaaacatcccagtctcatctagtaacctattcaagcagttacagtttataagcagtcgcttgagaggtaacactttaaatctccagtcatttacagtgtcattggtttacttttgccctcagaaaaagttccaaattccttaacatgtaatataaacacccacattcatttggttcttgtcaagttactcaggcttatctctcaccacttactttactctgcccctttgctctaggatccagccaaactggactgcacagaattccacagtgctcgtccttctcctccagctctttgcacttgcttctttgctctatctgccaacctttttttctcatccttcaggtatccactaaccatgcctccaccgaaaaacctacagtatcgagacaaaactgggataggtgtccctcttgcattccaatagtgccctgttttatacctgtcagggtatctatgacttggtatggaaattgcctatttgtctgctttttcaggttatagcatgtgattgctgaggggtggactgtatcatcttcatcttgtaactccagggcatagtctagtaccttagcatgcggttgttgaataaatgaatgaagaatgagaaaaccagaagctgtgatacacaaccacaatgatcatttagtgtgcaactatgggcagattcttatctaataataagttagcattgtagtcatacatacttttcattcttgttaacactgaaaaagctctcaactcttttttactgatttgcacttagttaactatgaaatatatagaatataattctttggccaggcatgttggctcacgtttgtagtcccagcactttgggagcctgaggcaggcagatcactggagcccaggagtttgagagcagcctgtgccaacatgacgaaaccctgcccctataaaaaatacaaaagcttgccaggcacagtggctcatgcctgcagttccaagtacttggggctgaggcaggagaattgcttaagcctgggaggacgagactgcagtgacctgtgatcacaccacggcactccagcataggtgaaagagtgagaccctatcttaaaataataacaataataataataataataataataataataataataatataattcttgctttttttttcagctgctactaaatatgaacctggatcctatatagcttctcctctaggatttacacacaaggaaaatctgaatcaagatccagttttggaagtagcaaaagaatatgcacagattttaagaagaaaatacatactctgaaagataaggcaattttatttgggctattcacatgatattttgtttcccattaaatatatgatgtgaacatttttactaaagggaaatattctatgttatacatgtctgatgaaaatttatatagtattttaaataatgtttcttggcctcttcagctaacttttaagtggattttgcaaatgaaaaccagtattactgagttttacatactcgaactgcccaaatgttagctgtttaaacagccaaataatcaagttgccattaataatttagtggagccaattgatggcttgtttgtattttataattttatctttatacatagtgatagatttaagtttagatagacatcattttggtatactggtactgtggtcattgtcaatgtttggatatattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctggtatgtgggtattcccacaagtcaggacattttatataactacttcataatcagaaagttaacatcaatacacttgatcatttcattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaagtttttttatgataagatttagatgataatttttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacataggtaaataggtgccatggtggtttgctgcacagatcatcccatcacctaggtattaataatagcccagcatccattagctgttcttcacgatgctctcccttctctcacccgccaccatcccacatgcccctgtgtgtgttgttccccgccatgtgtccatgtgttctcattattcagctcccacttgtaagtgagagcatgcagtatttcattttctatttctgcgttggtttgctgagg

SEQ ID NO: 610 - DNA, 5630 bp, Homo sapiens
ggtgctcgcccgagcagggttggggcgagtggaccgcgcctctaaaggcgcttgccagtgcaatctgggcgatcgcttcctggtcctcgcctcctccgctgtctccctggagttcttgcaagtcggccaggatgtctcaggtacagcgcgtgcacagccaggctgcgaaggtgcagcgggcgggaggcccgttgggggctcagccggctgccagaagctctcgggctctttccttccgtgcccctcacttgctcatgggcccatgcctagccctgattcgttggacagagccttgtgagcgggattttccgtttggggatttctaaatctgctgcccaccccgcaactgccggaaagttgcccatggggtggacttcgctgtgtagcgggagaggggtgggagtcgagggtgcttgatggagagatgggggaaggggttgcacggattggaggagcgaggagactcagtccccatcccgaagcacagggcaggacgtcgcggcggagtggggaagcgaggagtccgtggccgagagcttggaggtcaggggaagtacggggccggctgctcagagtgcgggacgaggagaatcgcggcccggggagaggtgacccaggggcccctcccttctctccagtgtagacccttgtctgagaccgagctatgtggggcgacctctggctcctcccgcctgcctctgccaatccgggcactgggacagaggtcggtgttgaacgcgcgggccccagggggagggaggggaccaacgggctccggcgctgacaccgcggcactcatgccctgtcccctttcagctgtttccagcatactgtgccccgtctgtcctcaggccagggcttcgctgcagccccggccactccctagtgcctggcccggtggtggccaggcagttggccgcgctgcttctcccgcagaggggacccccactgggggcgaaggcttggcctgccctcttcactgctgtatttccagacctgatgcctgcgtttgtgagagctctggatatatggttttcgattgaatgagtgaactggaggggcttccccttcttgtgttgctgaatctttctagctgccctgttggggcagggaggggcagacacacttcaggggctgcattgcccgaagggtgccacctttcccacctctccatccccgtaactgggctgtcatcaggccacagtaggattcttaccctctcccacccagaggaggccctcaatcctctcctctcccttccatttaggctgagtttgagaaagctgcagaggaggttaggcaccttaagaccaagccatcggatgaggagatgctgttcatctatggccactacaaacaagcaactgtgggcgacataaatacaggtatgcagagcgggggttggaagggcatctgctcatcaaagcaggctcagcagctcagactggaagtccctgggaacttcactctcaaactgcctgaggccctactcttcaggtggggtatggtgatggttcctgaggtggaaaagaccatgttccggattctcagtgtctccagtagtaacagaattcaaatcctggttttagaaggtctttactggttatcaccagcagctactctctactagggaagaagcaaaggctgcagcttggaaaagacttgctgaaggctctcagctcagtagtatcattgttgagccgttcagcttctgccctagatgggcaggatcaaagttggagcactttttggagcacttgacagcctggccaagcctgatgtcaggagcagagaagcacctggtttcttgggctaggtcagagcatttcgctaacaagtctgtgccttcctgatgataactttttccctgcccagaaatcttggtgcagattttgaggctgtgctttggactgtcatgttctgtaataacatctttcctgccttgggcaggtttcattctgtccctaagtccctgaaacatgggtggatactgaggcaacagcgcagtgcattctgtgcaaggactcagggttatcatggcagcacagaagggaggtctcccctgcccctgctgaggaagaaggcgagcatggtccctatttccgcagtagctggggtggaagatggagcaggtgggctggctgccaaccagctggaagcaggaaatagtacccagaatgacagatcacaggcagtaccatatcaaaccctggggttcacatggagcacttagttgaagaaggtcttatggcgaaggtgagttttacagtgagttcgtaaactctgtccttccagggaggggaaggaaaggtgaagtgggggaggccagaggtgccaagatgcttttctgacaaacagtattttcacagagactggcctgtgcccgtactagagttaccgattttcacatgagtctagatagactggcataggaatctatcacttactgatcaaagaggtgtcatcggctctctctagggctgtactatacagccctattacacgattataaaacatgatagtccaaacacgatagtttagtataatagccagtagccacatatgactatataaattttaactgaggctgggcgctatggctcatgcctgtaatcccagcactttgggaggccgaagcaagcgaatcatgaggtcaggagtttgagaccaacctggctaacgtagtgaaaccccatctctactaaaaatacaaaaattagctgggcatggtggcatatgcctgtagtcccagctacttgggaggctgaggcaggagaatcgcttgaacctgggaggtagaggttgtggtgagccgaggtcgcaccactgcactccagcctgggcaacagaacgagactctgtctctaaaaaaaaaaattttaactgaaaatagttaaataaaatcaagtttagtcttcattcacaggaaccacatttcagatgcccagtagtcatttcaggtacttggtgtggcaagtggctcctgaattggacattgcaaatatacatgtacatttccatttccaccgcttggagagagctgtcgaggagtgctattctaggatcctgatgatgaccacaagggcagtttgtttcagctgtccctgggaacacttccctgaaagcgctcagggacattttctcaggcacagtgctccaggctacggactctgattgttccctgtggctttggggctgggcatcgtagtgaaataggacaacagggagatggtgagtgtgtttcccaactgcagatgacaacaggtctataagcataaagtcatcatataacttaaagaaaccttaccctcggtgaaatctcccacagatcagcaagaaatagactaacaattcggtagaaaaatggggctaggatataaacagttcataggaaaggacacctgatatcattaatgattagggagagaaattgggtagctaacagcaggggtgagagagaaactttatagtattttcctctgtagcttttgaattttaagacatatgaatggattttttttttaattgtaattaaagtataatttttttaaaagagaaattttggagtcatttaacttgtaagacaaaggctatcttgtaataagaatactgttcttcctatttgctctagattttaagtttggattggcatacattggttttcttagggcagaacccactctactagacctatttaaccccatgacagagcctagaaggaacaggtgtaatagaagatggcatttatggcaagaaggttgatcaagttctccattagaatttgaaccagatctaatgccttttcttcccttgtttaagaacggcccgggatgttggacttcacgggcaaggccaagtgggatgcctggaatgagctgaaaggtaattgttctaatcaatttctctcatttgtgaaacccagtagtgaaagagtcttcattatgaagtgtaagggaagaggagagaaaacaaagtcaatggggcacgtgtgggaaaccagcctgacctgtgccagaatgggaaaaaaccgggccacctactttttctcctaacaccatttatgccttttctaaaagcaccatctctgagcaggagcatcatctagagaggaggggctgggaaccaggccactgaaaaatagtttgggaaatgatgtagttggcgtaggctttggatgtgttcagaataaggggtggtttcctgtctgcaactccctctcccctacaaggccaggcggtgaccccctaaccccagtggccctccccagttccttcctagccagaaggatacataaaagaagggaatgagctaatgcatggcctgccgctggcatcgtaggctcagtgaatggagccattatatgctaagcaccagcagccaagaagtatccaagctcgtacttaatcacgtgccacctgcagcagcaagacccaagagttggcaccaaagctcctggcagcattagtgttcctgctggctagtttctgaataagccctctgtccttctgcgaatgagaaacccttgaattcagaaagggccacaatacaataaacacactcctaggatctgcaagtaactgggaagggaatgcccatctgcctgcccattttcatgggacatttccataccatcctcaggccccatgtactctccagtgcttcagaacaagctctgagttccaaagggtctctatccttcaccatagaatccaggaaactgggtgtcactgtctctgagggatacattcagtgtcctttctactgcagcaagaagacaaagatttgtctcattcccctccaagaagcagccacttttggtcagagttcctgaaacttttctcatagcctctctctggggagaagagggtgcctggctttgctttttcactgccagcttaacagctctggaagataggagcccaaaacagagacactgaaaaggccaaagccaatatcagccacgagagttagcaggaccagtaaagtcaccacgatgacagtttcctacctgtctggagggtggcacctctctcccaaggctcacaatggccattcccccaggacaggtgggggacgcaggtgtccagcagatgggcgacagatcttggccagccccaccaggctttctgagcacagttgcttatggagcattcacttcgggccaggttctgtggatactgtctcctgtaattagtagaatctcaactttattaagtgagaaactgagcctaggagagttacagcagagctgcctggggctctggaggctgcttgtttcctaccatgctacctccctgacacataatcctgtcgattccttacagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaataacttt

SEQ ID NO: 611 - DNA, 58467 bp, Homo sapiens
ggaagaaggaaaacgatttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggtaagttttccagttataataactgcatgtagaatatattagtttttgacactgaagtccaatgtctttaaaaattctccacatttgggctagagataggaaagaatgttgtgattattttcctactctgagttctagaagaatgcccgggtgtgtgactgttcttagatgacaacaggaaaacagatctcttctgaaaaaggcaaggtgatatggtggaaaagcactagactggtttgtagtgagcgactaaattatattcttaatggcttcctatataaccttagaaaaatccctccttctctccagacttttttttctccatctatacaatgaaggagcatgacaagatgatccttaagggctttccaagtctcaaaatctgtgttttatgagataggttttggaaggcctgactgggtggaggagagggccgagaatgacctgagaactccattcccacacatagcctagacagaactttctaaacttctacaatggacaaacatcacagcagggtcacatggacactgggagaaaaaaaacaggagtctgtgtgcttgttatgtgaggagggggacattttagaatgctctgcttcttctttttggtctgccatggagttgtttttttttttttttaacatgtcaacttttcagaaaagcactttggaaaacccctaaatcaagagaaaggaacatgtgtttccaaattagctcatcaagaaagaaaaatttatatgggttattcccagtagaaattaaacagcttactaaatcctcgcttacattaactgtgtagcttttccctttattttcactgactattggatagtattcaggataataagaacaataacaaactcatattgtgcctggctcttttctaaatactttacatatgttacctaatttagtcctaacaacttaggagataggttgttattaatggtgcttgtatagtactagcatcatcagtagtagtagtgatagtagtagttattactacttcattacaacttttagttattacaatattataatgttgttctcatcatttctagataggtaaactaaggcattaaagtttaagtaacttgcctctaaaactatacagctccctgatggcttacaaagacataaaataagatatacttaccaaatgttaagttaaatacctattggcaaaagtaatgcttttacagccagttagattatttaacagcttgtcacatatatacaccaaggacatcatcaacctgtcttttcaaaattgtaagagaaagacccttgaattcctgcagtgctaggtaatgcaattaagtgtttgctaaactatcgggcataagagcgacttcttctatctctgggttgtagcaaaacatataactgctcagataggatataaatgagctgtaatttcctaactggctttttacatttaccaattccaaatcagaagtaatgtctcttcactgggtaactaaagtgttccctttgtctgaactgttcattcaactcaattagactcctgaaatcaattgttggctttcacctatgtgtttatcttcatagacttttcatatttgggtggtaatctggacaggaaactttagcaagtcacacatggatgagaaaatgttgaattaaataataactttcaaaggaaccaataatttattgagtacttactatatggtaggcactgtgctaagtggtttattaaccctcttttatgaatacagaaattaaagcaaagagcagctaagtaactttgtccaaggtcacatagctagttagtggcagagttagaattctattcctttaaaatagctatgtctaatattattcaattgttttcagttgtgtgaactttttagtaaactagtccagaattttatcaggtggagtgctttagatgtaagcttatctaatgacattgatacaaattacagattttctggaagaacctcaaatatcatctggtccaggtttttgttttattttaagctgtgttccacagatctctagaagtttcgtggaagatactgggaggggaaataggggttgagaaagactaaaagtgctaatgagtaatttttaaaaggcattactacaagagattaagcattctcctgtcacaattaagaatttatactacgatatctatgtgttctgtgtagtcaataaaaacattgtcttttagctctgaatgatttgagcaaggtttctatccaataactaagaacaaagatttcataacacacattttattttctctaagtgtagggatgaaataatcttaatgatttgttgtttgttgttaaatggaatgtttgcattctgtaccaaagactctaaaattaagttttagtatatttgtacataaaattatggaatttaacatttgggccaaaattctgaatgtaatacttttgtcaaaaactttttttaatgtgtgggggaaagaaggaagagatgatactctactctgagtgttcagaccatttcaaagtatcttatagctattataaatacttataaagactgattaatataaaaattcaacaaaactattaaatgagagaaggcagtgtttaagagtatggtgtctggaggatatagtcctggtcctgaatttactgagtgagaagaggatgtatgtcatcaactcttgattagccgactgtacttgagcaagtcagcctctctgagcctcagtttcctcacctgtaaaacaagtgtaataacagagcctacctcatagcatcatcctatttgtaaggattaaataaaacaagtgtataaagcacagtagttggcaatgtagtaaacactttataaatgttaactattgttgccattattatttttcatgtttaaaaacttagatcacaaacacaaagaaaaaaattgttttggtgaatggctgcatcctgtctttgccagctgaagataattaagagatcagtaattcatcaatcaggctagcgaatttatatcctaaaattgtatgtgatggcactttaaatcagcataacataacagaaaaaaaaacccttcagttttcctgtaaaactttactgcatttcccccacacctcagtgttttgattttccttttgccaaaggcgatccacccttcctgctgtatctattatcagactccattcttcttcctgcctcccacccttaatcatgtttccactcactaaacctagttttgattggatccttagtctgacttctattacaaaacaaatgcagctggtaaggttggttgcctcttcccattcctcttcacaccctgccatcataaagatcaacaatatcattttctttgtcacatccactatcagggaaagaaaattttgtcaaaaaattgaaattttgtccagtgtttctggaccttaataattctacgcataatagatcagagcagccgtaagatgaagtaccttttatttccttctataggctactctctctagtctttcctatcataattcttggtgattttaatatctacacagatgattcttccaacactctagcccctcagatccctgactttccctcctccagggatcttagtcctcatcatctctcaggtgcttcttcccatagtcatacgcttacctttgtcattgcaatgtctgcaacctctgcataatatcatttatttgggggtgttttttgttcttctttttgaacttctctattttcataggtacatgtttaactttgacaaaatactttaaaaagcagttgtaccattttacacttcacttcattatgtgagagttccacttgctccactttcctgtcaacacttggtatggtcattctttttcatttcagttattctaatgtgtttatcatggtatctcattgtggttttaatttgcctttcccacatgtctaatgatattgggcatcttttcatgtccttatttatcatctgtatatcttcctttgtaaagttttcaaatctcttccccattttaattgttctttaactttaatttttaatttttgtgagtacatagtaggtatatatatttatgggttgcatggaatattttgatacaggcatgcaacatgtaataatcacatcaggtaaatgggatattcatcccctcaagcatttatcttttgggttacaaacaattcaattatactgttttagttatttttaaatgtacaattaaattatttttcactgcagtcaccttattgtgctagcaaatactaggtgttattcatccttcctagctattttttgtacccattaacactcttcacctccccacacacacagactcactacccttcccagcctctagtagccatcctttactctctctatgagttcaaatgtttttgttcttagctctcacaaataagtgagaacacgtgaagtttgtctttctgtgcctggcttattttatgtaatatatgacgtccagttccatccatgttgttgcaaatgactgaatctcattcttttttatggttgaatagtactctgctgtgtatatgcccacattttctgtatccattcatctgttgatgggatatttaggttgcttccaaatcttggctattgtgaatagtactgcaatgaatgtgggagtgcagagatctctgtgatatgctgatttcctttctttggggtagatacctagcagtgggattgctggaccataaggtagctctattttcatttttttgaggaacctccaaactgttctccatagtggttgtactaatatttacattcccatcaacagtgtttgaggattcccttttctctatatcctcgccagcgtttgttatttcctgtcttttggataaaagccattttattaggttggtgcaaaagtaattgcggtttttgcaattgaaagtaatggcaaaaccgcatttacttttgcaccaacctaataactgagctgagatgatatctcattgtagttttgatttgaatttctctgatgatcaatgacattgagcaccttttcatatggctcttcaccatttgtatatcttcttttgaggaatgtctattcacatcttttgcccatttgtcaaacacagtattagattttttcctatagagttatttgagctccttatatattctggttattaatcccttgtcagataggtggtttgcaaatactttctcccattctgtgggtcgtctttgcacattgttgattcctttgctgtgcagaagcttgttaacttgatgtgatcccattcgtccatttttgctttgcttgcctgtatttatggcatattattcaagaaatctctgcccactccaatgtcttggagagtttccctaatgttttcttttagtagtttcatagtttcaggtcttagatttaagcctttaatccatttgtatttgattttttgtatatggtgagagataggggtctagtttcattcttttgcatatggatatccagttttcccagcacctttccccagtgtatgatcttggcacctttcctgaaaatgagttcattgtaaatgtatagacttatctccaggttctctattcttttccactgatctatgtgtctttttttatgccaggaccatgccattttggttactatagctctgtagtataatttgaagtcaggtattgcttaggagatagctttggctattctgggtctttcctggttccatataaatattaggatttttaaaaatttctgtgaatatatgtctttgtcattttgatagggattgcattaaatctatagattgctttgggtactatggacattttaactatatttattcttccaattcataaatatagaatatctttccatttttgtatgtctttttcaatttcttgtatcaatgttttatagttttcaggtagaaatcttttagtatttttgttaattactatgtactttatttcatttgtagctattgcaaatggaattactttcttgattttttttcacattgttcactgttggcatatagaaatgtcactgatttttgtacgttgattttgtaacctgcaactttactgaatttatcaactttaagagttttcattggagtgtttaggtttttccaaatataagatcatatcatctgcaaacaaggtaatttgacttcctcctttccaatttggaagcctttttatttctttatcttgtctgattgctctggctaggacttccagtactatgttgaataactgtggtgaaagtgggcatccttgttatgttcccaatcttagaggacaggatttcagtttttgtccattcagtataatactagctatgggtttgtcatatatggcttttattctgttgaggtatgttccctctatacccatgtttttgagggttttttgtcataaagggatgtttaatattatcaaatgctttttcagcaacaattaaaatgatcatgaggtttttgttcttcattctgttgatatgatgtatctcattaattgatgtgtgtatgttgaatcattcttgcatcactggaataaattgcacttggtcatgataaatgatcttttgttttgtttttgttttcacttttaagtacaggggtacatgtgcagatttgttatataggtaaacttgtgtcatgggtgtttgttgtacaaattatttcatcacccaggtattaagcctagtacccattagctatttttttttctgagtccatgtattctcatcttttagctgccacttgtaagtgagaatgtgtggtatttggttttctgttgctgcattaatttgctagggataatggcttctagctctgttcatgttcctataaaggacatgatctcattcttttttaaaaaagtgactttattttattttagttacataaattacaaaatatcactaagtgaaaataaaatcaataaaaatcatccatgataccacccactttaacatttatgtgtatagcctcttatgctttatttcctcacatatatagataaatacattcatcaaaaagaggttatttcatatattaagttggtacaaaattaattgcgctttttgccattacttttaatacattgttttgcaaactatttttatttcacaatatattatgaatttatttctataacattaaatatattatctgtatgtatgtgtgtcttggtttcttatgactaaaattttttaaaattaaggcgttgttatgttgagatagttgaagattcacatgcagttttaagaaataatacagagagatgctgtgtgccctttaccaagtttcccttaatgataacatcttgtaaaactatagtatgataagaaaaccaggacattattgacattgatgcagtcagatacagaagattttcatcactacacagatccgtgttgcccttttaaagccacatccacttgtgtctcatccagtccctcaaccattaatctcttttctgctttgataattttatcatgtcaagaatgttacgtaaatggaataaaacagtatatcaccttttgggattgtcttttttttccccactcagcacaattccctggaacttcatccaagttgttgtgtgtatcaacagtttgatcctttttattgctgagtactactccatgatactgatatgccacagtttgtttaattattcagctgttgaaggacattttggttgtcactagttttgggttattacaaacaaggctgtataaatcctcttttacaggtttctttatggacataagttttcatttctctgagataaatgccaaagggtctagttgtttggtcgcgtagcagctgcatgtttagatttggaagaaattgccaaagtgctttccagtgtggtcatactattttacattaaaaccagcaatatttctgtgcattcttaccagcattttgtgttgtcactattattatcttaactattttgaaagctgtgtagtgacattttattgtttaaatttgcatttcccaaaaggctaataaaattgaacattttgtctgcttatttgtcatctgcatgtcctcttcagtgcaatgtctgtccatgtcctttgctaattttcttttttccttttttattttagagtatttagttggcaaataaagattgtatatattcaatgtatacaacacaatgattttgtttctttttaaaaagaattatttatttttcaatgggtttttggggaacaggtgaagtttggttacatgaataagatatatagtagtgatttcagagatattggtgcatccgtcacccaagcagtgtacactgtacccaatgtgtagtcttttatcttcactcccccacccctttctctgagtcttcaaagtccattgtatcattcttatgcctttgcgtcctcatagcttagctcccaattataagtgagaacataccatgtttggctttccattcctgagttacttcacttagaataatagtctccaattccttccaggttgctgcaaatgccattatttagtgcctttttatggctgagtagtattccatggtgtgtgtatgtgtgcatatatatatatatatatatatatatatatatatatatatatcacattttcttttttattatactttcagttcttggatgcatgtgcagaacgtgcaggtttgttacataggtatacatgtgccatggtggtttgctgcacccatcaacccgtcatctaggttttgggctccacatgcattaggtaatgctctccctctcatttccccccactccgcaactggctccagtgttccatgtgttctcattgttcagctcccacttatgagtgagaacatgtggtgtttgcttttctgttcctgtgttagtttgctgagaatgatgggttccatctttatccatgtctctgcaaaggacatgaactcattctcttttatggctgcataatattccatggtgtatctgtgccacattttctttgtccactctatcattgatggccctttgggttgattccaagtctttgctcttgtaaatagtgctgcagtaaacatatgtgtgcatgtgcctttatggtagaatgatttataatcctttgggtatatacccagtaatgggattgctgggtcaaatggtatttctgattctagatccttgaggaattttcacactgtcttccacaatgattgaactaattgacattcctactaacagtgtaaaagtgttcctatttctccacatcctctccagcatctgttgtttcctgactttttaatgattgccattttaactgatgtgagatggtatctcattgcggttttgatttgcatttctctaatgatcagtgatgattagcttttattcatatgattgttggccacataaatgtcttcttttgagacgctcatatccttcacccactttttgatggggttgtttggttttttcttgtaaatttatttaagttccttgtagattctggatattagccccttgtcagatggatagattgcaaaaattttctccattctgtaggttgcctgatcactctgatgacagtttcttttgccatgcagaagctctttagtttaattagatcccatttgtcaattttggcttttgttgccattgcttttgttgttttagtcatgaagtctttgcccatgcctatgtcctgaatggtattgcctaggtttttttctagggtttttatggttttaggtcttatgtttaagtttttaatccatcttgagttaatttttgtataaggtgtaaggaaggggtccagattccgttttctgcatatggctagccagttttcccagcaccatttattaaatagggaatctttccccatttcttgtttttgtcaggtttgtcaaagatcagatggttgtagatgtgtggtgttatatctgaggtctctgttatgttccattggtctatatatgtgttttggtactagtaccatgctgttttggttactgtagccttgtagtatagtttgaagtcaggtagcatgatgtctccagctttggttttttgtttgtttgtttgtttttgttttttgtttttgctttggattgttttggctatacaggctctttattggttccatatgaaatttaaagtaggtttttaaaaattattattatactttaagttttagggtacatgtgcacaacgtgcaggtttgttacatattccaattctgtgaagaaaggcaattgtagcttgatgggaatagcattgaatctataaattactttgggcagcatggccattttcatgatattgattattcctatccatgagcatggaatgtttttccatttgttgtgtcctctcttatttccttgagcagtggtttgtagttctcctcaaagaggtccttcacatcccttgtaagttgtatttctaggtattttattctctttgtagcaattgtgaatgggagttcactcatgatttggctctctattttggttgtataggaatgcttgtgatttttgcacattgattttgtgtcctgagactttgctgaagttgcttatcagcttaaggagtttttgggctgagacaatggggttttctaaatatgcaatcatgtcatctgcaaacagatacaatttgacttcctctcttcctatttgtatatgctttatttctttctcttgcctgattgccctggccagaacttccaatgctatgttgaataggagtggtgagagagggcatccttgtcttgtgccagttttcaaagggaatatttccagcttttgcccattcagtatgatattggctatgggtttttcatggatagctcttattattttcagatacattccatcaataactagttgattgagagtttttagcatgaaggtatattgaattttatcgaaggctttttatgcatctattgagacaataatgtggtttttgtcattggttctctttacatgctgtataatgtttattgatttgcatatgttgaaccagccttgtatcccagggatgaagccaacttgatcatggtgaataagctttttgatgtgctgctggattcagtttgccagtattttattgaggattttcacaacaatgtttatcagggatattggcgtgaaattttctttttgtgtgtgtgtctctgacaggttctggtgtcaggatgaaattggcatcataaaatgagttagggaggagtccctctttttctattgtttggaatagtttcagaaggaatggtaccagctcctctttgtacctctggtagaatttggctgtgaatccgtctgatcctgtgcttttttggttggtaaactgttaattgctgcctcaatttcagaacttgttattgttctattcagggattgacttcttcctgtgtccaggaatttatgcatttcttttagtttttctagtttatttgtgtagaggtgtttgcagtattatctgatggtagtttgtatttctgtgggatgagtggtgatatcccctttatcattttttattgtgtctatttgattcctctcagttttcttctttattagtctggctagcagtcaatctattttgttcatcttttcaaagaaccagctcctggatttattgatttttttgaaggatttttcgtgtctctatctccttcacttgtgctctgatcttagttgcttcttgtcttctgctagcttttgaatttgtttgctcttgcttctctagttcttttaattgtgatgttaggctgttgattttaaatctttcccgctttctgatgtgggattttagtgctataaatttccctctaaacactgctttagttatgtcccagagattccggtacattgtgtctttgttctcattagtttcaaagaactttatttctgccttaatgtcgttgtttacccagtagtcattcaggagcagttgttcagtttccatgtagttgtgcggttttgagtgagtttcttaatcctgagttctaatttgattgcactgtggtctgagagactgtttgtcatgatttccattcttttgcatttgctgaggagtgttttacttccaattatgtggtcaattttagaataagtgtgatgtggtgctgagaggaatgtatattctgttgatttggggtggagagttctgtagatgtctattcggtctgcttggtccggagctgagttcaagtcctgaatatccttgttaattttctgtctcgttgatctaatgttgacagtggggtgttaaagtctcccactattattgtgtgggagtctaagtctctttgtaggtctctaagaacttgctttatgaatctggttgctcctgtattgggtgcatatatatttaggatagttagctcttcttgttgcattgattccttgaccattatgtaatacccttctttgtcttttttgatctttgttggtttaaattttgctttatcaggaactaggattgcaacccctgctttttttttctttccatttgcttggtaaatattcctccatccctttattttgagcctatgtgtgtctttgcacatgagatgggtctcctgaatacagcacactgatgggtcttgactctttatccaatttgccggtctgtgtgttttaattggaacatttagcccatttatattcaaggttaatattgttatgtgtgaatttgatcctgtcattatgatgctagttattttgctcattagttgttgcagtttcttcacagtgtcgatggtctttacaatttggtatgtttttgcagttgctggtaccggttttttctttccatgtttagtgcttctttctggagctcttgaaaggcaggcctggtggtgacaaaatctctcagcatttgcttgtctgtaaaggattttatttttccttcgcttatgaagctttgcttgtctggatatgaaattcttggttgaaaattctgtttttaatgaatgttgaatattggcccccactctcttctggcttgtaggctttctgcagagagatctgctattagtctgatgggcttccctttgtgggtaacccgacctttctctctggctgcccttaacattttttccttcatttcaaccttggtgaatctgatgattatgtgtcttggggttgctcttctcgaggagtatctttgtggtgttctctgtatttccagaatttgaatgttggcctgccttgctaggttggggaagttctcctggataatatcctgaagagtgttttccaacttggttccattctccctgtcactttcaggtacaccagtcaaacgtaggtttggtcttttcacatagtcctatatttcttggaggctttgtttgtttcttttcattcttttttctctaatcttgtcttcatggtttatttcattaagttgatcttcaacctctgatatcctttcttccacttgattgatttggctattgatacttgtgtatgcttcacgaagttcttgtgctgtgtttttctgctccattaggtcacttatgttcttctctatactggtttttctagttagcaatttgcctaaccttttttcaaggttcttagcttctttgcattgggttagaacatgctcctttatcttggacgagtttgttattacccactttctgaagcctacttctgtcagtttgtcaaactcgttctccatccagtttatttcccttgctagcgaggagttgtgatactttggaggagaagaggcattctggtttttggaattttcagacgttttgcactggtttttcctcatatttgtggatttgtctacttttggtcttttatgttggtgaccttcggatggtgaccttctgtgtggacatcctttttgttgatgttgatgctattcctttctgtatcttagttttgcttctaacagtcaggaccctctgctgcaggtctgctggagttggctggaggtccactcccgacctatttgcctgggtatcaccagcagaggctgcagaacagcaaagattgccttctgttccttcctctggaagctttgtcccagaggggcacctgccagatgccagctggagctctcttgtatgaggggtctgtcgacccctgcagggaggagtctcccagtcaggaggcacgggggtcagggacccacttgaggaggcagtctgtcccttagcagagcttgagcaccatgctgggagatccactgctctctttagcaccagtaggcaggaacgtctaagtctgctgaagctgcacccacagccaccccttccccctggtgttctgtcgcagggagatgggagttttatctataagccctgactggggctgctgcctttctttcagagatgccctgcccagagggaggaatctagagaggcagtctggctacagcggctttgccgagctgcagtgggctctgcccatttccagctttctggtggctttgtttacactgtgaggggaaaagagcttactcaagcctcagtaatggtggacaccccttcccctaccaatctgaagcatcccaggtcgacttcagactgctgtgctggcagtgagaatttcaagccagtggatcttagcttgctgggctccatgggatgggatccactgagctagaccacttggctccctagcttcagccccctttccaggggagtgaatggttctgtctcactggtgttctaggcaccactggggtatgaaaaaaaaaactcctgcagctagcttggtgtctgcccaaatggccgcccagttttgtgcttgaaacccagggccctggtggagtaggcactggagggaatctcctggtctgctggttgcgaagactgtgggaaaagcatagtatctgggccagagtgcaccattcctcacggcacagtccttcaaggcttcccttggttaggggagggagttccccgaccccttgtgcttcctgagtgaggtgacgccccaccctgctttggctcaccctccttgggctacacccactgtctaaccagtcccaatgagatgagctgggtacctcagttggaaatgcagaaatcacctgccttctgtgttgatctcgctgggagctgcagaccaaagctgttcttatttggccatcttgccagcccccagttatttcttttgctatacagaagctttttcatttaattaattcccatctatttagctttgtttgtattgcatttgcttttgggttcttggtcatgaagtctttgcctaaaccaatgtctagaagagattttccaatgttttcttctagaatttttatggtttcaggtcttagatttaagtctttgattcatcttgaattatttctgtataaggtgagagatgaggatccagtttcattcttctacatgtggcttgccaattatcccgacattatttgttgaatagggtgtcctttccccactttatgtttttgtttgctttgttgaagatcagttggctataagtatttggctatatttctgggttctgtattcagttccattggtctatgtgtccatttttataccagtaccatgctgttttggtgactatagccttatagtctagtttgaagtcgggtaatgagatgcctccagatttgttctttttgcttagtctttcttttgctatgtgggcttttttggtttcatatgaattttagaattgtttttctagttccgtgaagaatgacagtggtattttcatgggaattgcattgaatttgtagattgcttttggcagtatggtcattttcacaatattgattctacccatccatgagcatgggatgtatttccatttgtttgtgtcatctatgatttctttcagcagtgttttgtagttttctttgtagaggtctttcacctccatggttaggtatattcctgagttgttcattttattttattttttgcaactatggtaaaagggattgagttcttattttattctcagcttggtcactattggtatataggagagctactgttttgtgtacattaattttgtatcctgaaactttgctgaatttatttaccagttctaggagctttttggatgagtctttagagttttctaggtatacaaacatatcatcagcaaacaggaacagtttgacttcctctttaccaatttggatgcccttgatttttttctcttttctgattgctctggctgggacttccagtactatcttgaatataagtggtaaaagtgagcatcattgtcttgttccagttctcagggggaatgctttcatcttttccctgttcagtataacgttggctatgggttcgtcatagatggcctttattaccttaaggtatgtttcttctctgccaattttgctgaaggttttaatcataaagagatgctggattttgtcgaatgctttttatgtatctattgagatgatcatgtgatttttgtttttaattatttctatgtggtgtatgacatttgttaacttgcagatgttaaaccatccctgcatccctggtatgaaactcacttgatcatggtggattatctttttgatatgctgttggatttaattagctagcattttgttaaagatttttgcatatatgttcatcatgaatattggtctgtagttttctttttttatgtccttccttggttttggtattagggggatactggcctcctggaatgatttagagataatttcctttttatccaatggaatagtgtcaataggattggtaccaattcttctttgaatgccagatagaatgcagctgtaaatctgtctggtcctggacttttgttgttgttgttggcaatttttaaattatcattttaatcttgctgcttgttattggtgtgttcagagttactataacttcctggtttaatctagaagatctttgtatttccaggaatttatcctcttctctaggctttctagtttatgcatgtaaagatgttcacagaagccttaaataatttttttgtatttctgtcgtatcagtagtaatatctctcatttcatttctaattgagtttatttggatcttctctcttcttggttaatctcactaactgtctatcaattttatttatcttttccaataacaagcttttgtttcacttatcttttgtgtcttgtttgtttgtttcaatttcacttagttctgctctgatctttatttcttttcttctgctgggtttgggtttggattgcttttgtttcttcagttctgtgaggtgtgacctcagattgtgtatttgtgctctttcagactttttgatgtaggcatttaatactatgagctttccttttagcaccactctgatggttaatactgagtgtcaacttgattggattgaaggatgcaaagtattgatcctgggtgtgtctgtgagggtgttcccaaaggagattaacatttgagtcagtgggctgggaaaggcacacccacccttaatctgattgggcagcatcttattagctgccagcatggctagaatataaagtaggcagaaaaatataaaaagatgagactgacttagcctcccagcctacatctttctctcgtgctggatacttcctaccctcaaacattggactccatgttcttcagttttgggacttggcctggttctccttgctcctcagcttacagacagcctattgtgggaccttgtgatcatgttagttaatacttaataaactaataggatatatataatatatatcctgttagttctgtccctctagagaaccctgacaaatacagccacttttgctgtatcccagaggttttgataagttgtgtcactgttatcgttcagttcaaacaatttttgatttccatcttcatttcattttgacccaacaatcattcaggaggttatttaattttcaggtatttgtgtggttttgaggattccttatggagtttatttctaattttattccactgtgttctgagagaatacttgatataattttgattttcttaaatttactgagacttgttttgtgccttatcatgtggtctatcttggagaatgttccatgtgttgataaatagaatgtatattctgcagttgttgggaagaatgttctgtaaatatctgttaagtccatttgttttagggtatagtttaagttgatggtttatttgttgactttcttttttgatgacctgtctagtgctgtcagtagagtcttaaagtcccccactattattgtgttaccatctatctcatttcttaggtctagtagtaattgttctataaattcaggagctctggtgttaggtgcatatatatttaggattgtgatattttcctgttggactagtccttttatcattctttaatgtctctgtttgtcttttttaactgctattgctttaaagtttgttttgtctgatataagaatagctacttctgctcacttttggtgtccatttgcatggaatatctttttcctttaccttaagtttacctgagtccttatgtgttaggtgagtctcctgaagacagcagaaacttgtttggtgaattcttatccattgtagaatggattctatatcttttaagtgaggcatttaggccatttacattcaatgttagtactgagatgtgaggtactattctattcatcatgctatttgttgcctcaataccttggtttttttttcattgtgttattgttatatagatcctgtgagatttgtgctttaagtaggttccattttggtgtatttcaaggatttgtttcaaaatttagagctccttttagcagttcttgtattgccagcttggtagtggcgaattctcccagcatttgtttgtctgtaaaagactgtatcttttcttcatttatgaagcttagtttcactggatacaaaattcttgggtgataattgttttgtttaaggaggctaaaaataggaccccaattccttttagcttgtagggtttctgctgagaaacctgctgttactctgataggttttcctttataggttacctgatgctttttcctcatagctcttaagattattttgtttgtcttgattttagataacctgatgactatgtgcctaggcaattatctttttgtgataaattttccaggtgttctttgagcttattttatttggatgcctagatatctaaaggctggagaagttttccttgattattccctcaaatatggttttcagacttttagatttctcctcttccttgggaacatcaattagtcttaggtttgggtgtttaacatagttccaagctttttggaggctttgttcactttttttgttttttaattatttttttctttgtctttgagggattcagttaatttgaaagccttatcttcaagctctgaagttctttctcctgcttgtttgattctactgctgagactttccagtgcattttgcatttctataagtgtgtccttaatttccagaagttgtggttgttttttatttatgctatctatttcattgaagatttttgctttcatatcattgaagatttttcctttcatatcctgtatcatgtttatgatttctttaagttggagttcacctttctctgatgtctccttgattagcttaataatctaccttctgaattctttttctggcaattcaggtattttatcttggtttggatccattgcttgtgagctggtgtgatcttttgggagtgttaaattaccttgttttgttgtattaccagaattgattttctagttatttctcacttgcttagactatgtcagagggaagatctgggaggggctgttcaaattcttttctcccacggggtggtcccttgattgttgttctcacacttcctctagaattcgggcttcctgagagccgaactgcggtgattgtttttgctcttctaggtctagccacctagcggagctactggcttcaggctggtactggagagtatctgcaaagagtcctgtgatatgacccatcttcatgtcttttggccatggataccagcacctgctctggtagagatagcaggggagtgaagtggattctgtgagagtctttggttgtatttttatttaatgtgctggatttgtattggttggcctccagccaggaggtggtgctttcaagagcacatcagttgtagtagtctagggaggaagcaaactttccctagggtcacctggttaagtattcaggtttctcgggtggtgggcagagccatagagctcccaagagattatgtcccttgtccttgcaaccagggtgggtagagaaagaccaccaagtgggggcagggttaggcatgtctgagctcagactctccttgagtgtagcttgctgtggctgctgtaggggatgggggtgtggttcccaggccaatggagttatgttcccacggggataatagctgcctctgctgagtcatacagatcaccaaggaagtaggggaaagctggcagtcacaggctcatcccgcacccatgcagcctgcagtcctaaaggccagtcttactcccactgtgccccctcaacagcaccgagtctatttctgggaatctggtgatcaaggctgagaacttgccccagaccaccagcctcccagctaaaaagcaaggagactcacagtttttcagcatctcagggagcatgcagcagtgctccagttccttcaaagggtctgtggattatctcagcttccctggaatgttgctgtggtacttcttggagcaaaagatcatgatgtgagcctccacacctctctgtctgtccaagtgggagctgcaagctagtgctgcctcctatctgccatcttaattatcttattcttttttatggctgcatcatattcagttgtgtatatgtaccacattgtctttatccagtctaccattgatgggcatttaggttgattccatgtttttgctattgtgaatagtgctgcagtgagcatgtgtgcatgcatctttatgataaaataatttatatctctttgggtagatacccagtaataggattgctgggtaaaatggtagttctatttttaggtctttaagaaaatgtcacactgctttccacaatagttgaactaatttagactcccacttaacagtgtctgtgttcctttttccctgcaactttgacagtagttttgttttttttttttttttttgccttatttatatagagaggtggcattttgctatgtatcctgggctggtctagaactcctgggctcaagtgatccatcctccctccgtggcatcccaaagtgctaggattgcaggcatgagccatggtgcccagcctatttttgactttttaatcatagccattctgactgcgtgagatggtgtctcattctggttttgatttgaatttctctaattatcaggggtgttgaacttttttttcatacgctcattggccacatgcatgtcttcttttgaaaagtgtctattcatgttatttgcccactttttcataggctttttcttgtaaatttgtttaagtttcttatagatgctggatattaggccttcatcagatgcatatggaaaaacattccatgttcatggataggaaaaataaatatcattaaaatggccatactgcccaaagcaatctatagattcaatgctattcctatcaaactaccaatgacattcttcacagaaccagaaaagactattttaaaattcatatggaatcacaaaaagagcccaaatagtcaaagcaatcctaagcaaaaagaacaaagctggaggaatcaccttacctcactcaaaactatactacagagctatggttaccaaaacagcatggtactggcacagaaacagacacatagaacaatggaacagaatagagagcccaaaaataaggccacacacctacaacaatctgatctttgacaagcctgacaaaaacaagcattggggaaaagactccttattcaataaatggtgctgggataattggctagccctatgcaggaggtttaaaatggacccctttcctacaccatatacaaaaataaactcaagatgggtgaagtactgaaatgcaaaatgcaaaagtgcaaaaaccctggaagaaaacctaggcaataccattctggacataggaacaggcaaagatttcatgatgaagacaccaaaaacaactgcaacaaaaggaaaaattgacaaatggggtctaattaaacttaagagctcctacacagcaaaagaaactatcaacacagtaaacagacaacctacagaatgaatgatcattttaatatgttgttgaattcagtttgctagtattttattgacaatttttgcaacaataatcatatggtttggctgtgtccccacccaaatttcatcttgaattgtagctcccataattccctcatgttgtgggagggacccagtgggagataattgaatcatgggcacagtttcccccatactgttctcatggtagtgaataagtctcacaagatctgatagttttataaggggaaaccgctttcccttggctctcattctcttctcttgtctgctgccatgtgagatgtgcctttcaccttctgccatgattttgaggcctccccagccacaaggaactatgagtccattaaacctctttcttttgtaaattgcccagtgtcgggtatgtctttatcagcagcatgaaaatggactaatacagtaaattggtaccaagaatagggtgctacttaaaagatactcaaaaatgtggaagcaactttggaactgggtaataggcagaggttggaacacatgggagggctcagaagaagacagaaaaatgtgggaaagctaggaacttcctagagacttgttgaatggctttgaccaaaatgctgatgatatggacaataaaatacaggctgaggtggtctcagatggagatgaggaacttgctgggaaccggagcaaaggtgacacttgttatgttttagcaaagagactggcagcattttgtccctgccctagagatttgtggaagtttgaacttgagagagatgatttagggtatctggcagaagaaatttctaagcagcaaagcattcaagaggtgacttgggtactgttaaaagcattcacttttaaaaaggaaacacagcataaaatttcagaaaatttgcagcctgacagtgtgatagaaaagaaaatcccattttctgaggagaaattcaagccagctacagaaatttgcataagtaacaaggagcagaatgttaatcaccaagacaatggggaaaatgtctccagggcatgtcagagacttttgtggcagccccttccaccacaggccctgagacctaagaatgaaaaatgattctgtgggctgggcgcagggtccctctgctgtttgcagtctagggacttggtgccctgcatcccagccactccaggcatgactagaagcggccaaagtatagctcaggctgtggctacagagcatgcaagccccaagctttggcagcttccatgtggtgttgagcctgcagtgcacagaagtcaagaattgaggtttgggaacctgtgcctagatttcagagaatgtatggaaatacctggatgtccaggcagagtttgcttcggggtggggccctcatggagaacctctgctggggcagtatggaagggaaatgtggggttggagcccccacacagagtccccatggggtgctgcctagtgtagctgtgagaagagggccaccatcctccagaccccagaatggtagatccactgacagtttgcaccatgtgcctggaaaagccacagacactcaatgccagcctgtgaaaacaaccaggagagaggctgtaccctgcaaagccacaggggcagagctgcccaaggaaacaaggtgagaaaaatgcaaatgcaagtgtcaggatggaccaagtggccagggcatagccaatccattcagtgatctcactggggaaattggcttcagaaacatacataaacaagccaccttgtggattcctataggttatttctccaggcttcctgacctggcactatatacagtcactataaatgttgatttccattcccaaaataaacaagaagacacctaagctaaaccttataaacccaagacaatgggaacccatctctcaagcatcagcatgacccagatgcaagacatgaagtctaaggagatcattttggagttttaagatctgactgccctgctggattccagacttgcatagggcctgtatcccctttgttttggccaatttctcccatttggaatgactgtgtttacccaatgtctgtacccctccattgtatctaggaaataactaacttgcttttgattttactggttcatagatggaagggacttgcattgtctcagatgagactttggattgtggacttttgagtaaatgctaaaatgagttaagactttgagggactgttgggaaggcataattggttttgaaatgtgaagacatgagatttgggaggggccaggggcagaatgatatggtttggctgtgcccccacccaaatttcatcttgaattgtaacacccataattccctcatgttgtgggagggacccagtgggagataattgaatcatggggacagtttcccccatactgttctcatggtagtaagtctcatgagatctgatggctttataagggcccctttcacttggctctcattctcttctcttgtctgctgccatgtgagatgtgcctttcaccttcttccatgattgtgaggccttcccagccacgtggaactgtgagtccattaaacctctttttatttttattttttttgtaaattgctcagtctcatgtatgtctttatcagcagcatggaaacagactaatacaaatatttatcagtgatattggcctatagttttcttttttgatgtgtctttggttttggtatcatggtaatactggccttgtagaatgatattagaagtattttctccacctataattttcagaatagtttgagtagaattggtgtgagttatttttatttttttatttttgagacaggggctcactcatgttgcccaggctggagtgcagtggcacaatcttagctcccttcaaccttgacttcccaagctcaggtgatcctcctacctcagtctcctgagtagctgggactacaggcacgtgccaccatgcctggataattgtttatatttttagtagagacagagggttttttttacttgtatcttattgtactgtctatgtctcaaaacattgttgtagttattatttttgattggttcatcatttagtctttctacttaagagtagtttacaaaccacagttacagtattataatattctgtgtttttctgtgagttttatgccttctggtgattacttatttgtcattaaccttattttttttctgattgaagtactccctttagcatttcttgtagggtatatctggtgttgataaaaagccctcagctttcatttgtctgggaagatttttatttctccatgtttgaaggatgtttttgctggatatactattctagggtaaaagtgtttttctttcaacaccttcactgtgtcatgccactctctcctgacctgtaagattgccactgaaaagtctgcttccagacgcactgaagtgccattgtatgttattagtttcttttctcttgctgctttaagatcctttctttatccttgacctttgagagttggacgttaaatgccctgagatagtcttttttgggttaaatctacttggtgttctatgacattctcgtacttgcatatcaatgtctttctctaggttttggaagttctctgttgatatcccttgaataaactttctatcctatctctttctctacctcctctttaaggccaataactcttagatttgcccttttgaagctattttgtagatttcataggcatgctttattcttttttatgatttttttcttttttctcgtctgtgtgttttaaaatagcctgccttcaagctcattaattctttcttctgcttgatcaattctactattaaaagactttgatgcatttttcggtatgtcagttacatttttcaactccagaatttccactcgattcttttaagttatttcaatctctttgttaggtttacctgatagaattctctgtgttatctcaatttttttttagtttcctcaaaacagttattttgaatctttgtctgaaatgtcacgtatctctgttgctccaggattggtccctagtgccttatttagttcatttggtgaggtcatgttttcctggatggtcttgattcttatggatgtttatctacatctgggcattaaagagttaggtatttattgtaatcttcacagtctgggcctgtttgtacccatcgttcttgggaaggctttaatttggctttcctgctccacctctcctctcttttgcccaatttattttaagacagagtctcactctgttgcccatgctggagtagagtggcatgatcttggctcactgcaacctctgcctccagggttcaagcaattctcctgcctcagcctgccaagtagctgggattacaggagcccaccaccatgcccagctaatttttagtagagatggggtttcatcatgttgctcaggctggtctcgaacccctgacctcaagtgatctgcctgcctcagcctcccaaagtgctaggattacaggcatgagccaccacacttggcgtctcttgcccatttttaaagttgggtagttagttgttgagttgtgttctttatttgtatttttatatgttatagatacaggacttttttattttcttaataattcttttgaaaagcaggacattttatttttgctctatcccagcttattgaatttttctcttctctccctcctctgaattccagtcacattgaccttctttcagttctttatacatgccatgctcaagcctattgcaagacctttgcacatgttattccctgtttagaatgccctcttcgtgcccattcatctaattaactgttacttatcctttgaacttagtttaaatgctacttcctcagggaaggccttccctgacagaccccatatagatttctcagagtttctctgttatacactcataaaatgcacttcctttcttcaaataatttatctctgtttaaaactgagagttaatttgggggaatatttttattttaatatctggtgtgtatatatatatgtatatgtctggtatatgttacacacataatttgttcagtgaatattcattgggtaagtaaatgagtaagtgaagaaagagggtccaccaataaactcaagtgcatataaaatttcaaagcagaaaaagtgttttccatcagtagaaaaaatgatggctgatatagtttagatatttctccttgcccaaatctcatgttaaattttaattcccaattctggaggtggggcatggtggaaagtgtttggatcatgagggcaaacctctcatggcttagtgctgccctcatgatagtgagtgagttctcatgagatctggttgttgtaaagtgtggcatctcatcccccactctctctctctctctctcactcctgctttcgccatgtgaagtgtctgctcccagttcaatttctgctatgagtaaaatttccctgaggcctccccagaagctgagcagatgctggtgccatgtttgtacagccagcagaactgtgagccaattaaacctcttttcttataaattatccagtctcaagtatttctttagagtaatgcaagagtgacctaatacaatgatgtatcaggctgtgtttgcaatactataaaaaaaatctgagcctgggtaaattataaagaaaaaaagtttaattgactcatagttctgcagatattacaagaagcatggtgctggcatctgattctggtgagggccttaggaagcttacaatcatggtggaaagtgaagagggagcaggtgtctccatgctgaaagtgggaacaagagagcaaggggggaggtgccacatacttttaacaaccagatctcgagggaactaactgagcaggaacaaacttattaacaagatgatggtgctaaaccattaatgagggatccgcccccaggatccaatcacctcctaccaggccccacctccaacattggagattacatttcaacatgagatttggaggggacaaatatccaaaccatatcagatggatttatttaatgaaaggcataagactattaactatttgtaaaaatttaaaaatactaaagaagtcctcatacacttcttacaccaaaacaaaatccaaataaatgaaacaaatgcaaaaattaaaccatgatggtactagaagaaaacgtgatagaaaatccttatggtaaatcaaaatataaaaataaagtaaggaaatatgttttttgtaatcttgatgtatataagcagatcagaaaagccagaccacgtagagaaaaagcatggtagatctcatgtaaatttaaattttacataatccatgtttttaaaattacatgtaacatatatcacaaagagttaatgtctttaaaatacaaataatttttccaaacaataagaaaaagtcattaccttcataaaaaaattaaaaactgtcataaacaaacaattcacaaaataaggaaatggccaatggccatatggaaaggcacctttcagaaaggaaatttggtggagggaggagccaagatggccgaataggaacagctccggtctacagctcccaggatgagcgacgcagaagacgggtgatttctgcatttccatctgaggtaccgggttcatctcactagggagtgccagacagtgggcgcaggtcagtgggtgcgtgcaccgtgcgcgagccgaagcagggcgaggcattgcctcacttgggaagagcaaggggtcagggagttccctttctgagtcaaagaaaggggtgacagatggcacctggaaaatcggatcactcccacccgaatactgcgcttttccggcgggcttaaaaaacggcgcaccacatatcccgcacctggctcggagggtcccacgcccacggagtctcgctgattgctagcacagcagtctgagatcaaactgcaaggtggcagcgaggctgggggaggggcgcccgccattgcccaggcttgattaggtaaacaaagcagcccagaagctcgaactgggtggagcccaccacagctcaaagaggtctgcctgcctctgtaggctccacctctgggggcagggcatagacaaacaaaaagacagcagtaacctctgccgacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtactcaaacagacctgcagctgagggtcctctctgttagaaggaaaactaacaaacagaaaggacatccccaccaaaaacccatctgtacatcaccatcatcaaagaccaaagtagataaaaccacaaagatggggaaaaaacagaacagaaaaactggaaactctaaaaagcagagcgcctctcctcctccaaaggaacgcagttcctcaccagcaacagaacaaagctggatggagaatgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaaggctcaggagccgaagcgatgaactggaagaaagggtatcagcaatggaagatgaaatgaatgaaatgaagcgagaagggaagtttacagaaaaaagaataaaaagaaatgagcaaagcctccaagaaatatgggactatgtgaaaagaccaaatctacgtctgattggtgtacctgaaagtgacggggagaatggaaccaagttggaaaacactctgcgggatattatccaggagaacttccccaatatagcaaggcaggccaacgttcagattcaggaaatacagagaacgccacaaagatactcctcgaaaagagcaactccaagacacataattgtcagattcaccaaagttgaaatgaaggaaaaaatgttaagggcagccagagagaaaggtcgggttaccctcaaagggaagcccatcagactaacagcggatctgtcggcagaaaccctacaagccagaagagagtgggggccaatattcaacattcttaaagaaaagaattttcaacccagaatttcatatccagccaaactaagcttcatgagtgaaggagaaataaaatactttacagacaagcaaatgctgagagattttgtcaccaccaggcctgccttacaagagctcctgaaggaagcactaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacacatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaaatatcctaaatatatatgcacccaatacaggagcaccaagattcataaagcaagtcctgagtgacctacaaagagacttagactcccacacattaataatgggagactttaacaccccactgtcaacattagacagatcaacgagacagaaagtcaacaaggatacccaggaattgaactcggctctgcaccaaggggacctaatagacatctacagaactctccaccccaaatcaacagaatatacatttttttcagcaccacaccacacctattccaaaattgaccacatactgggaagtaaagctctcctcagcaaatgcaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaagggtcaacaaaattgatagaccgctagcaagactaataaagaaaaaaagagagaagaatcaaatagacgcaataaaaaatgataaaggggatatcaccactgattccacagaaatacaaactaccatcagagaatactacaaacacctctacgcaaataaactagaaaatctagacgaaatggataaattcctggacacatacactctcccaagactaaaccaggaagaagttgaatctctgaatagaccaataacaggagctgaaattgtggaaataatcaatagcttaccaaccaaaaagagtccaggaccagatggattcacagccgaattctaccagaggtacaaggaggaactggtaccattccttctgaaactcttccaatcaatagaaaaagagggaatcctccctaactcattttatgaggccagcatcattctgataccaaagccaggcagagacacaacaaaaaaagagaattttagaccaatatccttgatgaacattgatgcaaaaatcctcagtaaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtgtgcagacgacatgattgtagatctagaaaaccccattgtctcagcccaaaatctccttaagctgataagcaacttcagcaaagtctcgggatacaaaatcaatgtgcaaaaatcacaggcattcttatacaccaacaacagacaaacagagagccaaatcatgagtgaactcccattcacaattacttcaaagagaatgaaatacctaggaatccaacttacaagggatgtgaaggacctcttcaaggagaactacaaaccactgctcaaggaaataaaagaggttacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacacagccctcagaaataacgccgcatatctacaactatctgatctttgacaaacctgagaaaaacaagcaatggggaaaggattccctatttattaaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcgtgtctaaaacaccaaaagcaatggcaacaaaagacaaaattgacaaatgggatctaattcaactaaagagcttctgcacagcaaaagaaactaccatcagagtcaacaggcaacctacaaaatgggagaaaattttcgcaacctactcatctgacaaagggctaatatccagaatctacaatgaactcaaacaaatttacaagaggaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcactccagttagaatggcaatcattaaaaagtcaggaaacaacaggtgctggagaggatgtagagaaataggaacacttttacactgttggtgggactgtaaactagttcaaccattgtggaagtcagtgtggcgattcctcagggatctagaactggaaataccatttgacccagccatcccattgctgggtatatacccaaagaactataaatcatgctgctataaagacacatgcacacgtatgtttattgcggcattattcacaatagcaaagacttggaaccaacccaaatgtccaacaatgatagactggattcagaaaatgtggcatatatacaccatggaatactatgcagccatagaaaatgaggagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggataacatcaggagatatacctaatgctagatgacgagttagtgggtgcagcgcaccagcatggcacatgtatacatatgtaactaacctgcacaatgtgcacatgtaccctaaaacttaaagtataataataaaaaaaaaagaaaggaaatttggtaagatctatcaaaatgggaaatgtgcatacattttactgaccattttcattttaaagattaaccttaaagatataatctcagaagtggaagaagctatatgcccagaaatgtttgtttctgaagtgcttagagtagtaataattttggaatatcttaaatgtctatcaataggaaaattatataaattctgataatatataaaatttattattattattatgtacccatcacagttgtaactttacatataatgagattatttgcttccctatatctctctgtccatagatgatggagtacatgagattaagaatgtccatgtttgtctctagcaactggctcatttcctattaggaactaaatacatacttattgaacaaacaaatgaactgaggtctctctttatcttaataggctggaagtgatggagagagtattggaaactgtcccttttgccaacgccttttcatgatcctctggcttaaaggagttaaatttaatgtgacaactgttgacatgaccaggtaagagaaatcaggacatgttaaattctaggaattgagattggtagataccaataaaatattggtgtttatttaatgtgtactttatctagagacctaactctgcttatttttaataatcatagaaagcctgaagaactaaaggacttagccccaggtaccaatcctccgttcctggtgtataacaaggagttgaaaacagacttcattaaaattgaggagtttttagaacaaaccctggctcctccaaggtacagcatttacaagatactattttgctgaagataatctattttactggcttgtttattgcagatttagtattcttaccaatttaagtacttttggatttctgggcctacatgtcaaatgacacacatgcataaacatacccctccaacttcaaatacaaaaagatgatatgtgtaatatttcaaataatttttaaaagctgcataacatacataacacaagaaggtaagttctctgtgctctagaaatagagtaggaacatatagtgagatgggagtgagggaatgggatactaacactatgtaattcataaggattggtcatgactggtccttaacaccactgacgaaatgacagaacatacccaacacgagggctagtggccaggacatagacttcaagcagttaaccagaggccagaactgtactgcctacacttgaatgacaaccgcacatctctgtctacccaggataggtctagaaacaagaagcatgctgtattaattttctattgctgtgtaacaaattaccacaaacttagtatcttaaaacaacagctatttattatctcacagcttccattggtcagttgtctgggcatagcctgctaaggtcctctgctgagggtatcaaaaagtggcattcaaggtgttggtcgggaacacagttatcatatggggcccaggtgactcttccatcttcattcaagtttttggcagaattcagttccttgcagctatatgactgaggtcttaggttattgggtagctgtttgttggggttgggttggcattcaattactagaggctgcccctctgtataggcatttcgcaacatggctgattgttctcttcctctaaaacctgcaggagaatgtctctctgatggttcaccttcttcttttttttttttttttttttttttttttttttttttttttgagacggagtctcgctctgtcgcccaggctggagggcagtggcacatgttggctcactgcaagctccgcctctcgggtctcgggttcacgccattctcctgcctcagcctcccgagtagctgggactacagatgcccgccaccacgcccggctaattttttttttttttttttgtaattttagtagagatgaggtttcaccgtgttagccaggatggtctcaatctcctgaccttgtgatccaccggcctcggcctcccaaagtgctgggattacaggcgtgagccactgcgcctggcctgatggttcactttcttttaaatttttttatcagtacaaattatgggatacatatgaaattctattatgtgtatgtaatgcatagtgataaagtcaaggtatctacggtgtccataacccaaatacaatacatttttgtaactatagtcaccctgctcttctatcaaacattgaatttattccttctatcttatttatgtgtgtactttttaacacacttctcttcatcttcccttctcctcccaatcaccctccccagtctctgttatctctctttccattctctatcttcatgtgatcaacttttttaactcccacatataagtgagaacatgctatttttgtctttttgtgcctggcttatttcacttgacataacaactccagttccatccatgttgttccaaatgacaggatttcattctctttaatggctgaatactatttcattgtgtatgtataccacactttctttatccatttatctgttgatggacacttagatcgattccataccttgtctattgtgaataatgcaataataaacatgagagtgcaggtatccctttgacatactgatttctcgtgctttggataaatgccaattagtgagatttttggatcttatggtagtgctacttttggttttttcagaaatctccatgctgttttccatagtggctatatttatactcccaaaaacagtgtataagagttcctttttctccacatccttgccaacgtctgttaatttttttttgtctttttaataatagcaattctgactgaggtgagatgatatctcattttggttttggtttgcatttctctgttgattagtaaagttgagcatttctttatgtacattttggccatgccctttgcccatattttatgagattttttttattgttgagttgtttgatttccttgtatattctggatattagtcccctgttgaagtttgcaaacatttcctctcattcaaaaggttgtctcttcactcatttcttttgctgtgcagaagctttttagtttacttgagtcctatttgtctatttttgtttctattgcctgtgcttttgacatctcaatcataaattatttgtctagaacaatgtccagaagaattttccctaggttttctcttattatttttatagttttgagtattatgtttaagtcttcagtccattttgagttgatttttgtatacagtgagagataaggatcaagtttcattcttctgcatatggctgtccaattttcccagtaccattaattgaaaaaggtgtcctttccccaatgttcttgtgaactttgtcaaagatcagctggcagtaaatatgtgaatttatttctaggttctctattctgaccattgctctgtgtgtctatttttataccataacatgctattttggttactatagccttgtaatatatttcaaagtcaggtaatgtgatgcctctagctttgttctttttgctcagaattgctttggctatatggaatcttttttggttacatgtgaattttagtattctttttttgtaattctgtgaaaaatgacattggtattttgacagggattgcattgaatctgtaggttactttgggaaaatcacaattttaataatattcattcttctgatccatgagcatgagatgttttcccatatatttttatcattttcaattcctttcattagcattttgtagttttcattgtaaagatcttccacctccttgattaaaattattcctagatattttaatttttagctattgtaaatggaattgccatcttcatttcttttgtgggtagatcattattggtgtatagaaatgctacatattttttagtgttgatgtttttaacctggaactttactgaatttacttatcaaatctaagaattttttggtggagtttttaggttttactagatacaagatcatggcaccagtaaaaagggacaattttacttcctttttcccaatttggatgccttttatttctttctcttgcctgattgccatacctaggacttccaatactatgttgaataggagtggtgaaagtgggcattcttgtttttttccatttcttggaggaaaggctttcaatttttccctattcagcatgatatcagctgtgggtttgtcatatatagcctttattattttgacatattttccttctatgccccatttgttgagaggttttatcatgaaggggtgttgaattttatcaaatgctttttctgtatctattgagatgatgatatgttttttgtcctttattctatggatgtcatatattgaggttattgatttgcacatgttgaaccattcttgtatcactggtataaatcccacttgatcatggtgtattatctttctgatatgctattggattcagtttgctagtattttgtcaagagtttttgtatctatgttcatcagaaatattggcctgtagttttcttctatgtgtgtgttcttgtctggtttttgtatcagggtggtgctggcctcatagaatgagttaaggagagttctctcctcttccattttttagaatagtttcaggagaattggtattagttcttctggtagaatttgtcagtgaatttgtccagtcctgtgcttttcttcattgggagacttttttattactgactcaatcttgctactcattattggtctgttcatgttttctatttcttcccaattcagtctcagcacattgtatgtttcctggaacttatccatttcctctaggtttatcagtttgtcagcatacagttgtacataatggtctctggtaatcttttgtatttcttacatatatgacttaatgtgtcctttttcatttctaatttgtttgtttgggtcttctacttttttggttagtctagctggcagtttatcaatttaacaaaaaccaactttttcaatcatgatgctttgtattttttagtctgtatttcatttagttctgttctttattacttcctttttctgctaatttggtatttggtttgttcttgcttttctagcagcttcacatacattattagattgttaatttgtcattttcctacttttttcatgtaggcatttattgctataagcttgcctcttagtgctgcttttgctgtatcccacaggtttatgtatgttatgtttcaattttcatttgtttcaagaattttttttcttcttaaattctttattgaccattggttgttcaggagcatgttggttaatttttatgtatttatgcagtttctaaagttcctcttggtgtttatttatagttgatttgatttcattgtggcctgagaatatccttggtatgattttcattgtgttaaatttattgagacattttgtggcctgacatatggtccatcctggagaatattccatgtgctgatgaatgtatattctgtagttgttggatagaatgttctgtaaatgtctgtttggttcatttggtctaaagtccagtttaagtctaatgtttatttgttgattttctgtctagattatctatctaatgttgacagtgggatgttaaagttccttcctattattgcactgcagtctgtctctacctttagatctagtaatgtttgctttatgaatctggatgctccagtattgggtgcatatatatttaggattgttatatcttttttgctgggttgatctgtcattatataatgatagttttagtccttttttcactttttttgatttaatgtctgttttgtcttatatgattatagctaatcctgctcacttttggtttccgtttgtgtgaaatatctttatcaacccatttcagtctatatgtgtctttactagtgaggtgagtctcttgtaagtactatgtagttggattatgttttttaagtctattcatccagtgtatgtcttttaagtggaatatttaatctgtttatgtttacatgtgaagacttatttctgtcattttgttatttttttctggttgttttgtatattctttgttttttttctctctctcttgtcatttatcattacagtttggtggttttgtgtagtggtaatatttgagtcctttattttctttatatccaggcaagaaggatggccactattctcacactgggagcagtgtataagtgattcagcctttcctttcttgttggactccttacccttcagacaaattccacatatagcatttggaatgactttgggcttgtacccaggaactgagttggacagtacagaacgtttgggagcatcttttcttggagtggcagctttgtcttttgatttctgtcttccctggaaagagtcctcctggctgtcaggagagctttccccttcagataccttgccagaggagctgtccgaagtgcctttatttttccgcttctcatcacctcaaccatcttcgccgtcatctgaatcaccgtcactgtctagagcagggagctcaggatccagagtggcctcgtacagggctgtgtttaatggcagataccacagctcatctggtgagtacctcttataatattcctggaactgtccggggatgagagccactgggtaagaactgacctttgttcgccctgttggcaaaacttcctacttcccttgaggcacctggataacgtgtctgcaagtcaaaataagctcttctttcttccatgcgttcccggtttaagttgctgctttttttggcagcttttttatttgtttgtttgtttgtttgtttgtttgtttgtttgttttgagacggagtctcgctctgtcgcccaggctggagtgcagtggcgcgatcttggctcactgcaagctctgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgtctcggcctcccaaagtgctgggattacaggcagctttcttaatatactcaggcactttactggcttcaactttctgagtattctgttgttacatttgggaatactctttgtaatggtctgtaattcgttgacgttctttttcttgtagaataacagaatactcagcatgtttggctggatattcctttatcgttaaaacaatcacttcatcactgcccagttaaacctagagtgcattgagtttcagtaatgacatttggctctctcaggtagagtttctccttgtgagacaaatctcgtctctctaaatctggatatttccttttaaaggaggtcacacccaaatattaactgacttgttcttgaagcatatagtattctcctgtttcatcaggtggccatttgtactctatcaaattttatgctggatagtaactaaagccaagatcttgacttgaagtttcacagctcctagaaccatctcctgagcccattcgcctctttttggatgcctgggtccggtcatttgaattatcttcaatttcatccttcgaggactgcgctccgggggtggctgggtcgctgtcgcatggccgcggggctgcgggcgggaatggagaaggtcctgcggcggcggcagcgctcctgacatccgtccgaccccatttttttaaatatctgttttattcagcatactctttcccaacatatctgtaatactaggcattagcactctttttacatctgtgccaatataacaggtgtagtgacatctcattgatacttaacttgtatttccttgaatgatagatacatttaagcatctttacctatgttgtttgatcatttggttttgttctcctgtgaatcatcttgtcaaatccgtctgattttctattagcttcatactgaataggcaaaagctggaagcattccactttaaaagaggcacaggacaaggatgcccttcttaccactcttatttaaaatagtattggaagttctagccagagcagtgaggcaagagaaagaaataaagggcatctaaataggaacatagaaagtcaaactatccctgtttgcagacgacatgattccatatctagaaaaccccatactcggctgcactcagcatcggagccaggagctagtggccgccgccacgtcccaccagacctgcatccaagcaagtgaagatgttaaagagatcttgccagagccagaaatggaaagtacagacctctgaaaatatctattgaaaatgggcaacttatgattggatcatatatagtcagccttcagattcctgggataacgattatgattcctttgttttacccctgttggaggacaaacaactgtgctatatattattcaggttagattctcagaatgcccagggatatgaatggatattcattgcatggtttccagatcattctcatgtccgtcaaaaaaggttatatgcagcaacaagagcaactctggaaaaggaatctggaggtggccacgttaaagatgaagtatttggaacagtaaaggaagatgtatcattacatggatataaaaaatgtttgctctcacaatcttcccctgccccactgactgcagctgaggaagaattatgacattaaaatcaatgaggtacagactgacgtgggtgtggacgctaagcatcaaacactacaaggagtagcatttcctatttctcgagaagcttttcaggctttggaaaaaataaataacagctgaactatgtgcagttggaaataaacataaaaaatgaaattataattttggccaacacaacaaatacagaactaaaagatttgccaaagaggattcccaaggattcagctcgttaccatttctttctgtataaacattcccatgaaggagactatttagagtccatagtttttatctattcaatgcccagatacacatgcagtataagagaacggatgctgtattctagctgcaagagccctctgctagaaattgtagaaagacaactatggatgttgtaatggatgtaattagaaagattgagatagacaatgaggattagttgacttcagacttcctttgtgaagaagaagtacatcccaagcagcatgcaggaaaaagaagaattcgaagactaattaggggcccagcggaaaatgaagctactactgattcaagtcatcacattaaacatagcaatactagttttttaaaagtccagctttcaatacaggagaactgaaatcattccatgttgatataaagtagggaaaaaattgtactttttggaaaatagcacttgtcacttctatgtactttttaaattaatgttacataagagtcatgatttctatttttgacttaaagctagaaaagagttcaacataatgtttaattttgtcacactgtttttatagtgttgattctacactttcacatacttgttaaaattttatacaattgagccagttctagaaagtctgatgtctcgaaggataaacttactactttcttgtaggacagaaagaccttaaaatattcttatcacttaatgaatatgttaaagaccaggctagagtattttctaagctggaaacttagtgtgcctcggaaaaggccagaagttgcttattctgagtagctgtgctaactctgtcagactataggatcatctctgcaacttttagaaatagtgctttatattgcagcagtcttttatatttgacttttttttaaacagcattaaaattgcagatcagctcactctgaaactttaagggtaccagatattttctatactgcaggatttctgatgacattgaaagactttaaacagccttagtaaattatctaaggctctgtgaagccaaacatttatgttcagattgaaatttaaattaatatcattcaaaaggaaataaaaaatgttgaaagagttttaaaaatcaggattgacttttttctccaaaaccatacatttataggcaaattgtgttctttgtcacttctgaacaaatattcagatttaaaattactttaaagtcctagtatttaacaggctaacacagataaacaccttaataatctcctttcaattaatattgtatttcaaaccacatttaactgtcttctaatgctttgcattttcagttacaacctagagagattttgagcctcatatttctttgatacttgaaatagaggaagctagaatacttcatgtttagtctgttaaacctgctacaaaaaccataactttgaggcattttctaaatgagctgtggggatccaggatttgtaatttattgatctaaactttatgctgcgtaaatcagttatcagaaatgcacatttcatagggtgaaacactcattttttttttttttgagacggagttttgctcttgttgcccaggctggagagcaatcgcacgatctccgctcactgcaacctctgcctccagggttcaagtgattctcatgcctcagcctcccaagtagctggtattacaggcatgtgccaccatgcctggctaattttgtatttttagtagagacggggtttctccatgttggtcaggctggttgtgaactcccgacctcaggtgacccgcccgccttgccctcccaaagtgctgggattacaggtgtgagccactgcgcccggccaaagcacttatttctaaaccttattatctaaggtaatatatgtacctttcagaaatttgtgttcaagtaagtaaagcatattagaataattatgggttgacagattttttatatagaatttagagtatttgtgtggggttttgtttgtttacaaataatcagactatagtatttaaacatgcaaaataattgacaataatgttgcacttgtttattaaagatataagttgttccatgggagcacacatggacagacatacatacacccaaactattgcattaagaatcctggagctgtgttgcagaccatagctgaagcagttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaacctatgattgctgaaaatcagtgatgcatttgttatagagcataactcatcatttacagtatgttttaggtggcattatcatacctagacaatgaataacatattcccaataaatttatatagcagtgaagaattacatgccttctggtggacattttataagtgcattttatatcacaataaaaaatttttctcaaagaaaaccccatactctcaacccaataggtccttcagctgataaacaactttggcaaagtttcaggatgcaaaatcaatgtacaaaaatcacttgcatttctatacatcaacatcagccaagctgagagcccaattgggaaggcaatcccattcacaattgccacacacaaaaaaataaaatacctgggaatacagctaactcaggaggtgaaggatatctacaatgagaattacaaaacactgctcaaagaaataagagaagacacaaacaaatggaaaaatatcccatgctcatggataggaagaatcaatatcaacaaaatgaccatactgcccaaagcaatctaaagattcagtgttatttctaacaaactaacaatgacattcttcacagaactagaaaaaactattttaaaattcttatgaaaccaaaaaagagcccgaatagccaaggcaattctaagcaaaaataacaaagctggaagtatcgcattagccaacttcgaactatactgcaaggctacagtaagcaaaacacagcatggtactgatacaacacctgtaatccctgcacttttggaggccgaggcaggtggatcacctgaggtcagctgttccagatcagcctggccaacatggtgaaaccccatctctactaaaaatacaaaagttagccaggcttggtgacacacgcctgtaatcccacctactcaggagaccaaggcaggagaattgcttgaacctgagagatggaggttgcagtgagccaagatcacgtcattgcactccagcctgggcaacagagtgaaactctgtctcaaaagaaaaaaagaaagaaagaaagaaaaaaacaggcacatagaccaatgggacataatagagagcccagtaataaggccgcacacctacaaccatgtgatttttgacaaagctgacaaaagcaatggggaaagcactccctgttcaataaatggtgctgggctggctagccctatgcagacgattgaagctggacccgttccttataccatatacaaaaatcaagatggattaaagacttaagtgtaaaacccaaaactacaaaaacccagaagacaacctaggcaatgccatcctagacataggaacaggcaaagatttcatgacaaagatgtcaaaagcaattgcaacaaaagcaaaaattgacaaatgggatttaattaaatgaaagagcttctacacagcaaaagaaacaatcaacagagtaaacagacaacctacagaatggaagaaaatttttacaaactatgcatctaacaaaggtctaatatccagtgtctataaggagcttaaataaatttacaagaaaaaaatcgcattcaaatgtgggcaaaggacatgaacagatgaacagacatacatggggcaaattagcatatgaaaaaagctcattagtgatcattggagaaatgcaaatcaaaaccacaatgatataccatctcacacaagtcagaatggctaaaaataaaaataaaaagtcaagaaatagcagatgctggcaaggttgtggagaaaagcaaacacttatacactgtcagtgggagtgtaaactagtgcaaccattgtggaagatagtgtagtgattcttcaaagagctaacagcagaactaccatttgacccagcaatcccattactggatatatacccagaggaatataaatcattctaccataaagacacgtgcatgagaatgttcattgcagcactattcacaatgacaaagacatggaatcaacccaaatgcccatcaatgacagactgaataaagaaaaggtggtacatatataccatggaatagtatgtagccatagaaaagaatgagatcgtgtcttttgcaggaacatggatggagctacaggctattattcttagcaaactaacacaggaacagaaatccaatactacatgttcgcatatataagcgggagctaaatgatgagaactcatgaacacaaagaagggaacaatacacactggggtgttcttgagggtggagggttggaggagggaaaggagcagaaaagataacaactgggtactgagcttaataccttggtgatgaaataatctgtacagcaaattcccatgacatgagttcacctatgtaacaaaccttcacatgtatccgaaactaaaataaatttttttaatgaaataaatatggtttttggggggcctcctctttcggctttggagcccccctccctctgtctcggtatgggggagtttcttccttctgtcttctcccttccttcttgcctattaaactctccgctccttaaaaccaaaataaaaaaaaaagaaagaaagaaatatggtttttatttttctcacataagaaactcagaatgaacctaggatgatagctccgtaatttcattagggatttcaactcctaatctttcttctctgccatccttcaagtgaggcttccagtctcaaagttaactcatggtgacaatatgtctgctggaactccaggcaacagatctaatatacaagtcagctctaaggagttttcacagaagccacacccaaaaatttccatttacagctcattgtccagaggtaattcatgtggttagatctaagtagtggtatataagtgtgttatctgccatagtttgcccctctgaccacccaaataaatgtatgtatccctcttctcacatatggaacacacagttactacagtcggcttaaagtccagtacctttggatgatgtgcaatatctccattagatactaatggtcaagcagtcaaatatattaaaaattatctccacccactctttgacacacccatttttaaaagtgaagattcgataacacacaacaaccactggttcatactagttcataatagttaccatgacttgaaaaaggactgaaatattgtttctacgttttattgttacaaacactgctaaaaggaattgtctttttacaaggccctccacaacggttagtcttccatattgctggatatgggaacccttccatatgaactttgttttatctactttttaaaagccttgtaaacacccacattaatggaaatggtggagtagggaattccagaactccattctttcataaaagcaatgaataggctggcaaaactgtcagaagcaactttttcagaactctggaatctaagcaaaaattacagcagccaggagaacacttaatgaataaaaaatttaaatttcagtgagagttctgtggcatttttggttaccttgagaccatcctccaaccctcagcccatcaatagtcttaaaaatggcagcttatattgcaggtgcaggttactggtaccagaggaagcgatattgaccttattttcaatgaactgtgattgtgtagtttgatctatctggtggttccctgaaggattacctcaatggtttacctttttatcacctgcactagagcttccccagggctgaggcaccttccctggtgctggttgtggaaagaattttaaagcaaatgtattagtcacagctacacagaacaaggaataacatctgggaaaagcaatagacaaatggaaaaatcccaggaagggccaggcgcggtggctcatgcctgtaatcccagcagtttgggaggccgaggcgggcaggtcacctgaagtcaggagttcgagaccagcctgaccaacatggagaaaccccatctctactaaaaacacaaaattagccaggcgtggtggtgcatgcctgtaatcccagctactcgggaggctgaggcaggagaatcgcttgaacctgggaggcagaggttgtggtgagccgagattgcgccattgcactctagcctgggcatggacaacaagagcaaaactccatctcaaaaaaaaaaaaaaaaaatcccagggagaaagaggctgagatacttgggggatgcttagggaaataatggcttcaaaacattttatgtattctgaggactatagaagactatgcatggacccatttctagatgtgtgctcacaaaagaactgagaagactaggctctcaattctggctaaatttcaggcactgcacaagcagaaaatgaaggcaaaggcagaactttaaactgtatagctaagcaatgaaggagagccccaacacagaaccaaccctcaaaaactaagaaagctttttgttttcatagtttgtttctttgttttgcttccaggagtttaataaaatctctgtaaaatcaataactgactaaagctaatggaacaaatatttcagaggccacacataccaaaaaaatataggctttacaaaattagttaagaaaattaactaaaccaacaacaaccacaataagcagcaacaacaagaccaggggactgggagaatcaatcagatttccagagtttctacattataacattcaaaacatctggttttcaagaaaaaaaaaaaactgaggcatgtgaggaaacaagaaagtatggcaaggacaaaaaaccaaacaccgcatgttctcactcataggtggaaattgaacaatgagaacacttggacacaggatggaacatcacacaccggggcctgtcggagggtggggagggatagcattaggagatatacctaatgggcgcagcacaccaacatggcacatgtatgcatatgtgacaaacctgcatgttgtgcacatgtaccctagaacttaaagtataataaaaaaagaaatgaaaaaaatacattgcatagaagaaatacgatcatacatttatagcatttagcacaattcctgacataataaaatactcaataaaacaacaacaacaaaaagaaaaacccacagctgacattgtactcaatagtgaaggactgaagtttttccccttaagatcagaaacaagacaaggatgttcattgtggttggaaaaaataattgatgtaatttcaatcttcttaagtggttaagaattgttttgtggcctaacatatgatctatcctggtgaatattctgtatgcacttgaaaataatgtgtattctgctacagttgcccaaaatctggggttgaagaagccagcttagttctgggtcgggcctgaagcctggggctctgtgggtcagccttttttggactcggttggagcctggtctgggcctgaagcctgagcttgaatgggccagcctgaaatctggggccaccagggatggcctggagtctgtacccatgagggctgtattggaggctgaatgtttggatgctgacctggtacctgtggccatgggggccagcctggagctgaggtccatgggtgtcaacgtggcactgggacagacccaaagcctgggagtgtgaaggccagcctggagctgagttggtctggatactgggtctgtgggtattggccttaaactggggtccaaaggtgctagtcttgtgatggagagggcctgaaagctgagtctgggggtacagtggctgtcctgaagcaaaggggctgtcttggaggggtgcaagcctggaggtatgatctggtgctgaaggaagtctggagtctggggctactggcccagggctgggagactacatctgcagggatggcctggacattggggctacaagggctggcctactgcccaagtctgtggggaccagcctaaagtctggggtaatcatggcctgtccagggctagactttactgtgttgggcccagtgtttgggtctgaggcaaagtctggtgttcacttacctcttcttctcccaagcaaagggcatctctctccatactgtgggttggagaaggcataacacaggtaatttaaaactgtcctgctaaggtgaaaaataaagcaaaaaagagaagtagtgatgttagggaaaggagtgatgttgcaacgttacaattgagcgtccagagaaaggcttcacttagaaagagatacccatgaaaaagacctgaaagaaaagtgggagcaagggatgtccatgtgtccccctcacctacgggcagaccaagttaaaaggctctggggtaggagctttccaggcctatttgaatggtagcaagaaggtctgtgtcataattgagcgagtgagggatatgagagaagagaggtaaggtgggatcacatcatgtggatccttataggctactgtaatgagttaggctgtgactcggtaagatgagacgactgcagactactgagtaggggaaagccatcactctggcttctgggtggttaatagactgggtgggaaagaaggtggttcatatcatgtgggtccttgtagaccactatgagcacttgggctctaactctgagatgaggacattgcaggctaatgagtaggggaaagacatgacatgacttacattttaacatgattgctctgtctatgggtggagaatattccaggtgtatgagggacaagtatgggaatagggagaatagtcaggaggctgttacagtaatataggctttggactgggcaggggcgcgggggtggacagattctggatacattttgaaaggtaagctgaccagagttgctaatagatcaaatgtggagttagaaggaaagagaggaatcaaggaagatacctaagtttttgacctgaccatttctagcttccagtgaatttttttttatgaaaaggaattgagtgttttagcctttgtttgtattgtatatatttaaggtatatcacatgatgtcttgatatacatatatatagtgaaatgattactacagtcaagtaaattaacatatccatcgcttcatatagttatcttttttatatggtaagagcacctaaaatctaccctttgcaaattttcagtatacaatattattagtcctcatattatacattatatctctagacttactcattctacataactgcaactttgtacccttcgacctacatctccctctttcctccccccactgccccggtaatcactgctctattcttttttctatatatttgacctcttaaagatgccacacataagtgagatcatggagtatttgtctttctgtgcctggcttatttcacttaacataacgtcctccaggctcatccacgttgttgcaaatgacaggatttcattctttttaaggctgattaatattctattacatatatatatatatatatatatatctcacaatttctatatccattcatctgttgatgggaacttaggttgtttctatatgttagcttttgtgaataatgctgcagtgaacatggcagcacagatatctccatgaggtgctgattttttattgaatacttttctgcatctagtcattatcaaatgggttttcttatttgatttgttaatgtggtgaattatattggctacttttttcccattttctccatcctatttattccaccatttgttttataagttgtaatatttgaaaccatatttttctttttctttttctttttttgagactgagtttcacttgtcccccaggctggagtgcaatggcgcaatctcagctcactgcaacctccacttcccagcttcaagcaattctcctgcctcagcctcccaagtagctggaactacaggcgcccgccaccacgcccagctaatgtttgtatttttagtagagacaaggtttcaccatgttggccaggctggtctcaaactcctgacctcaggtgatccacccacctcagcctcccaaagtgctgggattacaggcatgagccactgcgcctggccaaaaccatatttttctactactcatgtctgcaaatgtattgtactgacattatatcttctgacaaataggcttttaggagcaagtatggaaaccaccatttgaaacattgtttctacagataaatgagctttggattccagacaactgattaccctgtgaactttagaaaccaaagtgttctgagattggaaaaaatataaacttctactgagagacttctaagggtgtttagtttccagcacaatgttccagaacttccattttcagtatagtgcaagctagggcacctggtctctgtcatgttatgtgcaaatgatagttgacgcatgtttctttttaaggtaccctcacctgagtcccaagtacaaggagtcttttgatgtgggctgtaacctctttgccaagttttctgcatacattaagaatacacaaaaggaggcaaataagagtaagatacctttctttaaatctctatttttctctcactcttcatcttctcactcagcaaaaatagaattttcctgaatatatagtatattttggggactggcctagtcttcccctcattctctatactctcctctgaaattccctcgcatgaagttgtattagatttagaactcaagattcaatatagctattaccaaccatagctcaattagaatattgacatactaggtgtgaactaactgcaggactgtgtacctttaaggtttcttaaactgtggcacctaccatttcccatgaacattcttaaatagatttattatcctctgagtcacaagaactgtgttttttctttcactttctaactcttctgatcacttttctttctttcttttactctcctgccaatgcacctccctaagaaaagcccaaaagattaacactcactatttcatcttactttgtcttatcagtgagtagctgagcattctaaatagttaactagatattgaagagccagtgtaagtagtatgtatagatagaggtgtctaaatgtgtggaaagcatatttagaatgtatttagtcaaaagacaatacatttacaagtaactctattacttcattgcctcagattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagtaagtctttataaggcaggctgaatgggtgggaggggtttgccagttgccagcacaaagcatagtgaccttccagtgcggtattattatattatagctttgtcattatcatcatcatcatgtgtactatatacatctcttttctctttagagggaagatccataatgttctcttctgggaagtattaaaacttgtttctttttttttcttttttgagatagggtcttgctctgtcacccaggttggagtgcagtggcatgatcaaggcttattgcaacccccacctctgaggctcaagcagtcctcccaccccactcttgagtagctgggactacaggtgcgtgccaccacgcctggctaattttttgtactttttgtagagacagggtttcaccatgttgcacaggctggtcttgaactcctgggctcaagtgatccgcctgccttggcctcccaaagtgttgggattacaggcgtgagccaccgtgcccagccaaaacttgtttctttctttctaaatcagaaggtattttccactgtcttattttgtaataatattacctattttacagaattgttaagagaattaaataaattaaagcatttaaaatgcttagaacagtgcctagatcataatagggaataaccaatttgggctattagtattatgatgaattaatcataaatttaataaatatttattgcatagacttacacagaatttactctttgagtcctatgccaaacacagagaatatgtaaagaaagaagacataggactctaaataaactcttagtctagtcgtggtggatatgtgctcattttctgtggttccttcctctaaatatagtcataattaaatacagaatcaatatcaacatgattgtaagcatgtagttttgtcaacatttgtagacaaaacatcaaaatagtccaagattcgtgtctacttcatagtttattttatagtgctttttgtgtcgataagatgcctttgataatcttgacttctaagaaacatttctacatagtaggcatattactgatgccttctttttcctcttttttttgcaaaattctaggttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagaaaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataattttaaaaaacaatataagaaacaaagtcaactgaatcttttattcatagaaatgaaaaggaaaataaaaactgtggctgaccaaaaggtcttcttgttgtccataaaaggataaggtaaacagtccttagataattacaaaactttctacaaaagttaaaatgttacattactatacgtattcagattcacttgttaaagtactcttaaatcattcaaatctggaaacaaaagctgaacttaactcttgctccctcaaaagagaaacacaagcataagtgcagcttcaaaaaaggaaaatattttaggctttggtggaagggtggagtttagataaaatttaaatgaagtagcgttttaataggttcaaagaaaagtaaggcaatgagcaaactcaaagtactgtccttgaaaaccatagagtcaagataaatgtatagtgtatggttaggtggcagagaaatgcaatcatgttgataatctttgagatacatcctgtcatcagtatatttcagaatacatgcaatgcactagcaagttacaattgatagaatacatttgaaatgttaaatgaaataagccaggcacagaaagacaaacaccacatgatctcactcatatgtggaattttaaaaagttgatctcactcatatgtggaattttaaaaagttgatctcacacaagtagagggtagaatcgtggttaccaggggctagggagagaaagaaggcagaggcactgaaagatgttggtcaatgggtataaagttacacctaggaagaataaattttggtattcaccacagtagggtgactatagcaaataataatgtagcatgtatttcaagatagctagaaaagcaggtttttaaatgtcaccacaaagaaataacaaatgtttatagtggtggatatggtaattacgcctatttgatcattatactgtgtgtacatgcattgaaacaccacattgtatcccatatatatgtacaattatgtgcccattatacatttaaaaaataaattttaaaaaccttcaa

SEQ ID NO: 612 - DNA, 456756 bp, Homo sapiens
gatggaccgcttcctgggttttgtcaaggcgataagaagatctaggagaagaaaggggaaaaagtaccgaccagaagaggattaccacgagggctatgaggatgtctattattacgcttcagagcattttcgaagtaagcgcttctctccatcctccggttccttctcgcatgctggggctaacaataaaccttgtgtggagccttaatcttaaatgcaaaaggtttctcagatggtgttctctgtgagcagtctgtaagtactgaagtgctatgttttgcttgatttgttgcaagaacagccattagataatagcatctagacagtgtcaccagccaaggtctgtacacatcgttaatattttaggtgaaattaattatgttattttaataagccattcaaaaaagttgcaagccaacgtagtaggtggccagaatatgctctgttgtagttgttgctttcctttttctttcagaatagggaaggctagctcatttggaagaaataattgttcatgttcaagttgatgttaatgcttaatgctcctgatacagacttctagacagttatctgtgattaatctcaggtgttgtttgtacaaggaagttcaagtacctttctctgatgcatgtttacaattttgttattaaataaggttaattcttatttgctgtcagctagaagcagtgatacctgtagtatccgtaatatgtctatattgagacatttgaaacttagcttataaatagaagagaactagcagttttcttttatctgtcagcgctttaagtttctggtaaggtttagacttgtcccactagatttaaaatgcccagaaatgcctaagggtgcagagagaaagcagctatgcacagagatcactgagtttatgatgtgccccaaatgggggaagatgacagttatgtatgatctacatttttaaaaagctaaaaattatttatttgtcttcttcaataaggatctttataaacttatatttcaattctaattcgttctggtcttttgatgtctaatcatgaatgcatcccacttataaactctgagcattaactaataaataatttaaatcccaatttctgtggtattgaaagccatgagaattccttctaaatgctagaaattctgttgcgattgatgaagactgagggttgaaaattcatgtggtggcaataatacaagaatgtaaaattgtaattatttgatatttgcttgaataatgtggctgtattgcttttacctgagtaacctcggggttttagagatgtttctcttttaaatgtgtgcacatgaataatgtgttctgatagagtgacactctgtttcctaaattttgtttccgtactatatcctagaatttaactaaaatttatgtcacatcaaaaaatattgtcagattgcatgtgtaattctgaaaactcagaaactgaataaaaggagcttatgaacttttaattagactggtagacattgtacagattttttgcagtcaatatatactgagtcagattcataccatctcaggtttgtaccatgatatatgtttgtagaaacagaattgaacaatatttctcaaatgcctgcatactactagctttggtaagaatttaaaaacaatagaattactctgtaagtttataaaatgtcttgacaagaagaactatatatggaggtatctaagaaatattcccaaactagagttaggacaattatataatgaagatagtaagtagtctttatacattaagtgaaataactcaaagagaatcacgttttatctcatttgtcaaggccatgctaaggataagatgttaaatatcaaaagtcatttcctttagatatgaaactgacatgtttttcctgtgatttatcagaacatacccattatgtaatatataacttgtggagttagttgcaaattgggtccccaacttgaaactactacataataaacagaatgtgtcagagtggactcaggcacttgggatttggcatttcatcaaatgtcaaatagccagggcttttaaagaagataagtcatataatacaatgacttctcagtgcatcttttggcttcggtttcagggcttctctgaattgggtaggggagacatccacttacatcttagagctgtagaaaagcattaaagagtgagaccgaccttaaaaccagtcctctcaaatgggtaatatggttgcattcaattacatctacaacatatctgttttaattagtttttggcataatttaaacgtttataccccatgtgtttctcgagacggcttagaaaaactatctacattaaggctgaaaacgtggtggaatttactgatgatgttcacatcttaatgatgctattgatgaaccagaagtgtcattcttctttttctccctagagtgtttacttcttgaaagaaacttaaccctctgtcttgtcagtttttcctttagagaagattgccacaagaactttgtatgtgtaataatgaaatagtcagctaaaaagaacctcccagaaaattctccaagtctgtcctccctgtagtacattttccagttctgatatttaattttatcctaatgtctcttctattgtgggttctgatttagaatttcaccacccattccttcatcttaaatacagcatcacttataatcttgttaaatgccagagtctgaattaaaatgtccatagggtgaaatgctatggaaaagaagttattttaataatagatgacttttctgaaattccatcaaaactcagttttagcagtgacaatgatgatagaatgattttaaatctcctctgactttatattgacttgatgtatgtcaatgtacatgagatggccatgtttgatttttttaaaaactgctttcatcactcatctatccttcataattctagagttagagtttaaataaactagacagacgcatgctttgggtaagtcaccaaacatttctgggttttagtcttttaaaatgtgatacaaggtggctttgtccctaaagcttttcccagttatagaactatattgtatatattttgaactttgcttgatttccaaaacaatttaggtaaaggtattgactggagaattttcattggtattcaaggcaaaaagaaatcacctaaatatcctgagggaattgtttttctgacaggaatgctcagtggggagaattcctgttactttagggtcataatctatcactgaatattaagtagtgttggagaattttgataaacctttgaaattctgaagatgtttgtaaatccgagactgcattttttatttaatcgtatccaccaagaagcaccatttactttttgaaattctcacaaagatgattcatttggtatttttccttgagaaaaacttgctttgattacaaaactgtcataaacttgaatgtagtgaagagctagaaaaggaccctaacattccatttttttatgtttggtgtttttgtttttcgctaaatactgtgttatggtaatgtctttttataggctctggcaggtcatatgttaattcatgtgtcatacaaaaataaaatgtctgattctattgtcatgtgtatttttatttagccacaccggataatattccagctataagacagataatgtatattaaagaagcaatctcttaacactgtgcttatacataacaatcctgacctcttgctgtccatgcagctgaattacttgagaaagaagaatttgtttctctcttatgaatagaggtatgtgagccactctcatgtacagcgctagcatcttatacacctgtgtaatagtatggaattaggagtgggactcctccatggtaactgctgttcttggtcttcctgactctcctagattgaagaaaagctgtctgggaaagctctcagggcagtcattagtgaccaattaacttttcttactggggtcatttcagggaaactggagagagggaggaacatgaatatggcttagaccttctgaataaaagggtcatttgtatgtacaaattatttcatttgttgttttgttgttgttgtttgcctattctaatagatattcagcagtaattgtgatgtgtgtgtatgaaatcattgttagctaaattattttatgatgcattgtatgcatttacaattcctagttaggcaattcaggctttaaagtgccttagatattcaaatcgtattttaaaagggtgcttcactttctttcatgtcattgaaaaacacgatgcattgttcttcttagaggaaaaacaatattgacagtggtatttgtagaatgataatttttaggctgtggtgtgggtgattagataagtaatttattcttactggttcctttagagttttccccctttggtaaattcatgtaaccacaccctctctgcttcaggaaactgacgtctaattaggactttctttcttgataagtgtgccacaaggctagagtgagaactctgacatatactttggaaagatgcctgatttgtgcagaaatatgtgcaagagctgaacacataatcaaagggagtcttgccttcctcagtctgtgggggatgacagggaagaggaaggaactggggaggggaaaaggaaggagagagggaagcacatttcataggctgtccttacttctctagtgcttacaagcatagaagccatttatttctatgttaaaaatagtgggatcatcagactgacaggtcttggatgtgaaatcctgaatgattcaagccttagctgtatttagtttaactcaaaaaatcccgaatgaattagaagaaacatcaattataaagaaatagggcaaacttgcttgttttatgactatactgcttatttttcttccctaagaattgctttccatctatagtatatttgtcttgttgaaaattgattggctatcatgttccatgggctggttattttgtatgaccaactttcttgtctcaagctatatttttttctatatggaataaagaaatactaaagttgaaagggaccttagaatctactttgtcaacctgagtatatttttagataaagtaacatatacaaacaagttaatcaacttacggagtccccactgattgtcgtggaactgggaatagcagccagactcccttattgggtctggtccttcacctctcatccccacttttgttttagctcactgatgagccttctgatgatatttaaggtccaggatcatctacatataaattgtaactacttagttccctgataggtggctttatttttttgaacagtaggccatcttatcttaaactcctgaacaaaaacaaactcctgatttaatactgcaagtcaaattaatatgatattatatttacagatgatgttaattaaagtgattgtcggtggctcaaaaaccataggtgattttctgtgtcacctgtcatttgctctgtggtttgcaaatatagctaccttcatcagtgaatattatttcaggggacttaaaatggcataattatttcaaacagtattagagttaggagggacttcggagtccagttagtacggcatgctatctgaaatagaaggtccttcttcaatatcccagctatatggacatccagctttcatttaaatcgttccaatgtgaacatgttcatttccagacaaggcaagttactgaataaacctatgcctcctttaaatacattgtaagttatatgttaagttgctggcttatttcaagaaatacaatatgtgttcaaaatctatatcttgacccaaataaacatagactctattgaatttaatgtgcaataagatttcatgcctcctttttattcacattactctttcacggatgtaacatatggcatgtggaggtgagtaattccttcaatgctatttctgttttaactatacaaacacagaagagctctgtattgggcccacatccatgtggtaatttttatttcttgttttctacttattttttgttgatttctacaagatcaccaaggcttctatttatttaataaaaagcatattctagtgctttctgtttgcatgatgtagtggtcatcatttgtctgccttaaaactcctttttcattccccttggaagagcaatgttcatatttaaaatgctcctgtttctccttcagttctgtcattattgattgatcaaaactgtgataatttgggttacaattatagaaaactaccacgttttagtctttagtgatttgtctgttcataaacagctaggtcaatcagaatgctcctgtgagagtttgcaaattcaactcagtgcactgtgctcatggagaaaccattctggactgggagggaatcaagcccacatccaaaggagacagacatgaaggatcaagaggctcctctcagggttgtattcactaattccagtccttaaggtctctaggttagagaattagaaaggaccagaactcagattggaactcagatcagctagtttcaagtttgatagtgttggtaagctcttatttggaaaatatgattctttagttattttcatttgatagtaataaatgccaccgatggaaactatattctttccataaaagttcccatcctcccaaaatataattctcttaatgggactaaaaaactatgtgactttggatgaatcacctgggtcagtatgcttcttcagtttcctatttgtaaaatggggttctaaatcccagtggagagtgctgaagaccccagagagagaggaatcactggcaggtgtagtcagtagagctgtgtctccccagggcagcatacatcccaaacagctggaagaaggggatagctagtgggcaaatttggacagatgacgttccgcttagcagcataactgcagtgcatttaacattctttgcccttacttttcatttagagagttaagtcttgttttagagggaacacacaacttccccatgtacctctcaccagatcattcaccatgatgccagatggaaacatgcctagtggtgtattagaatataatagaatttttaatctgctttttaaaatttgaagtgttagaattctaccccactatctcactaactattacataatcttacaaccaaaaagcttttctgaaacatccaaccatgggactgagttatttggatctgtagatttaaactaaacgtcagcaagtaggtttatagatatgtagaaactgagctgaatttcagttgatatccaaacctttgaagacctctgttttagaaattatttgaactggctcaaaatagtatgagattgtgactaaataagttattcataattaataatattgtaaataataaaatataatgcttgaattttcttcttaccatctttattctttcaagaataggaagattgtatttgtggtaagcatcccaccatttttattcattcagcaattacttgatgatgcacgtgtcaagagtcattctacatgctggagataccgtggtacagaagacagaggaggtccttgccctagtggagtcagcaagctaaaaagaaaacagaaaaactagtggcaagtacaatgaagaaaaccagatcaaagttttgggatggagtggtggaggtgttgagaagggtgagcgtttgagatacagtgttccttcttggagaacaggatgttgggatgaccctgattgaagagatggagtcattgtataatctggataggaggctggggcataaagcctccagagataaaagtgtattcattctaatacagtacttcccttgccatcttctggatggcttgtttctttgacattcatttgttaaatcagtttttttttttaattccgaatccattttttcctaggaataatgcactcagaataggaaaaatgtagatttaaaaccaggcctaatcataaagtctttttgcaatatgtcactaacaggtaaaagacgactgtggccaaaggggacatagttactggagaaaacctttattttgcaggactgctgttgctattcacatagaggagtcttctgttagtatactattgcaaagttagggattgtctaaagtgggggtggtgatttgggggtatgaaaagatggtttgctctgtctgtagaatagtgttagtaagtgtgtcataatcttctctgtatttggatcctaaacatccattgagcatgattcttaagctaaaagtacacttaccatgtcatcagaggatactaaaatgtatgattgctttatagtcgttgtttgttttctgtagaacaaaattattttatgcttctccctagtctttcaagtgcactccattataaagattcttaatggcttttgtatgtccaaggaaagattatatgtcaaagaaattatttccagaaagtgcacaaagttgtacagggtctttcaggttacagcccacagcatcaccatcttctgtgctttgtggagaattagaccctttatattgctattgtagattatgttactatcaatagataaacagggaattgtatgttgcttgttggaataagttattttctacataacttactatgtgttaaatatgattcagaggattggacttttatgtttaaaaataaatttaatgtaagatgaaattcctgttttctgataattatctgaactgcttttcacgattgagtctagccaacaaacttaaaatttatgtgtagtttcagaacagtggcaaacattttgtgaaaacaggtgcttttgattactgctaagctggtcttatgttttcacattgtgcttctgctggcagtagtatgtggttcctgaattttcaggtgcagaaaataacatttgatttgtgaagccccatttttgagataaaactaggcacatgtcaaatgtaagcaatatggaatgtgacgccaacagtggcatccttgctgattctaaaaattggatataggttaacaaattgctgtagtggaaagttttacaaatgattacagctctggttaatacttgtttttgtaaactgtaatctgcctgcaaaaaattaacttctgcaagtattttgaagacatgaatatgaacttatacctttaaaaactttgctcagtacatttcaccctgcttataatcgtgatcacttttaggggaacagctgttaaaatttagggtgagatgtacgggtgctcagcagttggttgtaaatttccactttatggatttacagtggtctttcattattgaagtagaattggggaatccccatcaccttaaaactgttatttatggctggttttatctaccaatgccaagttttcatgatttataggaacaaacacctctctcttttattcttaaaaattccaaatcttctgtgtaatggtgtttttagcactatttggaagatgatcaggcataaaaggaattttaaacctaagaactgttgggatcttccaatccagccctctgattttacataaatttaatatctctaacaacagagtaatttgctcagtaattgtttaaggcttaaagagagaaaatgtctaactcaagattacacagctcagaatagaagtaacgtaagtatttaagtctgtgaacttggtgtatttttaatcgtatcctcccccatacacttcccattgcttcaaacactgccttcatgtgaaatttcccacaaccctgctcactctcccaagggttagccctggagcccctgtgtatgtgaatggcacccccaattactccatcgttttgtgattacttacatacagtgtccttttgtgagtgccatatcctcatctttgtattccagcatctaagacagtgcctggaccatctatagatgtttctgtcttaaaaagctgtgaagaagactgattcccataagccacccacagaaacctatctcattactttgtagtcactattcgtgtatttgaaatgattaggaagtttagaaaaccatactctggctgtaagaatcttagtttgccatatcaatgattccgatgctattcctctccatctactactctgtgtagcacaggaaaacacagctcctgcaacagatgttttgagaatccaaatgcaaggaaaatagaaggggaaagcagtgtttatactttataagattcttatagacctacctttttcttttcaacacatgctacgaagtttattatgcttgatctcctgagatcagtgcatgctaggccctatgcttcgtaatttatgtgcattagctcatttaatccacacaactccatgagactaatactattatctttattttccagataaaacttgagccaaatgagcttaattttctcaatgttacacaattgtcggtatgttagctattatcagccaatatgcattaagcactactatgtgctgagagccatggcaggaatatcccagctcccaactgcagtgctgtgtgccatccttccccatgctgccagtcaactgtgccttcatgatggcagcctccatcctcgtgatgggttgataaactcctgagtcagcttggatataattccacggctccaaaaggagaaaaagcagcaaacgcaacatgctgttatgactaaccatttttgtaatgaggtgaatgttcttctcagtacgttcattcaattattttgtattcaattatactttgaataggagaatttaccttacactctagtgtgactttgttgttgttgttttttttcccactgaatctgaaattagggactgatgtatgtaattcacagcatacttggactggaagaaaatttatcaccaaggtgagcaaacagatccagtttagagttgggaccttgactcagctttgtgtataatccctcagcaacgtagtacaagagcaggagggctgtgacattgtcctgtgtcatgtccagccatcacaatatttgaatatgaatgcattttgtgtctgtaatacctagaactcaaattgtgaaaagtggaacagtaaaaaaccaatgcatctatataaacaaaaatgtgaatgtgggtataaaactttcataagatcagagagttctctgaggaattccaaataaatctagaattcatgagaattggaaaactatataggaactagttttatttatttatattttctattgctaagtcacacatgaatcatattctcctcttccatgaataaagtaaatacttacatatcaaatttactgataggaaatatttctcaaagagagtaaaattatttactataaaatatatgcatttttagtgaatattatttggattattggcaacagtggtcagggaactcttagtgtcaagttatgtaatttatgttatccagtttgagcttggctttgttaaagtgttctacttggagtgttgtaattttctcagacaattaggtatgttttcttttcatttagaaggttttgttttttactttttagtttttactttgtaaagttgagtgttcctcaatcagaaattgcaatattttatttaaatgagacagagatctcttagtttgagttgtaatagcaaacctcagagatagtcccatatagcctgggcaacataaggagactctgcctctatgaaaaatttactttttaaattattttattttgtagatatggggttttgccatattgcccaggctgttcttgaactcctgaactcaagctcacccctcggcctcccaaagtgctgtgattacaggtgtgagccaccatgcccagctcctacaaaaaattttaaaattagccagtcatagtggtgcgttcctgtaatcccagctacttgggagaagggggtgtggacactgaggcagaaggatcacttgagcccaggaggtcaaggctgtagtgagccatgatcatgctactgcactgcaaaaaagaaaaaagaaagaaatggtctgatatgatttggagttgtttgatgttatgaacaaagtgcaaatattaagctttgtagagaaaagtcgtagtaaagtgtatcatttctaaaagctccaaatcagttcttttgctttgttaagcgtatttggtagctcttacatttatcaggttctttctctatttttgtatctatttttctcctcaaaagtttcataaaatctcattttcccacctctttctcatgagaaatccagaatgttaaactttccaggcccttcaattccctaccagtcatccccacatgtgagaacattgttgacttctctaactcaggaatggcaaatcaaatgctgcatgttcccatttttgagtgggagctaagcaaagacatacggagtggtacaatggacactggagactcagaagcagggagggtaaggggaatgagggatagaaaactacatattgggtacaatgtacactattcgggtgacaggtgcattaaaatctcagcaccagtatacaactcagctgtgtaactaaaaaccacttgtaccccaaaagctgaaataatacatatctaatattaaggacatcaaaaaagagtattgttgagttattctttgattaggtattcagttccctgataccaggcctgataccaggcccctcaagtatttgtttctcctcgagacttcatccttacaaccctgccaatgctcaaccttagctccatcaaaccatctgtggtcttcactcctgctactgacattactggaagaaaaaaactgtataaccatggtggttggctacattacagatttatgagttccagcctcagctggtttctcaacactagtcatcaatcttttgtctttatctccagccactctctttccctttccctaagcaattattcccaaatcgcacctctcttctgaagtcccagtctgctcctcccatccggaaacacactctgaactgaagatagaggctacttcttagtttacttgactctgcttctcccaccttccaaatatcttttacaaaaacttccactatgcagcacgtactttcctgtccccaaaacacaaagcagatgcctggttcacttagagtgattgagcgatgccttgtggccctctggattctgcacctgccattctactgaaaaggattcagcagagatcaccagcgatcaccttattccaaatttagtggtctttaagactttcttaacttcgttgagcttcctgtagcaactgtaccagtcatcattttggtctttgagtctttcctgtcttggcttctgtgacccatcttctttccagtcctccagcctctctttgataccttctccttcctcccgctccttccccttaactctggggttcagcactggcccttctaactctctgaattcttcctgggctatctccgcctccctcgttttgtaatttagatgtcacaaatgagctctggatctatctttccaactgtcttctgggtggtgcattacctcagattttgacttttcctaaactgaactcaataccttagctcctacccaaatatgttcccagtacctttcttctctcttttagctataaaggcattatcctctaaaaactaggaaccttgaattcatttctcattccttacgttatctaagttttctattatattttatctatttcatctactttatacttcatctttgtattccctctgcacccggggtagtccatagttagagcttaataaatgtttaattttattttatttcacaccaaactgtagacaactagaatagtggatttcaagggacagatctatctccaactttaaagtgtatattaatatttaggcctactggaaagatacttgacagtttacgatgcctcaaggctaaaattttttgaggtaaagtattctgttcctgtcatagtacttatattcatgattctgaccttgttcattaaaagcaaagtgggcaacttgagtctgaaggacctatgtagctggaaatattagcttggagtccagaattcaataaccattgattgcgcagtccaaagcagtttattgttgatatcttttccctaaaatgaaatcagttattcttgctggtgcatttttattaagggatctgctgtttggactagaattataaatttaagtacagtggcatattgaaaataaagtgtttttcagtgacctcaaaatgttgatctaatgaatcacaaattatattaaagcttagtggagaaggcaatagaagtaatgataacatttaatggattctaaatggtagctctaaacactttaaatttaacatcaaataaaattttttctcctttttataagatagaaacttttctgcttataaaagttattaattggtctaatcaaaatgattagaatttgcatgttccttgtaattttcattcagtttttctgtaaacaattactgtaactatcttgtcacagagaataaattaagatgaaagtatgagagttttatattcaagggagaagtaattcggattgcatggttttgaaaagagtgatcaaaacagctatgtttagaatacaaatttcaaatttaaggacatgtttaaatagttaatggaaaaaattttttacatgacagtaaacagcaaattaattatggaccattatctatttgtacagcaaagtttgtatattatagttttggtaataaccattgcaataattataattttatattattttaaaattttacaatgctataacatacattgtcctttttggtctttctagccatcttataagttgataaattagctgttgttactgttattcctcattttatagatgagaaaacaaaagcactgaaaatttaaatggcttatccagtgtcacacaactagtgaatactggcattcctcctgattcacttatttccaaatcttatgggattttctcctctcctgaatggacttagagctctttgaaacaagctgcccatccgacttaattctcctgtgcctagaacattgcaggttctcaatgtgtatttgtaaaacagattcatctaaactagaatggaatttcaagtgtgagcctttttgtaaagaattttactactcaaatactatattctgtcaacctaatagaattatgctgtgaccttgaatatactgaaattgcattttaaagtcctaaaaataaagtaattgagagttgtcttggaaaacataacacaaaggcaaaggataagtattttattgttaatctatttaagtttaattcctttctatcagttatcttttgctgcatgacaaattaccccaaaatttggcagcttaaaaaaacaaacatttcttctctcatagtttctgtggatcaggaatactggtgcagcttagctggatactcgggttcatggtctctcagaaggctgtgaccaaagtataggctggggctacaatcatctctcggctggaatggggagggatcccttctaagctcaccaacgtagctgcaggcaggatccaagttctagatggctattgtatggagataccagttttgtgagggctttttctcccggcaaatgcccctctccactgagcagctcaaacaaggcaactggtcactcttagaataggtgggccagagagagcaagaaagggcatgcaagacaaaaaaaacacagtttttttttttaaatttaatttcagaagtgacatctcatcactgtagccttctgttcattagaagagagtcattaggtccagtctatactcatgaggaagggattacatctccctagtattcaacactaggaggatactaggaggtctcaatcatttgggccatccgaatactgcctaccttattcatgttaaatattattgttcaaccatagtaaactcaaagaaataaaattccagcagactgacctcaactgtgtccagactttttaagggaaagctacagaagtgcagctcaaactggctttagcttaaaaaaaaaaaaaagtattttatttttgtgttttttgtatttaacaaaaaagagtctcagtgttgtcccgatagtaggtgcagcagaattctgttctgttctccattggcactcaactttgctttctaaatagtcttgaatggattctatcaatctgtcttgtgccccatgaccacccctatggcaggggtgtgtgaaatactccagttgaccaatcctgggtcacttccccacccctggaacccggagaaagtgacagaagccaaaatctaaatcatatgaactcagagtggaggaaagtaaaccttgaggtgctgtgaccacaataaggcgccttggctgatggtaggcagatcactaaggcccacggcacccttctgtcactctttaagtccctacctgttctaactcatacagtttgcttttggggggtatcttagttcattcaggctgctgtaacaaaatactatagactgggtaccttatagacaacagaaatgtatttctcatagttctggagcttgggcattccaagatcaaggcacaggtagattcggtgttgggtgagggtctgttgctcatagatggtgccttctagctgtgtccttacatgacagaaggaacaaggcaacactctgggatcacttttataagggcactgatcccatccatgaagctgtgccctgccctcatgatctaatcacctccccaaggcttcacttcttaataccatcatcaccttagggtttaggatttcagcatatgaatttgcaggggagggggcacagtggaagacacagacattcaactcatagcactggtggacttaaagatgtacaggataacatcttcttttgatggcagaaatgggaagagaattctcctcctcagtaagaatttttgctaaatattgtttaaaatcaatagcaaaagctaagccacagttttgcaatatgagtgtgtcttctggaaacaaacgtcctaaactttctgtgtaacctttaattgttagtagaacacatccccaggactgaattcagttcatctgtctggagctttagaatgaaaacaaagccttattactgtgttgacttacagaaaacacagatgtgtgtgcacagatagtaattgggctcagctggggccatttaggggtcaaatactaggtatccaaggttacttgtgcgtaaatttaaacctcataagctgtagtcacagctttatagcagctggcttgttgttttgttttggatttcttctccttcctctccagcgcccactctgcacccccactttcaggtatcaaaaggattagacctgagggtcagctgtggttctttttcagagagaaaatagaattattacatggttcttaagattaaattatattgtattaggtcagtggcaaaagcaaagatcatttgttaagccttagtgctgttttccaccctgcagtcccatataaactgggtgttgctcaaggctcctctcgataatgactgttggcttctccccttcctagtcatgtgaggacccttgggagtcagtatgtctggagagccaatagaccaaggctctcatcattctccctccagctgcagcacctcccaggcagagtatttggtgttccagcaacattcacccttgagtgctcaccagtagatactgggtaaagcactgggggctgctgggaaaagcagaccatagtcagtgtctgaggatgagaccagagatacatggtttgggttggggaggaagagaaagcaacagcctaactagtctcaggttgaatggccatgaaggtgaagttgcctcctgaagctgtccccagccctgctgctgtcttgcagtttgctgtaagacacggtgctgttccctccaggtctgtccaccaacaaagttctgtggtatccatgcatctcatgtgtgtggccactgtgccaatccaaattcctctttcctctatctgaccatgtgtattgatttttattttgcaaaatgtggttgtcatatccatctagcagaatgattttgattttctacccccaactccaaattcctagtcgtcttcaccttttcctcaacccttattccattcaaaaagctataatttcaatacaaaaacttagtgtcacttgctaaaccaaattgctttatttttatttttttgtgtgacaggatcttgctttgtcacccaggctagagtacagtggtgcagtcatatctcactgtagcctccatctcctgggctcaagcaatcctcccacctcagcctcctgaatagctgggactattggtgcatgccaccatgcccggctaatttttaaatttttttgtagagttggagtctctctattttgcccaggctggtctcaaactcctggcctcaagcaatcctcccacctcagcctcccaaagtgctgagattataggtgtgagccaccatgcccagccctgctttccttttaaaggttacttaagtgtgtgattgtctgataatccaagttattattaatgaagtttttgttttgtttggctttattttatttgtttttgcttattaacccaaatgaatctctaaatgatggaatttcaggcagagtaagagagaattttggattgggtcactttactacatttggctaagtatattctacttaaataaaaggacacattttgatatggggaacttgcagcctctcccacccgaaatatttccatcgcctcaacctttttctttttgagacagggtcttgctgtgttgccaaggctggagtgcagtggcacaatcagagctcaccacagcttccatcccccaggctgaagtgatccccctgtgtcagcctcgtgagcagctgggactataggaaagtgctaccatgcccaactaatatatatatatatatatatgtatgtatgtatgtatgtatgtatgtatgtatgtatgttaaattcttggaagagtcagggtttcaccatgttgcccaggctggtcttgaactcctgagctcaagcgatctgcccacctcagcctcccaaagtgctgggattacaggcatgagccaccatgcctggccctcaaccttttttcttcaagtagctcttaacttttttctacttccctcttcttatatctacctttttatttggagttcaaggcctatggtgacctagtaaaatattattcagtacaagtcagtggagtatgaaattgatttaaaaatcagctttcagatgtgataagaaagagagccagaacacggaaggtagtggtagtcctactgtactctgggctggtcagacctcacaggcaacatgttatttgcttcagggagatgtggacaaactgaagcactgccagagaagaatgactagacatatgaaaggtgcatatggcctgactgaaagaacagaaggtgtctattctgttcaagacgagactttatagaaaaataacagagaggaggttggaggtacaatagtgctaacatgcgtaacccatgagtatgctttgtgtgactcttaaaaacaaagctaagaccagggagtagtttttaaaaaagatttttttttcctgaaagcagtaacatctttcctgtgaccatggttagtgatgctatagcaggaatgtaaacataaaaattaggatagcaaatagattaggtgctaactgcagtcaactggtggaagctggctttagagggtagtcattacgagcatggacattggattaaaatgagtctggctttcaatgccactcagcccctgccaactgttaagctaactaactcctgattctcagtgtccacatctctaaaagagaatataatattacctacctcattaggatattgtgaggttataaaaatgaaatgatgcatgtgaagaggttagtacagtgctgtgcaaataatagataatcaatgttactattgggaaattctgaggtcagaggaatctgtgtttgttgggaaagcaggccctatcaattagtgatgtctgctgtgggagtgaaagtaggccacgtatttatcatccttggggtatagctggataaagtgatcatttatgctcaatcctcctattttacttttcatgtaacatagttatctacttacaacttaaaaaaaaattagaggaaatattggcttaaattggaggccttctcgtccattttccctgctgtccctctgttcttaattatataagtttaaaattatgacgattatatggaaagtaaataccatttttgttcttctgttaaccttgatagtcttacaatatgaatgaattgaaaggaaatgcattttgcaatgcatgatgaatgagcctgcacttcttaaatgtctcagttctactacaggttagatatttagaaagaatgtgaggaaaatcaaatcttaacgcaagctgtcttttgccaaatataatttcttatctgaattttttcatattgaactcaaacttgagttcaatacttgagatagtattgaactcaaaactagtatttttttagcactttaaggtataagtggttacctagactctatttagaataccttatcttaaatatctgtggatacttaagaagaaaactgtaaaatcgatgtgttggccatgaatttttaaccctgcttatcaaatgttgttaagaacattgccaaggaaataaagatgtatcattaaagcatgtcatgtttgcaagatcatctctctgagtgttgattaactcctagacctttaagcacagccacctcacttataagttgctgccaagaggaaaatgcgggtgccactggttagccattgtcaaatggatgtatttttctcagatatgaataaatgagaactggactgtgacacagaaacaaactatgcactttttttccccatgacattataataatcaagaaacaatgtggccaggcatggtggctcacgcctgtaatccaaacactttggtaggctgagatgggccaatcacatgaggccaggagttcaagaccagcctggccaacatggcaaaacacatgtctctactaaaacagtacaaaaagtagccaagtgtggtaatgcatgcctgtaatcctagctactcaggtagctgaggcataagaattgcttgaacccgggaggcagaggttgcagtgggccaaaattgtgccactgcactccagcctgggtgacagagtgtcttaaaaaaaaaaaagtacctttactcatttgcctttcagctgagaaatatggcaatgcactattaattcaaagaagcagtattgccccttggttaaaatctcagactccagagtgagaaatgatcagaatcctggcatctctacttaactgatttttaattttgtcaaagtatgttaacttctctaaccatcttcagtttccttctctgtaaaatggagataactgttatacctatctatcatctcttgtggagaggagagcaataggaaaacttaggcagagattgttacatagcaagcagtaagagtaactacctttgtaaataggaaaaatctttcatgagtcaagagtactgggttctgatcccagctttgtcactaactacctatgcaatttggggctatcatatcagttctctgaatcttagtttccataaccagaagtgaaagaaattgattgcatgatcttgaaaattacttccaattctaaaatactattctggttagcagaagcatttaaaaactcaaactaaaacaaaaagccccctccgtttctaattggtagttaattatttcagtctttacttaaacattcctttatgtcagggaaagaccttttgtttttcaccacttctatttccccaggaacttcattgcctccagttccagagaaaggtgttaagaagaaaattaacaaccacttgctactgtgtgaacactaactgctcttaattgctttctttaagatagctttctgttaattgggagggcttgaaaatccgatctcaatccgaattcctaatatctctttatcaaacacaaacctgttcatttctatataggatttttattgaagtgtaacatttatataaaaagtgcacagattctaagtgtacaacttaatgaatttttaagaagtgaacataaccatgtaccagcatccagatcaagaagtagaacattagccagcacctcaaaattccctttatgcctctccttctagtcactaattcttatccaaggttaaccaccatcctgatctggaatgtaatgttatagattacttttgcatgtttttgaagtttatataaatgaaatcatcatacggttagtagtcatttccattggtatattttggagtggaattgctaggtcatatagtacatgcatatgttcagctttgatagatattgccaaatagttttcaaaaatggctataccaatttatacacccttcccctacctaagaaggtttctgattatctgttttaaaaccttcatgcagcctcctattttgaattaagttatacagctttctctccaatacctgtatcttctacctcagtgatgcttcacttcagtttgccttggacagactctggatataccaaattcatacctattgttcttgcataattattattagtgctcctttcattttcaatttgtcctaggttagagggagatgaaaaaaattctaaaattagattgtggagatgtttgcagaactctatgagtgtaataagaaaacattgtgtatactttgcttgggtaatttttttggtatatgaactgtatctcaataaagctgttttgatgattttttctagtttggatgataaattatgtggtcattctacttaatcaatttctaccatttgcaaataagttactttaaaaaggacagaaagaaagatacctaaataagcctcactgcttcatttggaaaaacaaaaacagacttcccctggcacagtttttgaagcattttctagcaagagatgccattgaaagcaagggaaaattgattgtgctaccccaatcaattaagctactcttttgaaaggggaacccttccactgggattgagtttgttttataatttaccaaaaattaagacaacttttaaagtaagtgtaccttataaatgttaccacgagacagaatatttaattaaaactgtggtatcgccgttacctgctgggtaacaaactcccctagaactcagtggtgaacaataatcattttatcatgctcttggcctttatgggtcagggattcagatggagcacagcagacagtttgcctgctccacgctgtcttgggcctcagcttagtgttagctgaaacctcagctcaactgtaggtattctagcacatgcaggtattctagttgagccagaatacctacatgtggcttctctgcatgggctagtttgagctttctcacagtatgacagctgggttccaagatagagtattccaagagggcaaagcggcagtgcatggcatttttatgatctggccttaaaagtcacataaagacacttttgccatcctctgttgatcaagtcccaaaattcagcccagattcaaagggagaggatatagacctcatcactcaatgggaaaggtgtcaaggtgacactgtaaacagtacatgggagacattgtgggatgctgctttggaaagtatgcctttcctttcatctggatcttctctttcctccattgctgttgttcctgtcctgattaattttgattccactcccagcagtttctcctcaatatggggtcctgtcctggaagggagcccacctggtcagattcaagagttcacaggggcaagactgctacagacatggccccttgggtcttgccgtgagcccatagccctcactggctttgacttgggtattttcaaccactgttaccaaactggcatgtaacactctctagtgaacacctgctgactatttggaggttctcctgttcccgcatccatcagatgcctgcttgcttctctctgctttctcttgcacaaacactgattcctgctcttcttggtagcttgtcctcacttgcttataatttggagtttgtgagatacatcatctccgggtttgatgtatgtgttgtccttagggttttgaccaactagttgctctgtttttatgtggggacttgggaaaacctcaaattatgctgccactaccaccaacatcttacccaagtacaccccaaatgaaatcccactccatatctcccgctccttccctgcctcctgatacattcaccacactaatttttatgttctttaactttgctttagggcctttcaattggaatgtacttcctgaatatagtcatgtggctgaccacttcttaatatgcaaatatcattttaaatgccatgtcctcagacttgaccttcctgtctacagtagcttccccatcattctctaccacattattccattttattttcactactgcacatattatgtgatattacttgtttactgggtccccccaaaacactattatgtatggaatgttgtctgtcttgttcaacactgtattcccagtacctgttacacagatgttcaataaatattagtaggttgaatgaacgaatgaaaagtgaatgactaatccaggtttcccgattgtatgataactatcattatgatctctaagctgctttgtcttgtgaacctcagcttactaagaagtgtttccatgtttaatattctttgatacaataaacgtgtgacattcatgaggaatatgcccagaaggtcttcttgtatccacaaattcaccagtattataacataaaatctaccccataaaatgcagtaaagtgtaactgaaaaatttaagtgactcttaatggttttttttgaatacagaactaaaatcatttctaaagccattaaaataaattcagccactaaaataaatgctacactacattacacatgatttttattttcaagaggttcttattattctgtttgatgtcttgtggtttgtcagatagtaaagtccagcttaatttgaaaacctgccatattgacctggaataggaaagacaaattgtccttgggcaacttaaatctgatttcagtttttctccttgaaattatatgttaacaaagacattttcctgaagtatagcacttcatctttattgagccggttttctgatttctccatcttttctttgaatttctctttttggggaaaagtgctcccaaagctatgtggccagctaatgtgttcttctcttaatctcacattaacgggatagagttcttcctcacattttcaaattttggctagaggtgaggtcagttcagacttctccttcgtatcttgatcacctgtcacatctggacagtgttggtacaagctccacagctttccattgattcccctttccctttcctatgtctactaaagtttttactactgagcaattttgcacgtatcgaatatatcagactgtttacatatagaaatgtcatagattggagcacctccagcactacactgaaaattaaattattcatttcttcatttgactccagtttgtgtttttctgtgcaagatttgtttctttatagggtgtctttacattctttttttgtcataggtaacacgggctacacaaacatgcagaaaaacgacactgtcttactgcttgcttggtggtagggctcatggttttatagtagctttatacactatttcctctagaaacaaatccagcactgtaccattatatggtttacgtttatgtagcaagtatcttatatgcatttatctcctttaatttccactataatattgtaggggatcatatccccatttactggcaaaggaaactaaggctcagagaagttaagtaaaagcaaagctggtttttagttcatgactgcctatctatctaacttcagagtctttttgccacttttaataatatgtctgtgtgtgtgtgtgtaaaatttctttttggagagatcgttttattgttcaatagaaatataatacaaatcacaaattcaagctgcatatatgattgtatattctactgtagccaccttttaaaatgccaaaagaaacaggtgaaattaactctaatgatgtattttattataccagtatattgcaaatagtataattttaccatgcaatccacataaaaattattagtaaggtattttgctttctttatattattcttcaaaatttggtgtgtattttacagttcattttgatgtggactagcgtgtttcaagtgctcattagctatgagtggctagtggctactataatggattacactgagagagggagggaaggagggagaaagaaagtaataacatataatagggtaaacattggcaaataagacttcctgtatttctgcatgcttctgatcttcccttctttagtctttcttctcaaagtcaaacacaatttcttacatactttttggagttattctgtactcaggtaaagtgtgtgttcgtgtgtgtgtaggtatgcatgcatgtgcatctgcatgtatgtgtacatatatgtgtggtccattcaattcaacaaatgcttattgacaacctactatgtgccacacacttttcttgggacttggttacatcagtaaacagaactgttcaacacccctgccttcaaagactatattttagaggcaagagatagatgataaacatctaagtaagtaaattatatagcaagtgtgttagaaagtcataggtactgtgaataaaaagaaaaagtaaaattctgtgttggggggcagtttccatcacaaatagggtgctcagagtagacctcattaagaaggtgaggtttgctcaatatcttgaaggattcaagggggttagttacaggtgaatctcagggggaagggtgttccaagaggaggagggcagcaccaagaccaagttgggagggtacctgtcacatttgaggagcagaaggccagtgtggctggagtgaggcaagagaggggaacacagcgtgagtgaggtcagggtggggagtgcagcagatcctgtgtggctttgccactttgttgcactttcaaggctcctgtcaccactgagcctttcactctgagtgtaagaaggtctgctgtgttctgattagcagccacaaagcatcctgtggtacagaggatgtatttaccagtcttctcttgagatggatacttaggttgtttctgacctgtttttatcagaactacaagaccgtgtatatatcctggaatcaacatatctttgcacatgtgtgtgatcttatgtgcaggataaattcctaataatgacagctacaatgtctatttttaatttttctagataatgccaagttgcctctgaaaaagctgtacaaatgtatgtgatccacagtgtttgggagtgattgttttcctgttatcactatggcatttcatcaacaattttacttctgccaatctaataagcaaaagtattctcttattggcgtcactttgagcaatcactctgcactctaaattataaataatgtagattctaccccgctcttcctcttctctgggctgtcaaatggatttgcactttacagcgattatagcaaatattgctctgtatttacttgtgcatgtccttgtgttccactctttattataagcttcttgagagcagggctaacctcttatttttttacaccctctccctttgactagaactttgcttaattctgtttgaattatgctatataatcctatgtcattaatttactaattaaagttattgttattcagtgattattcaactgtcggtgaaagtctttgatttattgtattacctactcttgactgctagctgagaacaagtacgtattctatctttagtgttcaggatagaaatagtcaatttgttctcttatttttaatccctaaagtaagcatttctttaaatatacaaaaacctgagtaggactgaattggatacctatgtaggtgacagtaaatacagttaaaccagggtcctgtcgctttatttgcttctatctgttttgtcatcttgaaactatgcagcaatttctggcctgtagccttgggcatctggctgctgaggtcattaggccattgactataccatcacttagttttcagaatctttgaaatgtgatttgcaactggatttggacagaggattgtgtgctgggtcaggagtctgagcagcctttcctagcctgtgttcccagaacgtgtgggtccctggagatagtaacaaatgttccattttggcaatgctatactgtgtctccctcctccttgcacataagcatattaagcgttttgagaagccctgcgggaaagaaaactctttattccagtgtttctcaaattgatttgaccacagaaaaccatttttccccctagtaacacctatcagtatatcacagaatatcaattttctgcacagtagagttggagaaagagcagttgttttttctctgctttttattttataccaaatagaggtgaattatataactttataaataattattattaaatatatttaaaatttttatcttcatcaaatgaaaggtctctgtccagttacaggctagtttatagctgattgaccacagaaataggccacagatgaagtgaatatttttgtttaggatctattttgtaatagattccatcccagaaccagttagattaaagctaacatgacaaatgtttaaagctaaaattgacaaatgaagatgattttaaaaaaccagacccagctattaatttcctctaactatattacattttcagatacctgaaatgtggccaggggaatgattctacaacttctactgtgttgtcaaagatgccaactgatgactcctctcacgtgtattttaaattatggagatgtatttaacagacactgtcaactttaatctgcacatagaaattcttaattgtcccaaccccctttgtttcagcttgtttttcaggctttctaatgcattcaccttgcttcttcctattctctctcctccctctctgtgctccttaaaaacatccactaggctggcaattaggggctgagcacagatgcatcctttaatttaatttcacattccatcatttgaaacatgacccagtgtgtctgcttatggccttcagagtgctgggaaatcaatatgttaatttacctccatctttccaaatcatctttgcaagcaagcacctgtgaaatgagaggcttgcacaggggagggagtgattctgtgtaagagacagccccaagtacctgtattctccccctccccctctttgttaatgagctatattctaaagtatattagtaaattgactgttcagaactttgaatactttgttttcctgatgaaaacttgtttatggtcattaggattctaagccagcccttaaaatcccatggactgccagtgtatctaaagcactctccaaacagtacattgaggctgcaatagtacaagtgtagctccagtcccactctatcttactggaatgatatttccattcgtgtagcctatggttgcatttctttttatcatccaggtcatattcttgactcatagttagcttgtggtaaaaagaaatctccaaagttttttctacatcaaaggctccaaagttaagtctacacctccccacttgcttaggcctgtgcatattaataatgttttacatattaagacaagtgtgtccctgttacattccattcttttggattttgtcttactgttcaagttgagtgctttattaatcttcattaagtcacttcttaacacattaattcagttgtgtcacattcatattgggttgagtttatttctgtctatataaactgtagatagaactattgggcatggcaactttaagagctttggttttcagagcattttcataggaaaacatgatctcatttgagcctccctcagaccttaggaggtggagtgagcctgttaatgatcttaatgaattccatttctatggatggcaaattagaggcaggaagattgttccctagtcacacaatgagtatatggtggccctgaaagtcacttttcaagcatttggttttgtccttttactactacaggtcaatatctcattgaattcattgtcaaatatactgttctccatttttgaactttgaactttgatactttttttttttaactcccatcttctagcaccattcaggtttacccatgactatgcagagattaatcacagcagttcttggatcttcatcatttgtatcttttgatgtaaaccattgggtgtgaagtcttgagtccacttaaactaaagcactaagagctgcctcatagtatatttttgcatattatgctttctttgataaagaaaagacatgccaaaaagtttaatacttctgtttgctttttatattttcttaacattacagcagttaacccccatccccacaaaacaaaagcagtgatttggttcttttattttctttttgtttttattattatactttaagttctgggatacacgtgcagaatgtgcaggtttgttacataggtatacacatgccatggtggtttgctgcacctatcaacccatcatctacgttaggtatttctcctaatgctatcactcccctagcccccgaccccctgacaggctctggtgtgtgatgatcccctccctatgtccgtgtgttctcattgttcaactcccacttatgagcaagaacatgcggtgtttggttttctgttcctgtgttagtttgctaagaatgatagtttccagcttcacacagtgtggcaattcctcaaggatctagaaccagaaataccatttgacccatcaatcccattactgggtatatacccaaaggattataaatcattctactataaagacacatgcacaggtatgtttattacagcactgctcacaatagcaaagacttggaaccaacccaaatgcccatcgatgatttggttcttttctttgttcttgccaagaccagacataacatcattaacctcaactttcaaagttcccactgacctgaaggtaaatgcggacctcagtaactacgaaaatgtcatttctcagctctgcctccctttacccattccattgtgtggacccctacccatcactgaagaattgcagaattcttcctcctcttgaatttccttaacagacaagcactccagcttgttttggaaatcctttgtccacttggtgtaggaagtttcattttcccagctgccacatttgggggaaggtttcctctcttatatcttgccactcttgatggtctgaggcatggctaccagcttgtgctcaggcctaatttgggtctccagtgggtttcaataatcagtctaaatgagaaaagctctttccctcccatttgtgctatactttgtcacaagggcctcagagctgagctactttgtgctcaccaaagcctaaggggctttaaagaaggaatgcttttctatctccaatccccagagttccgcacaagcctagatgttgggggtaacacacaccaatgaacccaaaatcaggtgcccctctaacctgaggcctttaccttttcagatcaagtcttttagtaatagtagctttttcccttagcacatgttattttgttgatggtttcacacccctctgttaaagacatatcccattaatccttcaaaatgcccaactgtggctgaagcttggcaccaacaggattgatgttctcaatcagggactccaccaataaaatgtgttgctttcagcaattttctgaaggatatggtttatttggggttttagctccctgcactgtcatttgggattacattttagtattctttcttgattatatgacaattcctctgtgttttataatttctcatttaagatctaaacacacctgggagtcctctgcttaatcgctctctattgaaagtcagatgaggatgggatggagagctctagctctggacatcacaggaccaggtttacattctggcactgccatctatgagcacatgaccttggacaaataactgaaatcactaagcctcatttccctaaactataaaatggggatgatatcttacctatctcatggggctgttagaggaccaaatgagataaccatgtaaaatatctgcacagcatctagaatacaagttctccataagtcttggctatttagttatcgcctttattatcaccatatttattataattttcctgtggtcctttggtcctttttatgaaccatttgtatgtgcagatcctgttttaatatgttgaaaacttttctatagaccgtggcacttgcagtgagcctccacagatgtaacctcatttagatctgagacttttggctgtatgtggcccaaaccctaaggacttagacacttgtcagagctagtaaaataacatttcttattcattacaggcttaaagaactttctttctttctaaaccaacagcaggagactctctggccttggggtgggacccagtaggctctgaaaagccaggtcatttgtgtaactctgtggatctgagtgagcctaagaactgactcattcctggggacctctctgcgctgggattgaccaaaagtaaattatctccaagtctctttggaccaaaatgaaccccaaatttaattcagccttaacatataccctatggatctatagcaataaacaacatatgggcattactttatgatgtactcaatggtttgattttaattttatcattggctttataggaattgctgtatctatgtgtgtgttgtgtctgtgcaaggtcttgtatgattatggctcaagatatacatttaaatatagttgagacttaatggtgcattgtattactatattacatttgagtatcaggttggaaaaatgtaataatgagaataagagtatcatcattaaaaacgaatttaagaattttctgaatttaagtgggagattaagcctccaaaagataaaatgggctgtgagtgtgagtctgattctgagtcttcggcatgtctctgaatgataaactacaacatataggccaactgctgagggtttttttttctttctatctttcttttgagacagagtctcgccctgttgcccaggttggaaggcaatggcgtgatcttggctcactgcaatttccgcctcctgggttcaagcgattctcctgcctcagcctcccgagtagctgggattacaggcgcaccaccatgcctggctaatttgttgtatctttagtagagatggagtttcaccatgttggccaggctggtctcgaactcctgacctcatgatccacctgcctcggcctcccaaagtgctgggattataggcatgagccactgcaccccgccaactgctaagttttcactttgggcttgtctggtaaaataagtggaggttactggtaccatgaaatagggagtatgccttattttatttataaataaaaatgggagaaaatctctatgacagagtaaagttaaacagatccctgacccgtttggcttaccttttcaagcttcattgcccatgtggtcctcagtcccctgcttgtgtctggccactttacgggcctctaacattggcttgccccagcttctccaggtgctgacccagcggtgaccgtcagcttgctatttcccataatcttttttgaaaagattaaaaaaagtctgtcccatgatgtgcaagacctgaatccttcttttctttttattgacagaaataaccctcacagaataatcttggtcttgaccaatctacaaaaaataaatttgggatcacttttgttggtgaacttcatactgaattatactctgtccatgcactcttgaattttaggttccctgaacaataacttagtttgaatttgaagtttgacagtcctaaaggactgcttttgatattattcatttggctagttttttatttatttcattctttattcagcatttgctgtgtccactatataaaaatgaaaacaaaaactcacatttatcgaacacttgctataagctaggcactgtgccaaatgctttatatgttttagttcatttcaataatccatgaggtaggctttattattactcccactttatagatgaggaaatgggggtacaggtggttaaataatttcctccaaggctacaacctggtgagtggcagatttgggataaaatgccatacttgaatagctccaacagttgtccttcaaacaagttactaatttttaaattataaactcataaaatattgtttagttctcttattatctagctcttacttattaaacctgagagtgtcagcaaggtgggatgggaaaggaaacatcctcctttcctaatactctgttattttttgtgagttcaagaggtgtagaggtagaagtaggtatagccaaaaagacattacaaatattgcaaaaagaccattggttgttatagtgaacttgctggaaagggagattttttttttccctcctatattcagaggatttgcagcaataagagagataacgaagtgtgtgtgctcaggatacacagacttttctccatgactgagttaatttctcagacatgtgttctgaaaatggtacccgtgcccttgtcccctggcccacagaataatgcagtgaagattcctcaccacagggaattcgctgtttctcacttctcatgttggggtctggtggccttttcatgcttgagtcattttggttattaggggagaactgtttcataagcatgcagaaagaggaggtaaaacagtggttctcaaacttcagggagcataatcacagggtggggagggtggcacctgaagtttacgaggcctcaccttgagtgggcctcagtatctccatttcctccaggggatgctgatggcagtggtccaagaaacacactttcagaaaggctaaagtaaaaaaaaaaaaaaaaatttccatttggagaaagattcgtacagtgaatacctttgatggaggcagtgatcctcaaatatggtccctccacagcatccgcatcacctgagaacttgttagaaacaccaatccaaacctactgcgtcagaaactctgggggtggggcccaaccagctgctcttcaacagagctccagatgattctcatgcaagctcatgcacaagacctactggattagggaggcgaagtgctgttgtggaatcccataccattggttctcaagagtggctgcatgttggaattacctggggaggtttaaacactgggtcacatgcccagagattctgacagagttgatctggagtgtgggctgagtacaagaattgttttagaggtctctcagttactctaatgtgcagcagtgtcctctgggtcaggttacctgagttttttttcaccctgttatgtgaaaaactaagcattgcttttgtcctcagtcaccactaataaaatatcaccatatcaaaaggatagatgttattgtgtataaccagtgtttagctgacatatttattttacatagtatatccttacactatgacctgtgcatggaaaaggtaaataatttcctccacgccattgggaaaatcagaaaggtggttgtagtaaggacacattgttcctgccttcactccttcagcctgctggtgagcccactgggtcacactcactctcacacgttaacttcctcaattcactgaggtgcgtcatctgtattggcaattctagtctttattgccacggaagcaatttgcaaggttgcaagttccggacaacaagatctgtagcatctccagctgcatgtgtttgtatgtgagcatgcatttgtaggcagatacttcagtgatccacaattatataacttgggaaagtggttgcctgctacactgagattatataaaatattaatttcagtgaagttcatcagaaagtaccagtaattctcaaatggcatttgctggtggaagacatgcctactcagtttcccaatgttcctcctataagcaggagcaaacaatattaatctgctgctctgcctccaccttcaataaaatgtagaccaaatagagcatttaatcagtgtcactggatgtatagttctgtgactctagcatttctcaaagtgcttcttcaaggacatagatgttattactcattgctggagtgaattgattctccctttcataagcctgcagcatatacacatttgacaggaattgcgttgattcttaaccctcccctcttcctatgaggactgtggttgttttaacaaggcaccttacaaatgagttgttgtaccttcacgttgttcaaaaggggaagaactcgaggctattatcttgttataagatatcgccttactatggcaccaaaacatgtatgttatgtccatggtggacaaagctaaggagaggcacaccagcatcgtggcagggtcctacatctcaattgagtcacgtgtaaattatttgcttgtcttctgcttcagtggttatgtaattttctctcatgttggttgcagtttttcagcctacggcaagaaatcagcctggtagcctattaataccgtcaaaagtcagttatactgattaaagcctttttttttttttaatacagagacagccacttgctgagaaggcaaaatgatgtgactagccttcttcttcagcttttattgtttagttagatgtatcagagaacactagtgcctttaatcctgtctcagacctttcagttgaaataactctttaaacatctcaccaaagagggtattggtaataaaagtggttttctttgtggctttgttttttcctaagcctcttgtccttagatgcttcttttgagaactgcttcctttctcccctcctcccctcctcctcactcttcatccctcagagaagacatcttgttaaagtacctttattgaaaaacaatctgatatttgaaggtgcttcttcgtggcaaaaaatagtattttaaactgagtttccaaagtaaataaaataaaagcatttacattcaaaagctatccaatggctttctgatatttaaagctgattaggttggtagcaaaattaaagaaattaatccagaaaatgacaaaaaaaatcatttcagattttatataaatgcattaaaacgttgtagtatagagttttgagtctcctattacttaaagacaaacctaatgtatttgttatgggtagaaaattccagtggaaaaggggaagtagcagtgaatcccttatccatttgttcattctcttatccatagggaatgtttgcttaatgatgaatggattcttcagtagcttttactcaacacttcacttgctgggaatatgtttgtgtcaacactgaactaggaagagcaggttggaattccactaaataaaatccacaaatatgtcactaacaaatttataatttaatgaaaaaattagccagtcttggccctgactgttgatctttaagtcaaggttttgctcgtaacgtgagaacctcctgtactgttactgaatctccctacatggaaggccacccatgcagcgctcttccgagtgtgtttggttcctcacagggcagccatttggaaggaatgggtgaccatgtaggcctgatacaaagtgctgagaacacaaaggtgaccaaggcccagtgtctgctccccaagagctcacagtctggtgggggacatagtcatgtgacctcaaagtacagtgtgacaaatgctttaatgaaggtgtgtgtgccgtgtgctggcaaagagcaaggaagggagtgccagctgtccctggaataccagccaccttctagaagagtggccacatgcacagatctggaagacctgggtgtgcttttatagcaaggccaggggagcccctagaatggaggccagtcctggaaaggacttctgactccccagatatctctaccattcctggtcgatatatgaaattcaagacctggagcttcagccctttgatttgatatttcaattcttgttgaaaatatacttttcatggggctagtgtttcgagttgtcagccagtcacttatatcacagtgtggatgagctttatgtgtttcctctgagcatattttcatagtgaaaggaaaaaaacaagagccacagtgtagtgagtcctggaggaggatggatcatgggtgtagaaagttagatggtggtaccagaacagtcttgagtggtctgcaagttctgaagatcagctgtgcccacacactatttaactaaggacatcctatgtctgcagtcatttcctcctggttcattctcctcccatcttcttcctgtctccccatcttttctatttctgcctcttcctccaaatctagtgtatatttctttcactgaaatagagcaaggatggtgagttttcacaccgtttataaaagaaaaatactccttcagctttccttctcaagagcttcctgctcaacatcaattctacaaattatttgtttctagtggttttccctaaggcaatgtgagaaaaaagtcagcatgttccacagtggagaagccatgtgaagctaccatggagtgtgaagcaaggagagggtgaccactaggaatgaggattagatatcccaacccacagatgagaattagtcccccttcattcccttatgtggaagtccacaatatcacactcttgattttaagtaagatctaatttaaaaaaactatgacatttcctgtttcacttgcatagagcaacactgcaaaggaagaagatcttttcttctaaagaggagtcatttcaaagattgtcatgagtgtgaaggaagatgagagctttgacatccagagctctccatccacaagagaggctagaggtgttcagatgaaggctagaaacccattcaaaaaatatgcttcctgcagtgggtgcagcattgccctaaatgactccgaggtcatcttcaactttaagagtttcagaatctaggaaatatcatcaccaggcagatgaacaggctatggctaagggcctgtctcatcattgaggaagaccaaatgtgatttcaatgaagggtacatatttagtgagataaggaaatctacctcctttcagttctgcactctgttgaagctgcaagtaaataaacttatgagaaaaaatatatatacctaaactttcttatctatccaataaggataataatagagcctacttcataaagttttgtaaggattcgatgagctaattcacataaagcacttagaacagtgtttgaaacataggaagcacaaaataagaattagctgtgattagtaatattgttgttattgttacgttttacagactacttaagctgccctccttatctgtaggagaacacagcagtggctttgcaaaacagacaagagatagggggctttgctcaaatgcaagtgacattctttatggctggttacactttatcccaacaggaaaaaatataagaaaaagggagagaaaacacaaactccctttccaccccttgtccttacaaataactgaattttaataggtcttaataaatataaaggcttctagaatgtatccatgatttacaaatcatagatggggtttcagtaattgtaacccattcatttgctgtcaagtattggtgaacatcttactatgaagtaaagcacattcctgaaaagttgagtgtaaattttggtcaaaggtcttagtataagtaaaataataacttttcctcagtaatgctttctcttatggaaaacatcataaatgaaaaagcagttttctagcagttcagttgccttgaggttgcacttggctgatatgaacgtgatgatccagtagctaaaccacattaagactattaattaatagatggctgtagcctagagccaaggtaaaataattctagttccctctatctttggtattcaaactggagtttacattccttatattgatcagctattggcctcagattctttctcattatttttcactctgtgggcagttttctgtgaccagaaacacaaatggaacctatttttccaaatgattgtttatatctagttttgatttggacagccaaatggcccctctgcatggtccacatcacttttgctgctcttgttcacagctgcacagctttcttgttcacagctcgctcttggcacttagagtatggacacaatgtctcatagctgtccatggcaggctgcatttgccttgttaggcaatgtcagtgcttgctgcaccactttgtaatttgtgtcacttgaatacaagtgggaagacttgaggagaattttgagagaaaaatataaaacaaactctttgaaaatgtgtgagtataatacatgcttagcagatagcagtgtcgttggtgatttgtatataattattatccggttttaggtggtacttaagttctttgtccaggatgagaagattcatttgtgtacatcatcattatccctcctgacatgtgctttggtgacattaatctatgttttatttcctgcagctgtaatgatggggttgtcttccgtggctttattatgttgtcatgtttttttcagtgatcgtcctcacagtacaaaagaaatatctcatgtggggataaactccaaaatagctgacatttaacagtcatactggcaagcatctagttttctttcccttcattctttgtccctgtcaagctgagtcctggggaattatcattgactgtggtcagaacagtagttgtttgtaattttacatggaaaacatgtctgaggtggagcttgtttcttaagactagataacttgtacaggagtaggctagatggaacatcaattcaaaccggcaaatgactagctgattttgagggaagcttggaagaaagaatggattgcaagggtgtctgatttctagctgtagttgcagccagtggcctttgtagtttagagggtcagaatctaaatctgatagtggaagttcaaaggaaaacaaatgcaccaggtccttgctttaaggacagcaaggattagcttagcagtagagatctaataatccaattttaaattataaattttttataaaaattataattctttataaaagtgttgcaatttataattgtatcacttttatttgcattttcagtaacagaacaaactatgtgggcatggcttctgtaaacagaatatcaagactatgatgatcagtgactgctctgtacttcagctcaatagcccctgcaaacagcctcatatacaaaacacattaagcacagggaatgatgaaatgaaatcaaccagtattgtttattaatttgttagatgttttaataaagccaatccccagggcagaatcaatctgcgtaaccactgcacattgtatatgctccgattaaggcatttaatacattaccttgcagttgtgtgtgttcatgtctgtctcctttaaataaatatgagtttcctggagggcagggactttggctcatttctttttgatttcccagcataagcacagtggcttgtacagaatggtgttagtggtgtttgtagaattgaattgaaccaacttttgcatctatgcaccgaaggatttaagcagatgtttagccacaaattttaagttgtacagcatatattaaatcatacagcatatatgaagttgtacaacatatattattgaaattaacaataaggagaaaataggaaaagtattaacaagtaacaggaaaatgaaagagggaaaggaagactaataagaagactaagaagctccatccccttgtttttcattgtaggctcctctgatcagggattggggtcctcccagcctcctctgaccaggggcaaatgaaactgttgatgcagttgtggagtaggagtcttccttggggccaggtaaattgccttcagtctagaatctccttgttgacagttattccttgacacttactattgaggaaagttcatactgagcaagtgtaaatcaccagaaagtgtctccaaattcaaaatgcctgtatctcaaaattgaatgtcataatcatgggaagagcaaaaccatggagacctagttttcccattattttaatttattatgtgccaggctctgagttaagtgctatacaaatattaactgatttatttttcttaataactctgagggataggaaatgtaactatcctcattttacaggtgaggaaaccgaggcagagagaaataagtaacctgcccaagttcacatcagagctggtatggggtagagccaggactcaccccaggccacatggctacagaatccatgcttttccttgctgcaccacatttgttgcttctctcttgtttagttgcttaatgaaacacagagacttgaggaagctggggtttgattcttctagctctaggatttcttcagaacccagcttattaacaccataagtcctcgagactgctgtgttgaagcttctacttcctttaaaagtatatttaatgagccctgctgtgggctagactccaaaggaaaggcacaggtcaatatgaaatacctgtccttgagaagctttcagttgagtagggagataatgcatggcagagttaactgggtgccataggagagtcacaattccaatgtgacggggaacaaggaaaagaagaaattacatttaatggaggaaggaaatgagactttgtgggatctggaacattagagaaggtctccgaaggattggtaagtctggggttgaggcagtacgggcttccttttaggtaaggaaacaataagcaaatatgcagaaataagctggagcaaaaagtatcatggaagacttgcacccagctctggctggaggacatggcagatgtgtgggcttggatgacagacaaagatgcatgtacttaatttggaagacacaagggagaatccgtggaaatttttgagtggagaaaagacttgtacttaagaaaggtttgtctgtagtgatgcttgggatagaggaaaggcaagatttagcgaaggatctgttacagtggagtcaagcaggaaggggtagggagagctgaaaaggaaagaatgggatagaagtaaatgtctgattgtgctcatgatgtacaaaggcaagaaagcagagaccattttgcgaagtcagttgagaggcatggactagtaaatttgaagaaattgtggtgacatgctatgctgtcttacactgtgtggtaagttggaggttccatagagctcaaagctttcactgcattccactacctatctgacacactgggtcattttaacagacaaaggtgacccaggctacttttggggaattaaaaaaaaaaaaaagatactaactaacagaatttgaagtttgatctgagaaaagttccagatcaaattgagatgtgtggaatattcatattccgtaatcttcattgtgcagtcatttttatctccagttaaattcataatactcttctgttttcagaagtatttcttgtgatagggtttggctgtgtccccacccaaatctcagcttgaattgtatctcccagaattcccacactttgtgggaggaacccacaggaaggtaactgaatcatgggggctggtattttcttgtgctgttctcatgacagtgaataagtctcatgagatctgatgggtttatcaaggaattctgcttttgctttttcatttttctcttgccaccgccacgtaagaagtgctttttacctcccaccatgattctgaggcctccccagccatgtggaactgtaaatccaattaaacctctttttattttcccctgtttggggtttgtttttatcagcagcatgaaaacgaactaatacagaaattagtaccaggagtagggggttgctgaaaaggtacctgaaaatatggaagcgactttggaactgggtaacaggcagaggttgaaacagtttggagggctcagaagaagacaggaaaatgtgggaaagtttggaacctcctagagacttgttgaatggctttaataaaaatgctgatagtgtgctgggcaaggtggctcacacctgtaatcccagcactttgggaggctaaggcacatggatcacaaggtcaggagatcgagaccatcctggctaacacagtgaaaccccatctctactaaaaacacaaaaacttagccaggcatggtggtgggtgcctttagtcccagctactctggaggctgaggcaggagaatggcgtgaacccggaaggcggagcttgcagtgagccgagattgcaccattgcactgcagcctgggcgacagagcaagactccatctcaaaaaaaaaaaaaatgttgatagtattatgaacaataaggtccaagctgaggtggtttcaggtggagatgaggaagttgttgggaactggagcaaaggtgatttattgttatgttttagcaaagagactagcggcattttgcccctgctctagagatttgtggaactttgaacttgagagagatgatttagggtatctggcagaagaaacttctaagcagcaaagcattcaaaaggtgacttgggtgctgttaaaagcatttcattttaaaagggaagcagagcataatagttcagaaaatttgcagcctgatgatgcagtagaaaagacaaactgatttttttgaggagaaattcaagctggatgcagaaatttgcataagtagcaaggagcctaatgttaatccccaagaccatggggaagatgtctccaggccatgtcagagaccttcatggcagctcctcccatcacaggcccagaggcccacgaggaaaaagtggttttgagggctgggcccagggttgccatgctgtgtgcagcctagggacttggtgccctgtggctccagccatgggtgaaaggggccaatgtagaactcatgctgtggcttcagaggatggaagtcccaagccttggcagcttccacatggtgttgagcctgtgggtgcacagaagtcaaaatttgagttttgggaacctccgcctagatttcagaagatgtatagaaactcctggatgcccaggcaaaagtttgctgcaggggcggagccttcatggagaacttctactagggcaatgcagaatgcaaatctggggtgggagcacccatacagagtccctactgggggcagagctgtgagaagagggacaccgtcctccagaccccagaacgatagatccactgacagcttgaaccatgtgcctggaaaagctgcagacactcaatgccagcccatgaaagcagccaggagggaggctgtacccgaaaagccacaggagcagagctgcccaagaccatgggaacctgcctcttgcattagcatgacctggatgtgagacctggagtcaaaggcgatcattttgtacctttaaaatttgactgccctgctggattttggacttgcatgggccctgtatcccctttgtttgggccaatttctcccatttggaatggctgtgtttacccagtacctgtacctccattgtatcttggaaataactagcttgcttttgattttgcaggctcataggcagaagggacttgccttgtctcagatgagattttggactatggacttttgggttaatgctgagatgagttaagactttggaggactgttgggaaagcatgattggttttgaaatgtgaggacatgagatttggaggggctaggggcagaatgatatgatttggctgtgtccccacccaaatgtcaacttgaattgtgtctcccagaattcccatgtgttgtaggaagaaccgggggtgggggtaattgaatcacgggggccagtctttcccatgctattcttgtgatagtgaataagtctcacaagatctgatgggtttatcaggagcttctgcttttgtttgttcctcatttttctcttgctgctgccatgtaagaaatgccttttacctcccaccataattctgaggcctccccagccaagtggaactgtaagtccaattaaatctctttttgttcccagtttcaggtatgtctttatcaccagcatgaaaacgaactaatacatcttgctttctaaaaatatttctaaaccagctacattgtgtaaatatatgttgtttttttcacagattttgtaattttttctgttttatttttatagtaaaatatatgggatctttattttcttcctagatttatttgggtaaaaataataagattttttatgcatcaatgaggcttttcatttcatagaattgtgttggggatttaccaacaaccaaaaagatgaatgtaaagcaatgagaaaagttcctgaaaggtgctgaacatcattgatcatcagagagatgcaaatcaaaactacagtgagatatcgtcttaccccagttaaaatggcttttatccaaaagacaggcaataacaagtgttgatgaggatgtagagaaaagggaaccttcgtacactgttgtgggaatatgaattagtacaaccactatggagaacaatttggaggtcccttaaaaaactaaaaatggagctaccatatggtccagcaatccaactgctaggtatattaccaaaagaaaggaaattagtatatcgaggaagtatctgcaatactcctatatgtgttgaagcactattcacagtagccaagatttggaagcaacctttgttgctgatgaacctttgttcatcagcagatgaatggataagggaaatgtggtacttacacagaattgacttatacagacaaaaaaaatgagatcttattatttgcaataacatggatagaactgaaggtcattatgttaagtgaaataagccagacacagaaagacaaacttcacatattctcacttatttgtgggtgctaaaaatgaaaacaatccaactcacgtgaggtggttaccagaggctgggagaggcagtgtgggagggaagagaggagggatggctaacgggcacaaaaatatagttaaatacatgaataagatctagtatttgatagcacaacagggtgacaaccgtcaacaataatttattgtacatttaaaaataaaagaataattagatcatttgtaacataaagaaatgataaatgcttgaagtaatggatacctcatttaccctcatgtgataatgatgtccctatatgcctttatcaaaatattccatgtatcccataaatatatacacctactctgtactcacaaaaatttaaaaattaaagaagtttctggcacatagggtttagatggatttgactgagatagtggcggttatctagcaccacatggttagtggcagtctctgaaggcagaagggcttagattcaaaccccagctttgccattcattggctctgtggtctcagacaagttcttgattaaccttgacattctcagttgtcatctggtaatgatgatatgaatcatatggcaataaggaaatttacctcattgcaggcaggattaaatgagatgatgcatgctgcctggctcaaagagcttaatgctagttaactgcctcttctaccacccactgccactaccaccttcattatcactcctaccaccttaattcccaccattactgaggctctatgaagtgagaaccaggtgttcatcagaaaaagagttcttataacatgaaacattattacatgatacaagttttagactagttttaatatccaagtcaaggatctattttcaggagacaggttcactgcgccaatgagttaatgctcagttatacagaacatggtgtcccagccagaattttctaaagactaccctgaagcaaagatcgaaataccaatgcttcattggggatatacaaattcaggccagtgagatgaaggaaaagggaagagagtcaccaaaagacaaatatgatatgattgcactcacgtgaggtgtctaaagtagtgaaactcatagaagcagaaagtagactggtggctgccagggtctgggggaggggaaatggggatttggtgctcagtgggcatggggtttcagttttgcaagatgaaggagttctagagatctgttgcccaacaatgtaaatatacttaacactgctggtctgtacacttaaataaggttaagatggtaacatttatgtgctttttaccataatttttaaaaggatgggggaaggaggcaagggaggaagtaaagcaacaggaagcagtggttccagggctggttactgcttctcaagaccaacaagggacacagccattggccatgcagctgcacccacttgccacatggaactctactggataggctggagaaaagaaccacactccacaacagtgaaaaagagaggtgagggcatttatctgccctgctctctccccattctcatagggcagagttcaccccttggggagtgaattccctgacatttccaggttgcattggcctctccagctgtagtgtggactgccagctcccacatctgtgagtggccagagaatccagaaacttcagctgggtaacggagaggtcccactgcccagccacagcctcaagagaacattcaacactcccagagcaggtgacgctggtggtggaaacttagttccccaggtgggaggaagcatagccaagggagtatgaagatgtgcataagacttttgtctgatacacactgctatccttttttgtgctaatgaattcattgctactatacctttctttgttattttttaacaatgtaaaaggctttgatattagggtgcctcatattagaaaccactgtatggtgaccacctggctggatgtagagcatgaatgtaaaatagttcgccacattctttgccctctttgcctttggaaggaaaaataaagtgagtcctagttagttatttatcacataatgcaatgaaagagagcagctttaagagatttcacatttctaaaaaaatattaaaggcttgttttttcattgcctttttactgttttaaatattagcaggcaccactgtcaaaatgtgttctcaattcctactctggaatttttttaataggaaaattttctgataaagatcacaggtttcctgatgttttattttggcccactttcttttgttttactagaataatcattatgtttgggaagttatatccatcagtattccctagcaaaaagatataatggcattttagaaaatgtgaaaatcatactcgtttgcttcttcctaaagggtggcatagttttgtgtgtagtgaaatggatttttgatcattgccttctgatcaatttcatgatagccaactagatgaaagggtatcagaatgaagcaggcagactcagggaaattggcttcccaaaatgctggcatgcagttatttttagaggcatctgggctttctaccctcttattactttctatcctcccgttttcatttctcctacatgaaaatggggacttcctcaggctgattttggcttgagaatcaagagaactccatgttagtcttacttctggaataatggtatcagctctgagtgttaaagggcagtggtttagaaaaaattgtgcttttagatcctgtgagaccctaccttgagcagacagtgtagtgacggctctctgcccttgctaggagtcagaatggctcatagaagctgcaggagatagaatatgttgtctctctcgttatttaaacccgcaacttaatctaattgtatcctgtgtgtgcatgtgtgtggatgtacacgtgtgcttgcttcattccacctataatccccaagaaacgctgcggtgtgtgttgcagcttttggagggaagtgggcacataagacttacaaacaccttggaaatgtatgggttttgtttcaatttttgataacatagactataaacctttgcagattttcagttttaacatttgttcagcagaccttttttcagttacttgtggctagattattattgaatgaataccagatgtatacatccatcgtctatattcctttgtcaaaaggaaaaataaaactactctggaaaatcacaacagatcataattatttaccagcaggttgtcacttaacccctaaggggcaactaagaggagatgcatttattgtggctggatttgatgattcacactgctaagtgttaaaaggagagggaaaaaatgaaccatgtttatccaaggaaatgctgtttaagcatgacattcaagtgtgaattgaatacattgctggatccaacagtaacattttctcaccaaccatgaaaaatcttttctttttctgttgtgttctaaatcaaactcatatataagctttctattagattaatgcagctttatcagatactatcagtcatttaaccactttcagtaaacattcattgagtgtctgctatgggataggcgttaagaattcaaagttaaataaaatagtatctgctttcaaggatctcacaagctgattcagacagcaatgaataataaatatacataataaatgctctgggaacaaaatgaagagggtgattagttctgcctaaggcagagggaaagactttgagtggaggaaaccttgatgtatgatgaaaagataaatgaagatattggttaaggtaaataatgctagctgctacaacagagaaactcccaaatctcagtggcataacatcataggtgatttatttttcacttaggtcacaggtcaacagctcaaagcaggtcagcagtggtggaaggtgactgcgtgccacagaatgatttggggaccttggattcttcctactgttactttaccatgtcccagatccttagaataagtggtctacagatggaagtcaaaaagtggccccattccttccattcacattttattttctatgattcatatacgtagccacatctaagtacaagagaggttggaaaatatattttagccatatgcccaaatagaagagaacacagatgttagtaaatactagtaattttgctctagtgagattattttacattgagaaatggggtcggatagccatatacctaggatataagagcatgaaagagtttgggaagggaggaatgttctattttggctagaatacacagcattggtgggtaggggctggggagtcaaagagaaataccactacaaagttagttcagggctggattatagaagatcttaaatgccctactgagaagtttccgctagcgtttgagctatagttctccattgttgtcttattttcttggctaaaatttatttttgaaatagatgttatatttattctattatttgaggcattatattttggtaatgtaatttttaaaaactcaagccttattttttttagtaagattataatcttgaagtcaagggtcacattaatgctttatatatttccctacagtttccctagacagtgaagcacaaaggtatccagtgtttaattaaccaggtgataatttactaacagcttcacagaaatggcttttatttaaataggtgtaggtaagcaatgtctctggcccatggtactgtagctaaataattcagttcatactgaccagcaactaaggggcctctgtattatgccatcaaatcacatatatcaattgcctatatgtataaggctgtaagttggatataatagtgagaacaagtccttgttctctaggtatttaaaattgcaaataaacaaaatgtatgactgtccttggaaaatatgatattttgaggagtactctattcagttctgtatcagaatgcacttggtttaatttactataaaactaaatgttattttatgcttcaaactagaaaacactttaaatatacatgtgaatttagtatctttgaaaacagaaggttaatgaaactcacagctggaggactatgtaggtatttgataaaaatgcttgacaccccaaccagtgcacttcattcattccaagctatgatcctaaccagagcctccactgtgtcttaaatggaagcttataacaataataaactgttacattatactttgttatgactgttgttataaatatatcgtttcataatatggacaaatcttttctctctacaagaagcattttcatgaatgatttgtggaacagttgaggtcctgccagtgagaatgataatctagtattctctctctccattcctgttacattggccccttggatttgtggcatgcttaccttattgacagtgattcattatggctttgtgctttgtttttatttgaaattgcagcaaggtgatgtaagtcactttagatttcacttcccaccattggatcataatgtagacattagcttgtgacacatgttgtcagcactttcagattatatgtgaaacttaaaagcagatttgccaagtttataagcgagataaatttgacacaaacctaaatctatttattttagctaaacaaaccatgaaatgtttctcattgaggttaatgaaagcaccaccctaaatctatattcttatttaattcaatgcccatttatggagcatctgcctaagagccagtcatgaatatcaagaagacctaactcctgcccttgaggtgttcacaccagcagaaagagaaggcttcatggaggaggtggcttttgaaccaggttagaaatgaaataaactaagcattcagtcatcatgccctggactccaccttacccttttggcagaaacaatcctgaatgtttttacctttaatttctgaagtgtgtgcaagaggttttgggtttgggtgggtacagaatgcagaatatgagaagagagaatagctggttaccccttttctgcctgtactttgagcatccgttaagagccacatccctcttagcttctctactcaccgaactcctctatctgtcttagttttcctagtattttattcttctgttctccttttccttttcattacatttagagttgatggagatacaatgttcaatgatggaatgtaaagtactttggggggctttcactctaatgttcttaccttagggtctaaaataagaaccctgcagagttccacaagctgcatttacaattctttctcaatttctcacttgggcactacttttattttaacttaaaaaaatttttttaaatgaatgttatcctcccaaaagtaggctactataataaatatatgaacatgaaaaagaataaagttatagcaaccttagaatattttagtctttattggtttaaatcaatcttcctattactttaggagatgaattactgttcattgcctatgctgttttaatgatcacatgtaaataatttattttaaattctctttgatatctgtcatttggtgacttaacccctatttcacaggtcttttgcttattttatgaaactctattgctgttagaatgtatcatttaaatctgtgtgatggaattctctttgtgatctgtagagactttggcactcctctaatgtaacagatttattcaaagttgttattctaatgcagctctctgtccttaaagctgcacagtgtcaaacctggattgaccctgttgcctctgggattaaaccagtggaacaaggtaggggagaatgggttgcctccttcacccagtgtgtgaggttatacctatgcccagtttcctacaggacctgtgacctcctccccttgacaggtagactaaagtagccaggggcttgtctttctctgacaattcatataaacagctggcaccctatattgaggctctcaggtaccaagcactgacaactgcttcccctgctttacctataaaaaggggacacacaaaagaggaggatttcttcactgaaactcagactcaaactgcagcaatagcagcaccctgccccagcatgcttctctgtgggatgatgaaaggatcaagggacccttggcatgtataaatttcctaataaagcctgttttttaaactcatgccatggatatcatagaattctccccaaacctaaatgcttgacaggtggaattttcctgttatgacagtattgggcaaaggaaagtaagctgatataatctctgctcattagagagaagaaaaatgtgtgaacacatcctatggtgtacactgtagacatatacacattggaatgccttgtctccagtttgttggggttgactttggggaggcagcagaatcagtacagattacctcaagtggtacttggttttcagcctgagaaatgagaagactatgagatgaaataatctgcttttgtattaggcaaggcattaagagaaatttatttctctctctgtatccatgtggacacaagcagtccaccataacagggagccaggctccttctatgctgctgctctgacatctccggggaattttcttcatccaagatgcctcaccaccattatatctgcattttggccagcaggatgggtaaaagggttggtggtggcagtagggagggggtcatccggaagatgcatatgtgaattctgctcacatccagttgctgcaggggaggctgggaaatgaagtcatccccacttattcccaagtggcaaaactgccaaattaccgccacaggaagtctaactactgcataccggttagaaaaaaggattacagttttacaaaatcaacgtttaagaagagtcagtaaaacactgcagaaaatatacaaattacttacagaaaattaatttagagaacagaaatagcctcatcagtttgctcatagccattgtttgcttatgagccattgcatggtacacagctgagaaaaggcaagttaactggggtgaataaggtaggggccattgagaattgagttggtctctttcccaaattacactgagtaaacaattcagaaaaacaggtggatcaataagtggtgtcatccattcaacatttcctttatgcccagttggtgttagatgttgtccttggaattatgaaaatgagattggattaaacggtttttcttcgtgagtagttcacattctaatgaaggagatatacatgtactaattaaaacataataataaaaacacctagctaaaatcaggggttctataaaagaagagtagaatgggaagaatggatacttgcgggcaactagcagtctctgatacagtttgcatattaatgcatgcactcaacaaatgtttattaagtgtctgctgtgcattatccctgcctaggtagtgatctgtctgtctattgtttatatagagaagtctgggatttaaacatgtaaagtatataagaatggttacctctagggatggatacactcaggtatagtacaaatgttttatagaatgcatgttttatccctgttatttaaacaattggtttaaaaatggtagcagcaaacaaattagaacattgaatctgaaaagataaactcaatcttttcagactcaatgaaatagaaaaaaagaccatatagaaagtccacacagccaagaaatcgtagaccatgtgtagaatcagggctgtgaaggaaagcagctttaattgtttgcacaacaaatatagaattggaccttaaagtctctctagatccttaaaccacatcatcctaaggctgctagacacatacagtgttctcagtacagcttggggttagttggaacttacgatagatacatgccactaacactggtactgaaagttaaaaggcaacctggcaagaacaagtaccatgggaaccatgtgagattagggattactattacccttattttacaattcaggaaactgagctaaagagagttaaatatgacttctaagattatacaactatgtatggtgatgccaggatttgcacccagactctaaaattcttacataagtaactgaggccaagcatggtggctcacgcatgcaatcccagcactttgggagaccaaggtgggcggatcacttgaggtcaggagtttcagactagcctggccaacaaggtgaaaccccatctctactaaaaatacagaaattagccgacatgatggtgtgccctgtagtcccagatacttgggaggctgaggcaggagaatcgcttaaacccagaaggtggaggttgcagtgagccgagattgtgccactacactccagcctgggcaacagagcaagactccatctcaaaaaaaaatacacacacacacacacactgacaataaacaaatacatatttatatccacatttgtaatctcatttacacatatgtaaatttatatatatgcataaataatgtattctttccttataatctctgaatccgtattacgtgaattatagttgattgtattcaatgtattatgtaactcatcttttattccctttggagttaaagatcaaatatttatttttatttttattgagccagacactctgtacatttcacagagttcacaagacaaccctgggggaaaaaaatgttggtattattaaacccattttgtagattaagagattgagtttcagaaaggtcaaatactttagctcttgctgggtatatgcctttgctcaaatctgaatacagacttatccctcatccccaaataagcttttcttactttgtgtgctattgtgcccattttccattccctgttggcctgaaataaaattcctttttaatccattttatttttctcttaagctttacctatgtttttcatcccaatcagaaggcacggaaagaaatgcttcttttacttcatgtttagcagatgtaacttacattttgagtctctgtcaaggatgtgtagcttgcttgattttagaagcttctgctgaaagatattcttttcatgtacacagttgcctcttggattgtgtaggcagcagtgctatggttattagtcaagttatttaatatcctttttgttagcttagttttcaatttttaagtagtttatacagccaaggaatctggatataaattttatttactcagtttttttaatcccttatattctttctagagatctagttttatttgagagtgtttaatatgttcatttccttctcagttcacttcttttctacatccaactaaataggctcttttggtatttctaatcctaaatccaaaactgtccttatctatttatgctctatttttatcataatatgtaacttaatcttagctaatcagctcaacctctcatcaccattattgccataactcagatgaatgtggcttaatttattataatgctattttgcccataaatggattctaacaatttattgttctgctagcagtggcctgcagtgggcagggacaatagatacctggaagccttcccagctgaaaaataactctttcctgtaaactgtcaattagaaatccatttggattagcaaattcccttaaaatgtcaatgcttgctgggaatgttaatccaatcaacctttcacaccttagtacctgagatcttattttaatgagataatcatattcttttcctcttagtacctaattaagctcagtcatagggaagtagctaccctgtgggtaatgcaggtattctaaggcattccagggggcatctggtagaccagcacgagtagagagcaacaggagggtaccaaaggtggagaaagacatgttcccacttagtgccttaacaacagctttcttgccctttttgtagcatgcacaatttccccaattctataaaaaggtgcctctcaaacgtcaatgtgcatgtgattcatatagggctcttaatgaactgcagattctgaatgaacaggtctgaagtgccacctaagattctgcatttctaacaaacttccaggagatgccaatgctgctgggctgtgaacacattttcaggcttcaatgctatgaaatatgcaatgtatccatgaataagttatggaaataagtggctctttggatgttctttcatttataaattttcttttagctcttcttatagagattgatttctcttctaagttctcccagtcagttcagcagctttattttatttttcaaacaacaagatttctgatgtttccttcccttttcactgtttttatattcaatcgatgtggcagccagcaaattctgccaatgcagaatttgtattgtcttctgcctgcactggtccttcctatggtgttcattttgtgaaatatcctaagctaatatatttgagaactaactttaagcacaccaacttatccttttcaaatttgaagctttcagtatcctccacagcagccaaagtaccacccatctctgattgggtgttgctgaacagaggggccctgcacttcagtgacctggctttgccgcttctgaccttacagactatactctgatcactgaacatctctcctgtcatggcttctgggacacctctgtgccctgcttctaaaaggtcttttttagtacgctgtactatctttacctctttcctttggtgtttctgaccttttcttacattttgaaatgtccctatccctctccttctgcatgtcaagtcttatcctttttatgatattcctctaagtttacttctacttgctctgtgaaattggtcatttctctctgctctgtgaagtgctttgcataattctcctacagcatttatcttctattgtagtctttcatgcgtgtatttgctttatccactggaaggtaagctgctcaagaacaaaaacattgtcttgcttatctttgtgtttagaactccaagtgcaatatttgggacctagtgggcatagaataaatgttgaatgaatgactacatttattaatcagcctgtttttccttattatttactctatgtgggttctaatttatttactctatgtaccttgtctttcttcagctttgattcatctatagtcttgagcaaacataggaagtctttctgttctctatatgaataatctgtaagtcatttgtgtattttcttcagggttttactgaccattcctaaatgctgattctgcaaaactgcagtcctttttactgactagtttatatatgttggagtctgacatcctattgaggtaatttggcagctttaccaccagggagccatagaaatctccgtgttgcttgttatctatggaccttatctgatgaagcaatcctttcagttatggccatcaggtgacgtgtaaaatgtttgtccctgaaattcaagtggcccctgcaaagcgatactcctaagtttgccttttataggaccagaatgattgttaaaaccagaagccaaattcattaatttcttgctgtgatatataacatagccatacaatactacacatttagtaaatgtcagcagtattaatagaactgtctgtaatataattgagtaagatttctgtgtataaaactaaattatgatggatgagttactcaaaggatgaaggaaaataacctttaagtagtgtcaaaggctgggcggcactgggttgtatacagagaatgaggtactgagactgaagcactagtagctgggctaatgtgcaaagacaggagatatatgggctgatgggccaggcctctaggagaaccaggcaatgaaaggttaacatgtagctggaggtctgcaatgagtttagcagtccagagcagattgcttcacaatcaggaactattattcaaacaaatcttggcggtcagaatgcaccgtaggacccaaacccaggaagacagaccaggcagcaggaatctagctgaggattcatggagaaagaggaaccagaagctcatcaaaaatatctgtgtaggacatatagggcattatgtttattatctcccgggcacagtgtcctaaaaagagcaggctaataattgcagaaaaaatgtaatgactagagaaagcgtgaaagggaagagaaagcctatccttataggaatgaacctttttttttcaggaatagaagataaatgtactggtgtggcatgatgggaaaacagtataataaattaaattagatttaggcaatgttttattactttcattttcatgtatttatgtatgtactcatttgcttgtttattaacttactctgttacttgctttggtaactttccactggcagcacctggaagaatgagagctaggtagctctctagagagcatgctcatagtatgaagataatattttaattaagacacaggaagcaatggaaaagcactgaaggaacctgaaaaagaaattactattatcatagataaggacaaggaattctgtacagctataggatctgtatttttgagtggaaggtagagaagctactgtcaatgaaaattgcctcctttcacttgaatatgtaatggaggaaaggtcctctacaaagatttcagtctttccatagctgtagcccttgtggcaatccactggtaactgatgtttttgaatagaaaattgattaatttaccggcacaccaattttaacactattaactttgtctggctttattggataatgttggctttcctcctcctccttgttatcttataatctggggatttgcacagtatcctagacactccaggacaggatcctggtaaaggttgagtgcatggccacacacacacacacaaaaaaaaagcctatttacgttatggacatcattgattcaacttgtcccttggaaagtatgatcactatttattctggctgatatattgacttcttccaggtccctggctcttgatccacggatctaattggatcagtcataccttggcttctgaaagggttcctcctcatgacccctactctgtttaggattcataataaagtttccctggtcactccaccagcttggataatagcaagactcctgctaccacccagacttaatccttccactttgggggaggttgccactcgcccagtggttctcagcattgtttctaccccaacatatttgggaatacaactatacctactagtaacctacagctataatcattccccaaaaatattttcaacaaatatttaatgagtacctgttgcatgccatctaatccctggggtagatgttaggtgagtaaatgcagtccttgcattctagctggagaatggttctcttctttatttatttttcatgtctattattgctaccatgggttttggacggctgcttgtttgtcttaagaagtagacatctcttccaatcaggaaaggctgctgtttctgtggtacattgaaaagtttcattttctaaatgctacctgttcttatgacagagaggtatgtactgttctttttttcaataagaatttaattcttacattgactatttttcctcctacttttgctagtcattaactgcctacaattaactactggttttaattgtcaaaaatagataataaatttgactgacattctctattttttattacctcatcatgtctcatttgcccttttcttctctcagcttgccattttatatgatcatctagggaaggagcagccacttcctcaaatgttgttttctatttcctgttctatctctcacttgaaacaactttgcaatgcacttttttttttaacatttttctgagtaaatgagtgtattatgatacaccagaaatagccatagatccttcttatccaaatagtgtaaatctgtttatcacttcctttccaattaacctttcttcaagatgatcctggaagtgctgttgttgtttttacttgactttataatcaccttcctgtagtaatccattctacttcttgaggtgctggtagtcttgtcaggatgcccttgtgggtggcatagctgcgtgtagcaatttatactggttccttgaagattacaagcaaatatttctgtttggtatcagtttctctccgttttcctaaggaaactattttattactagttcatttgtaacaaaatatcccaacttctttgaaagaaagatgagttgaggtggcttccagtaaaaatgcaaatataacagcacagttaatgtcagaaagaaacaccagacctctcagagaggaaactttatggagttttcagtactaaacctcagagaaactggcagccctcataaatcaaaggcaagaggtatgaaaataaagtaatactagagcagggaaataacctagttactgtataaagcagagaagaaaaaggtacagtggtgtataattctacactttagtattgtgagctgttgacagaaaattgttttctttagtatgagttgagtgaagaattggtagagaggttgggaagcaatgaaaagaaacagtgcttggcaaagaaaagcataaggaaaaagctggctgttttctaaagatgggaagccattatgtttagaaacttgaagaatattcacagattagtgatggtctagtctgtcctatctgataataccatagccactagctgcatgtggctggctatagagcatttgaaatgtagctagtccaaattgagatgtgctgtaagtacagaatacataccagattccaaatcttagcaaccccccaatatgaaaccttaataacgtttagattgattacatgttgaaatgggaaatttttggcattaaataaatattattaaaattaatttcacatttttttatatttgcttacatgtgactacagaaaatttaaaattacatatgtgacacacataatatttctactggatagtgctggcctagccccataccctgttggtgggactatcttttatctctgcgacaagttaactttctgaatgccgatcttactttatccccacattttccctctgagttggttaatttctttttaggtagttgttttatctgttttggaaagtttatttttaatgtaggaggtggagatgagtaaagagaatgtatagcataattggagaattattttcatggacaagccctacagacaatccctttgaaataaagggtttttaagtacttttttaaaaagtaagaactgctatcaaatgttgattatggatagatatcctatacaaaaagcacttaggagaagaaattgcttcagaataattctcttttatttgtattagtaggagtagatgttgcatcttctatgaaagagagctgggaacaattgttagagaaaggggagctgtttttctgagcatcattcttcacaaccaagcccgtttcaaggagccttggtcaaattggacattttttttctttaattgaatttctagctttgaaaattaaatgtgcatacattgaaagcatatgtgcccatatcacatatgcatctggctatgctgagagagaatatgaactcctccacccagggttgagaaagaggactttggttggctcctgcttccagcatgtcctagctctttaatcttagtttttttttttatctctccaagcctaatttttctcaaatataacgtttaaataatctcattatatattcatgagttgttgtgaggattgcatgagataattatccaaggcatctagcacagtgtctggcacattagtgctccataaatattaactgctcttatagatgtaagtttgattctaaatacagtcttcatttacctccctatagtttggcttgtattcttctaatgggatgaatcaacagaaggctaagtggtttttccaacatctttaatgagttaaaagcacttttggcgttagaactcaggtttcaaaccatctatgccatgggccaggagccagaaattatttctggccacagttcagattctaggagaaaaaccggagtgactgcagtcttaacatcctttgttgaagtcaagaactgtacactgatgctgatgctgacatttgtatcacttatgactcataggcacggacaggggtgaggatggtccagttaaattcagatggccagatccagctgaggaaggcaaacctgaaattagatcttttccatctagggtaaaagtggggctaggaaggccagacagaatgaaaaatcggtgatttttgcaagatgtatattcatcatcagtgatctaacagacatggcatagcaacaaggacatctgattgccagaccacacccagtcaccaggtttcttggcacagctctatctgaggctctccttagttcacattaagggcatctgtcagaagagcttggataaaaatggcaggactcagggtcacaggggagagctgacaaggggaggatctcagtcttgaggctgctgggctgcagacttggggacagactcagcttcctaatccatttcctagaattcatgagtgaggaagatgggtagagactactattgaggactgagcctcaacagacttataggaagtttggcatgatgctgatttttccttattcagtattattccttattctcagaacatgaaaggaggctgggtttcaggttagaaagaggggactggatggaggactggtttttttttttttattttattttaggttctgggatacatgtgcaggatgtgcaggtttgtttcataggtaaatgtgtgccatggtggtttgctgcacccatcaacccatcacctaggtgttatgcccagcatgcattagctatttatcctgatgctctccctctcctgtcacttccctgcccccgcaccatggaggactattaaatgctcccctcactaagggaatcagaatctcaataatcagtttgacaaatatggctatcactgagactgtgggatatctcagcaatgcctttaactggtgcatggggcttggagccaaagattccttcatagaagataaagcttctgcttgtgagatgtgtattaccttatcaaataagtcagtcagttgcagagtaagactgctggctccaccatacattctttgtgcaaattactttggccttctaagcctcagtcttttcttctgtaaaattgagataaattataggacataagagttctgtgaggtttacattcatcatcaaactagaaaacctggtatattcataagtactcagtaggtgttaatcataatgattattatctaatctcttagttgtcctgttggcatgagttacagtagacaaggtacttctttgatgactttttagcccagaattttatcgtgaccagagcacattatagacccggtgtttgtggtcactggagaatgtactgacttattaatcatgttaatctatgaacaaatatataaggctctccaagtcaaggatcaaagttcctggggaacctctgaacaaagtgaaggacagaagaaccctgagtatgtaaaggaggaattgggtaggatggcttctggcatgagtggagaggcaacgtagaaaagtcagcttccattctggaaacagatatacaccttcatgtcattgcactaggaggatatcaagggcatttatgagtcgcctttattctccatacttaactctcttatgcccacccatttccattccttctcacagctggcatgctaatgtaagcccccatcaactgtcccctggactatcactggggccttgagctcatctccctgtgtccccttttgctccttctgacccatcttcttcacatcacaggaacaatctctcaaaaccaacaatgggccttacctctttttcctgcttgaaatcctctgatggtttcatatgtttcttgcaattaaaaaaaatgaaataagtgggtgggcgtggtggttcatgcctgtgatcctagcactttgggaggccgaggcaggcagatcacaaggtcaggagatcgagaccatcttggctaacatggtgaaaccctgtctctactaaaaaaatacaaaaaattagtcgggcgtggtggcgggtacctgtggtcccagctacttgggaggctgaggcaggagaatggtgtgaacccgagaggcggagcttgcagtgagcctagatagagccactgcactccagcctgggccacagagggagactctgtctcaaaaaaaaagaaaaaaaaaagaaaaagagaaatctatgacatcacttgccaggctcccatgttcttacctctgcctgccttgccagctctcctcctgctgtgccttctctcagcccatctctgcacttcttcccagtccttcaacacctgtgcttctctctgcccccaggccttccagccagggggtcccaggcaccagaagtgaattcccctcaacccccttctgtctgccctccttcccacgtgaatccttccttgattcctttcatctggtcagctcccattagtatgctctctttgcagcctgccctttctcttttcagtgcgtgatcacaactgtattaggcaatcacctgtctaatgtctgccttcttaattagaacttcaaattcacgtgggcataacatcggtctgccttattccttgtggtatcctggatgtcgaacataacacctggcacctggtgggcaatgattaaatatttgtggaaagaatgggcaaaataaaagagtaaaaaaaaatgagtgcaagatacagtgaagtgatgtggcaatattgctaacttttaaaaatattgtcaaagagatactgagttcgaggaagaggaagatagaaattatgctggaaatgctggagagataaggagtaatgagatgactttctgaggtgagctcatgcctgtaatcctagcactttgggaggccaaggcagatggatcatgaggtcaggagttcaagaccagcctgaccaacatggtgaagctccttctctattaaaaatacaaaaattatctgggtatggtggcacacgcctgtaattccagctactcaggaggttgaggcagcagaatttcttgaacctgggaggcggaggttgcaatgagctgagatcgcgccactgcactccagcctaggtgacagagtgagactccatctcaaatttgaaaaaaggagaaagagatagagggtagcctggaaatcactagaggtgaaacagaggacaatttgcagaacctagaaagaaaaaaacgagtcagtcacagtgaactgcaacctaagcaaacaagcatcttatgcaactgaggggaatgacatagtaacccctgtatccaagggaaggaaactgacccttgtttagccccataatttattcaacccacccagatgcacacatgatcgtggccagctcttctaacattagtattttttgccgcttcgcagctgtacctgaaaatccctgatgaatagttgtcagtctgcagagcccagggaatgttagaatgtaagggttttaacacaatttcaaaaaaaaaaaaaaaaatgacttgcaaactgtatatcaaagcaagcactgatgtatattcaatttgcagactacttttccagaaaatgtcatagtggatcttgtctagttccaatgtatctttatggtatcaatttatctacctagtgaaattctttccaaatatctttttaaatttttcatataactttttttcagggacttttagtagcagatgaatatcaatttaaacatttaaaatatagttgacccttgaattgcatgggttcactagtgtgcagattttcttccacctctgccacccctgagatagcaacatcaaccccttcttttcctcctgctcctcagcctactgaacataaagacaaggaggatgaagacccttatgatgacccacttctactcaatgaaaagtaaatctattttctcttccttatgattttctttctagctttaagaatacagtatataatacttatacaaaaatatgttaattgcagagtttgagaccaacctagaaaacatagcaagaccctgtatcctaaaaaaaaaaaaaaaaaaaaaaaaaaaaaaaaaaaaaaaaaaaaaattagccaggcacggtggtgcacacctgtaatcctaacaacttgggaggttgaggtaagaggattgctggagcccaggagttggaggttacagtgagctatgattggtgtgctatgatggtgccactgtattccagcctaggcaacagagcaagaccctgtctctgaagaaaaatataataattgactgtttatgttatcagaaagccttctggtcaacagtaagctcttagtgaagtttggtgggagtcaaaagctatacacagatttttgactgtgcaggggtcagccctccccaacccctcagcattgtttaagggtgaactgtttatgttcaccttctcttcttctcctgggtgccacatctcatatgtgtctcaagatccctcttctcattcagctgcatgatatcccaagggccatctttgcccactagtcatgggggagtggagggagtgcctgtaaatacagtttaatgctgaggcatattgtctttgggatagagtcaggctgaaaatgattaagacctgggattatggagagatttgtcttcgtaatggcagcttttgcatctggaagtcccgccacttatgatcgattgccctgcttatttggcctattttctcagactacttcttgatggtctctttcccctgacaccttactctccccttcctgtcacctttgttctcaggttttctcctctcttgtcacctccatttctttttttcccctcctgctgccacttaaacttttttatcttcctaccaagtttaatcagattttcccttttgtcataaagccgtcttagaatgactccaggcagtaagaagtgagtcagaaatttatgtccagactgtgagattgttatgctcttggattcccctgccaccgctgtcactgggctagtgagcgtgtttattattgacttcacagtctcttttagtgactttgttcctataacttttctttactccagaattactctttatcttgcagtctttttcctatgcctcagaaaattcttattatttacttcgacattataagcatatttttactttctctatgagtatcttaaaacccactcatcctttcatagaaccatggaagtctgttataataaaacttactattccatagatttgcacacaatccagaacaatcacgctcctataaatcctattgagaagaacaacagggactccactttttgcttcccatcactgctgtgaggacaagcatttgagcatttctttgtcccagtttctactggagaaactgtgcaaggacatcatagaagtacccacctcacaggattgtcattcatgttaaatgagttcatacatgtaaaaatattatcaaaagacctgtccacacttcatgctcaataaatttgagttattatattacgtagacttaatattattaccataattgaggcttgacataatatgcagcctttaatataaaatcacttttataagagattccactcttctttaagcctcaattagtctagcgatgtttctttttaagaatgaatttcctaatgctgccttttttgctgcatttttataacactcttcctaccattcacaaaacaaatgtttattcctgtccatctatggagggaagttatctgtttctgaagttatcttcccacactgatctaattctttccctttttaaaatatcttgtttattttaaaatatcttaaaatatcttgttcctcacaaatcattccatcatagatctgtatactaagaaaatgaatacctctgtattttgactcttgtttccttctttaaagtacagttcagaggggtgattttaatttttaagccctaatcaatctgagctgttgttactgtagaaaccacatttctcatcctgaaacatgacagcagtgatcgcccctgacagttcatagacctgaatttcagacaatcaaaggcaaagcaatttggaggtctgatcatttagaattttcacagtttcaaggaagcacagtacaggttctcttccaatttgtcagaagcaaggaaaagcgcatagttggagagctgagtgccagctttcagccctaggtatcagtgccaaacacatttttattattctctggaaaataaggttgtaaaaaagtaattgctgacacaaccttaatgatagcactttaaggatgctgctgtaattaaaataggaattttattaaactagacctctgagagcctaacatacgtagcattccgatctcaggatttacaaagcaagcaactttgattcctgctgcttttgctgtgtgggccccacatttcctttttgcctctcctagttgcagcgtacgtagaaaaccacctctctcctgaaaaaagcaataagcatccatgtttagaataatgccctgtggtgatagtgccacagctttagcacacttacctctgaaatgtcatgaaaggagctcctctctcctttgatttcccttgaaataaaactgtcatgtgttatgcagtgaggttaaaatcctacaggatgttttggttaaaatttgaagaaggctgtcttacttcagtgggatgtcatatccattttattcctattttactgatggatgggttagatattgtacacagctgctagatataaagacctaaaaatagtggctttaaaaatttagttgattatttttcatctgtgatgagaattttacaggttggtggcccacgtgtagtgatgctacagtcaccagtgggacccaggagccttccatttttcctgcttggacatccttaacatgtggttgttacctcaggccccaagatggctgcctgagctgtagccatctcatccaagttccatggaggaagaagggcaaaggaaagagttacatcccagctacatcagccctctgctttaaggcactttcctcagaagtcccatccagaaacatccactcatatcttattagccatgacttagtcatgtagaaaatgtatagtttattggcttgagtatattgccatcactctgaaaaatcagtgttccatattagaaaaaaagaaaagggatgttagttcaccaattagcagtctttaccacaaccaacaatgtataaaaacaagtataagcagcagaaccccctctctccacgttgttattttcccacagtaaatacttatttattcagcatataaataattagattctggcatggtggctacaaggatgcttctcaggaggctaaggtgggaggatcacttgagcccaggagtttgagtccaacctgggcaacacagcaagaacccatccctttttaaaaaacatagaaagtcatcttaaagctgcgattattttcctgttgataacaaaattactctttattatgataaaatttgggcctagcacaatccttaatgacttttctgaattgtcaaatcttctgttatttaagtatccttttcatgttactttagtgttttacattgcaaataatcattgaacaaagtggggattaggggcactgacctcttgcatagtcagaaaatctgcatataacttttgattccctaaaaacttaactgctaatagcctactgttgaccagaagccttactgataacatcaatagtcagttgatacatattttatatgtattatatactatattcttgtaataaagtaagctagagaaaaagtgttaagaaaattataagcaagagaaaatgtatttccttttcattaagtggaagagtgtcatcaaaaaggtcttcattcttttgttttttttttgtttgtttgtttgttttgagacggtgtcgcccagtctggagtgaagtaacacaatcacagctcactgcagcctcaactttccaggctcaaatgatcctcccacctccgcctcccaagtaactgggactacaggtgtgcaccaacatgcttagccaattttgtaactgttttttagaaacagggtctcactatgttgctcaggctggtcttgaactcctgtccttaagtgatactctggcttcagccccctcaaagtactgggattacaggtgtgagccaccatacctagcctagaaaggtctttatgcttatcatctttatgttgagtaggctgagtaggagaaggaacaagagggattggtcttgctgtttcagaagttgcagagacagaagaggtagagaaggtggaaggggaggcaagaggagcaggtgtaacttttagtgaaaaaaaaatctacatataagtggacccacacagttcaaacccgtgttattcaagggtcaattgtatttgatatagaggcatttggatacaaggctttgggtaccaacttagaagaatgaatttcatcaacattgcatttctcaattttttgaattaacacaagtttcttataaatctaaaatctactacaaatacatttgaaaatttaaaagccatatcctcaacatattttatgtgtcaatacaaataggccctgcctctattgttagcctgccatagtccacttaatttactctgccatgaagaattctctcaagatttcttaaaattgtgattaaatatacataacataaaatttaccattttaaccacttttagtatacagttcagtggcattaagcaccttcacattgttgcacatctcccatagttttaaaatttctttattatgacctaattcttttcttgtctaccatagtatttgacaccaagtagtgctctagtaatgtttgtgcagtcagatagattttcaggtaacaagtagtcattttcccaccatgtttatttatagtttcaatgattaaataaggcagatattgtataaaaggttataaacaggtctcattggacaactggataacatcttacttaacagtaaatgctcttatccaaaacattgcacagtgatcttatgtggttatagcaccttcatcccacagtccctaaaactaaatgtaagacatgtaaaaagtcaaatgtcaaaaatcattttatgacacaatttaatatctcttctcagcccaatgtgttataataccagcttaatgatagtccaaaagtggttttcatctttaatctcttttaatggtacttataacaaagacttcttttcttttttatttcattctgttttgtttgaatccgtgaaacctatttctttcttctttagcaatccagtaatcctccttaaaataatgaaatccacaggcagagaaaatatctaatgagatctctctaagaataaatgtgtgtgtctagaaaacttcatgggctgtatgactccaaagccagaagagtaggcttatagtctccctttgttatttaaccaacaatgataaaaacagcttttattttaaggttaataattatgctttccacacttgcttagtgtcttttcttcccaagaatacagaatattctattgatagaatgccattaaagtttcaggcattaaagtgacagggcagccaaaggcacataaaaagagagagagaaaggtaatatacatttttttttcaaatttgaattaagtacttttcctgcataacagttcagtactgtggtccgtcaccttctccccagcacactgggcatgggaaataccatgtatgagttttttttttttttttttttgtagatgaccctcttggtatcttatttttggactagtatccatttaggctttgggcttgtacttaagagcaagtatattttaggttaacaatttatatcttctgtgggtaacttacctttaagaaaaggatgtatatttcacatatatttttgaaatttgagcttttttggacagataattataattcttgtaaactcaggagattgctatggatctttagtaacagaaattgtaaatataaacttaagcaataaatgatgcatttttcaaccattgttcctgctcctagaatttttaagtaagctacatacacacaattcaaatattaagacatttgcaattatagctatttatgaaacaatttgcaggattctaaaaccactactagccattagtgatagatactattttatagtagaaattcagagtggtggagctgtttatgacgctaggaaatgtttgtgctttttaaattttacggtaaaataaaaaccattagtatggcataaatttattggaaagtagattaaaatagaactactaataggtgtaataatttcatagttcagtcattttacagctatcaagtggctattatatatgagtcagtctgctgtatgctggttttgcgaagcattggagacagagttttctgaatattcacttaaatagaagataagacaaggaagaattataaaaataaagacaaatatgtaattttctagttatcgctatgatgcatacaattttccttaagatatatgctatagtaaagcagtgattaagcttgagtcttatagtcagagaggcttaagtatgtattctggggctgggtgcggtggctcactcttgtaatcccagcactttgggaggccgaggtgggtggattacgaggtcaggagatcgagaccatgctggctaacacggggaaaccccgtctctactaaaaaatacaaaaaattagctgggcgtggtggcgggcacctgaggtcccagctactggggaggctgaggcaggagaatggcatgaacccaggaggcagagcttgaagtaagccgagatcgcaccactgcactccagcctgggcaacagagcaagactccgtctcaaaaaaaaatatgtatcctggttttaccttccatcattgagtagcatgcgaccatgaacaaattacttacccattcaagtctctattctgtaaattggaagatataatagtccttccttctagatttacttttgaaaaaggagttaagtgaaatatgtaatgttaagtgcataacatggtgcctggcacatatgtatttattatgctcactatttgcctttatattttcattacaaataagtcacatattttatttggaataaaactgcatatattaatgtcagtatggtttttcttaatactagccaaaaacctaaaattaaataccagaaagtaacagataatatgtgccttttccatcaaatttaggcctttaatgctagcagtcaagactagcatgttttagttaggctcagtggtgcacatctatagtcccagctaccctggaggccaaggtgggaagatcacttgagtctaggagtttaagtctagcctgggaaacatagtgagaacccatctctttaaaaaaaaaaaaaaaattaacgtattttgtctgaagaatgtatccttaacctagttaacccacagctccttttttatttgagtgattggatgtttgggatcattttagtgattactagactttctattttaaccaataccaataaagaaaggaagggaggaaggggagtgagggatttatagacatcaccttagttttatgtatgctgcgattctgtgggttagtgttgttagtgttttgtttagatctcaaaatgaaatgctatttttctgtttctgtaaagttcttgtcttggtgtaccacaatgacttagagcaggctgtgagactataacctataggcttactgcttgcctataggttacactctcaacatagtaagaattgtggcagaggctactggtgccctgtatccattcattccttctttgataaaataattctcagtttcttttctgagtataatggtttaaaagtacctgtgaacctaagttctggccaataaaggcataaactaaaatatcacatgagatgtctgggaagtgcccttccagagaaagggcgtgttcttctttattgtttcctctattctgccccctgaatacgggtgtgatggctggatgtcaggaggccatcttagagtttggcagcaggggtgactgtgtgctgagaattgtggagcaacaacattgaaagatcctgggcctgtggcattgtgatgagccgttgcagccctgcatttattgcctctaaattttgagatctggactcatattttataagagacaagaaatcctactgtgtttaagccaccattaatttggataatctgtcacttatagccaaacctaatcctaaaaagtaacataaggaaatttgtatagattgtagaatatgagctacattaaaatctgaattatctttctccatttcatttttgtaacatgaaagccctcaaggtggatcttttatctttggcaatgtgtctgttgtggggtttttgtctttctagcatctggtcttttttataaaattctatcaacacttacaaactttaattaacatttttgaattcaaggacttaggtcaagatgaacatcatcaaggatagcactgtaaaaatattgaaattatttcttgcccatgctcttgggcaaattaaaacctttctcaatgtagaatttttccaacagaaggctggaatagcagcagctcctctgaacttatatgcatatttctatgcccatttcatctattttagctcctacagtgtatcttatgttaatagatcctcataggtctaccatccttaatttccatggcatttctagtctttttctaccttctttcaaaaggctatgtgtttaaagaatgaagaattttcagtggcattgaaaaaaagtaaaataaaaatattctaattctgcatttttcccttttgtgtcagttaggtttgttccattaatgcagcataacagacaaccccaaaatctcagcacttacaacagcctccatttgtttttctcatctctgggtctgtgggatgactggggcagctttgcttcagatgcaggttgggtttcactctgctccatgggtctctctttctgcaaccagcagctacccagttcatattcctccactggctgctggcccaagagcaagaggactgagcagaagcatgtgatgccttttaagacctcacctcagaactgtctttctgtcacttatgccagaatccactggccaaagtcaacaaggcagggatatttgcccccacctattccactgcgaggcattgtgaagttacatggtatgggtacagagctgttatcctattacaggaaactgaaaaatttgaagcagtacttagttctaccataccattatgagtaaatatatgctttctttttaaaaccatacacacatgtgcacacacatgtgatacacatagaatcttctaatcgtgactttaaactccagatggagtatatgttgtttgagaaatttgagctgtgtgttagagaaatgtttatttttatcgtatttagaaggagagattttgtattttgtactactacaatataaatgatttggtcagttaactgaactacatactgcatttgtttaactaattctaaatgcgaaggccagcagctaatatcctgaagggcacattggtctcttgaggaaatttgctttgcctctgataatgggtgtcacttcattttaggatccagccgatcttacttaatgggcagaatgaagatagtggctaactttactgcctcaaattcttccagctcagcgatgctttgagaactgtgctaaaaataccctgctcaacagagtgtagtttccgtatatgattgcaatatactttggggcctctgtggacataaaatattacaactgcatgacaggctgcttcattggttgatagaggtcagatcaattataaataggtgcttaaccttttaaaaaggtattgttcatgcccccagatcacaatctgaaaatactggaatgggcgaaacaagaattaaagttgtttgttttttgttgttgttgttgtgtttgttttgttttgttgttgttgttggagttatgccctatattctttcaggcgtctagggcagtcatttccattttatagataaggaaagcaattgaaggtcataaattcaatatatttatccaactcatagagtgataattttacatattctacagttttgtaatacaaagttattcaaactagtgacttgtgtctttaatagtttgatctttattcatttgaagaaattgctggacctgctgccttacaatattgtaaagcagtgtggtgtgagaaaattaactcatggatcataaaacagctattacattaatttatttttctcatggaaaatgttgagcatttttctttatatttggggatgctatatattttggggtgccattaccaccacaaacacacactgacacatgtgcacacctctctaccaataattagtgattcagtgaggctaggagatagagatggcatgggctgaaaacaagtagatctgtttctggttttgacaatgctatttattcactttgtgatcttgggaaatcacttaatgtctctgagcatgttttccttttaaaagaaggggtttattgaatttgtttttcaaaaactgggatcacaactcagtagtgagttatgaatttgcagaagagctttaccaacattaaagaaatcaaagtaaaatggaaattaaagtatttcttacatggtaagagtaagtattgttatatgaaactgtgtgtgtttgagtgtgtatgattaatataaatgtgtgtactggagtgcaatgtaaaatttattttttagtttaagtgtagtcaaaagtttgagaaacgctggaacagatgatcgcttacatcatttctagctctaatatttgattctgtgaattttcacatgtacatacacacacacgtgatttaatgattttaaaagatattcataatataccaagtgagaaaaaaatctcattttgtaaaagcagtatatatacctacttattttatgtatatgtatacatatggtctaaaatatgtaaatttatatataaaacaacaaaaaactgtaaagttaatatcaacattagctctagatgatgtattcttaaaattttgttagtgtttatcattacattatataatgttcatgtattacttttatttttgtttgttttcgatttttgtgtttttttgagacaggctcttactctgttgcccagactggagtgcagtggcgtgatcatgactcactgcaaccttgacctccctgggcccaagtgatcctcttacctcagcccccttagtagctaggactgcaggaatgcaccaccatgtccagctgtttttgtttttgtttttaatttgttgtaaagctggggtttcattatgttgcccaggctagtcttgaactcctgagcttaagtaacccacctgccttggcctccaaaagcgctgggattacaggcatgagccatcgtgcctggcctacttctattttttaatgtatttttaaaaggctctcttgttttaaaaagaatcttcaatggatgggcttttcatttgggtgtccaagtggagaaagatcccgtgggcaggctgagagaagtcacctgcagtcagatatagacaagcctgctcatcgagctagcatgtctgacatcgggttagccctcaggcagattgtcccttccacttctgcagacaaaggttctctgaactccctgggttttttcactgagcagcaaatggtgatgtggtcaactgtgagtgggagttgctttatttatgtgcccaagacaaaaggacacagaaacatggagtaatttctaaaggaggggtcgtatggtacagaatactgcatggtcatcagatgaaggccataagatgaactattgttagcactgtctctggagtctattttggacatcacataagcaaagccccctcactgaagcaagaggaggtcagtttttagggtaaacacagctgaagctgactgacttttcactgaaatgttgtatgcttctatgatgtatttgatgaaataaggaaccgtgatacagtgaaatttcctgtgcctcagttagccaaaacatgcagcatgatgctcagtgcagctcagcaccgctgaacccttctgccctggctttaaccaagaagtcacactagtggtctgccccttttggtgtcagtggcaccccatctgctcctgtctcatgaaagtatctcagaggtagtttgctgaaaagcatgctgatatgtgtaaagaaatgactgccagccctgttcagatatgccaggaacttctcactctgggataccagaacaggctttccaaaaagctatttccaacttagcagacctacatacaaactatcttctctcattactcaagcgtgaattcccagagtctcctaaatgtaattgggtactaattcaactcttaaactattattttggactggagtcatgtcaagatgttatggcacaagggcatgatgctttcctaacctgtcatttctacaaacaccatttctgtgttttattcgggtattatttcctaactcatctttccctctaccactgacctaatcaaagaaatacctgtttcattgaaacaccatgctctgttcatcaggcgtgtgttcacaaaatgatccccaaatctggtagttatgcttgaattctttgtatggaagctccctcagacaatttttaattctgtatttgtcctgctttttcttggcatgaagcatctcatactgttttacatgtagataccttgctatggtgttgctttacagtgtctcagaaagctccatggtgaagccatgtgtgggtgcagaactccttgtttgcattctcaagccaaaaagaaaatgaggccaggcgtggtggctcatgcctgtgatcctagcactctgggaggccaaggtgggtggatcacctgaggtcaggagtttgagaccaacctggccaacatagtgaaaccccatctctactaaaaatacaaagattagttgggcatggtggcgcacgcctgtagtcccagctactcgggaggctgaggcaggagaattgcttgaacccaggaggtggaggttgcaatgagctgctatcgcaccactgcactccagcctgggcaacagagtgagactctgtctcaaaaaaaaaaaaaaaaaaaaaaaaaagaaagaaagaaagaaagaaaggaaggaaggaaggaaggaaggaaggaaggaaggaaggaaggaagagagagagagagagaaagaaagaaagaaagaaagaaaagaagatgaaaaaccctaggtggaagattcccatgtgtataaatgcaactgatttttttctttcatttgttcttttttttttttccaaaaaatatttggtgaatgctgcccaaaggctgggcattcagccagttgctctgatggatcagtatagggtgaataaaggcctgaggacaaatggatccactgatgtagagttttctgttttgttttgctttattgatttgatgaaagggcttcaatattatgaaatatcaaaaataactttagcaaaataaagttataggagacaggcaagcataatagaaatactactgtactttcaagtaacgtgactggggatagaattctagttttaccattttagtgtattatcttcatatcatttaccttctcatctgtaaaataggaaattcattaacaaaggacactaaagctaaaaagattaattaattatgtattatctgtattttgattgtcttttccaggattagagatttattccagaagctacatacaggcatccctcattttattggcctccctatgtgcttcacagaaaatgtgttttttattaattgatggttgagctaatctatcaacaccatttttccaacagcatgtgttcacttcgtgtctctctgtcacattttggcaattctcacaatattttacactttattattatatctgttatggtgatctgtggttagtgatctttgatcttactattttaattgttttggggcaccatgacctgcacccatagaagacagcaaacctaatcaatgttgtgtgtgttctgattatgccactggccaattgtttccctgtctgtctccctctcctgggaccttcctattccctgagacacaacaatattgaaattaggtcaattaataatcctgcaatgacctctaagtgttcaactgaatgcagggtttacatgtctctcactttaaatcaaaaactgaaaatgattaagcttattgaggaaggcatgttgtaagccaagataggctgaaagctaggtctctttcgccaaatagttaaccaagttgtgaatgcaaaggaaaactccttgaaagaaattaaaagtgctacaccaatgaacacactaattataagaaggcaaaacaaccttactgcaatacggagaaagttttaatggtttggagagaacaaaccagccgcaacattcccttaaatcaaagcctaatccagagcaatgccctaaccctcttccattctgtgaaagctgagagaggtaagaaagctgcagaaggaaagtttgaagctagaagaggttggttcatgagatttaaggaaaggagctgtctccataacataaaagtacaaggtgaagcagcaagtgctgatgtggaagctgcaagttaactagaagatctagctcatataattgatgaaaggggccagtataaacaacatattttcattgtagattaagcagccttatatcagaagaagaagacatttgggactttcctagctagagagaagtcaatgactggcttcagagttttacagattgggttgattctcttgttaagggctaatgcacttgtgattttaagttgaagccaatgcttacttaccattccaaaaaatcatagggtccttaagaattatgctaaattccagcactttggaaggctgaggtggaaggatcacctgagttcaggagttcaagaccagcctggccaacatgataaaacgctttctctactaaaaatacaaaaattagccaggtgtggtggcacgtgcctgtaatcccagatactcaggaggctgaggcatgagaattgcttgaacctgggaggtggaggttgcagtgagctgagatactgccactgcactccagcactgacagagtgagactctgtctcaattaaaaaaaagaaagaattatgctaaatctactcttcctactaaatgctaaatctactctgaatattttaagatcattgtcgagatctgctcagaaaaaaagattcctttcaaaatattactgttcattgacaatgtaccgtgatgcaagagctctgattggaaatatacaaggagatgaatgttgttttcatgcctgctaacacaacatccattctgtagcccatggatcagggagtaattttgactttcagatcttattatttaagaaatatattttgtaaggttatagctgccatcaatagtgattcctctgatggatctgggcaaagtaaattgaaaaccttttggaaaggaatcaccattctagatggcagtcagaacatttgtgattcatatgaggtggtcaaaatatcaacattaacaggaatttggaagaagttgatttttaccctcataaatgactttgaggggttcaagagttcagtagaggagataattgcagatatggtggaaataacaagagaattagaatcagaagggaagcctaaagatatgacctaattgctgcaatctcatgataaaacttgaacagataatgagttgcttcttatggatgaacaaagaaagtggtttcttgagatggaatctactcctagtgaaaatgctgtgaacattgttgaaatgacaatgaaagatatataatgttacttaaactttatgggcagtggcaaggtttgagaggattgactacaattttgaaagaagttctactgtgggtaaaatactatcattgcatgctacagagaaacctttcctgaaaggaagaatcaattgacgcagccaactttattactgtcttattttaagaaattgccacaaccatcccaaccttcagcagtcaccaccctaattattaacatcaaggcaagaccctatatcagcaaaaagattataacttgctgaaggctcagatgatggttagcattttttgtttagcaatgaaatattttttaattagggtatgtacattgctttttagatataatgttattgcacacttaatagactacagtgtagtgtaagcataacttctatatgcactgggaaaccccaaaattcttgagacttgatttattccaaaatttgcaataagtagggatctagagccaaatccgcaatatctccaaggtatgcctgtatctacctattttgataaaattagataagtcagcatttataatgtctgaaattaatcttaatttgtttatagatgctattttagtatgtgagaataggcaaaataattttaactttctctacatgtcctattcagattaatacctgctccaaactcattgtgtgatattgggcagaatactttatatctgtaggcctgtgtccgttgagaaaatgtaccaacttaattagaatgaccccaaggtttcctccactctttaacctttgtccgtctataaattgtacataagcccgaacattccagttgtttaattcttgcatcactgcccctgtgcattttcagagcattaatttttacataaatctaatggcctccttagagaccaaggcctcatggccaaaagtgttcagtattttttcacttgtatgaagctcagttactcaaatttaatgatgtttcatttgtttggtagtgaattttttatacagtttttcatcaaatggtaaattggaaaaagatgagttataaggtacttttgagtcctcccctgaaacaatcttgtttatttggattgaaatgtgatactatctcagggatttacaataagttcctattagtcaagtgatacaatcattaaaaattagttggctcttagaagtcatttactcctagcttataaaccatcactcactggttaacatctatccctgaggagggatggaagatctctcatctcctcaatggaacccattcccttttcagacaaatgtacttgctaaaaagttcttttcacattgtgcaaaattcttcctccatgggaattttttcccgttattattattatcttctagagcaaaatagaatagtacccctcactcttgtatattgtagccttcaagttgagaaacagaactatgactgctcttctattatctttagctttcaaaatgttttgtttcgtattgttttttgcctctatatggtaaccatacaccccatccaggacagtcccagcttctgcctgtttcccagtaataagtattaagatacttccttttattctaaaaaatttcttagttgggcaataggtgatatagtcacttttgttctgcaggtgtctagatctcaaaggtgctctatgagaaaagaacaaaaatatgtaggaaacatttatatgtaccacaactcttcctataagtttacaaagaatatttatttatatttattttattttattttttgagatggagtttcactctttttgcccaggctggagtgcaatggcataatcttgactcagtggaacctccacctcccatcttcaagcgattctcctgcctcagcctccagagtagctgggattacaggtgcctgccaccatgcctggctaattttttgtatttttagtagagatggggtttcactatgttggttaggctggtctcaaactcctgacctcagatgatccacccacctcagcctcccaaagtgctgggattacaggcatgagccaccgcacccagcctacaaagaacatgtagagaacatttctgcaagaaggaaatctgcttacctttggttatccaactgcttctcaaacttaattgatcatggaaatacctatgttctgagaactacagcttggatttctttcttttataaaactagcttagaataattttaattttatttccagttattattatttttgaaattgttagaaacattaccctgaatattaaccagactggctctctctttttctgcctgtaaaatgagggagttagaggaggtttttaggctcaacaagtggagcaaaccttggcaatcactgcagcagaagctccctcaacttatgtatccagtggtgacttagagtcagcaggacattagtggtggcaggaattcctgagcattaatgaatgacatcattgcagccggggaggagtgaccagccattgtgtggatgtagtgggaagagtctacagttggagactagttaggggatttgaaggaaattgaagggcaatctccaaagtataatgccggagatagatctccatggaaactgtgttgtgatgaccctgcacagcactgatttgatcattgttcctatgtccaggaacacatctttcctggcacacccaggaaacaagatgtgccatctccccattgtttcctacagaggagaactactgattttgttatcttgtagtccaagaatagctgcattaaccaaaacacagaaatgagagacttcctctagaacaccagtaagatttaaatcaatttttttaaacatcactaatttaattttgtttatcaattgggtacattgaattgaagtgcaatctcatttatagttaaagaaaagaccaacacaatgactgttcaatatgcatcaccattttaaggcctaagcagacagagagagtcaatcttacaatgatatgctgaagattacatttttaattctcttttcaacggcactaatagaaatcactttggcaatacatttcttggatttacataatgacagagcatgacaagattagttatcatttttaaccactgagttttctggcacgatgcttgtcattgcatctgtgtatacaccctttgcaaagctatggtgacatcagatgcgtacattttctaagccaaagaaataaacaccttcctgggccatgtggtgactttttttttttttacagtgagcaaaaattcaagcccattataaatgactaaacaatattttgagatttaaaagggccattacacaaagatgtcataaagcaagcattttctttaaaattggcatataggcttttacttatacagttggcatgtacatactgccctctgtctacaaaattcaagaaaaataattttctgccataagttgttgttcttctgtgataagaacaggctgttataaatatgtatgttctataacttattggacttttctttctagggtaacagaagagagagttttccatctaagaataagttttgtttctaaagatcactcctgcctagggtttttggcactcagaacatattctgttataaaagcagagttatataaatagtaatcaggttctcagcaattttattgatttcttgcctgggctgtgtttggttatgagaaggatgaagagtggagaccacttaaatagctgaactagagtactcagaacaagcctgagtttcctgtcttaagagttggggaccatggagttgatgagggtgtcaaaaaattaaagtgtttcaaaacatggaatttaagcctcccacctgccacctcgattttcttcccttttctgccactcctaagtgcctcccacctgtggtgacacacctggttgtgcctgtcactacagagtcatggtgagtgggagggggatgttaaccatctagatcttaattcagtctattggggcccaaatgtctgtattcttaacccatgcctccactttaaggaaatccttaaaggataagaaacctgcatgtgtgcacatgtaccctaaaacttaaagtataataataataaaatttaaaaatttttttttcaaaatttattaaaattaaaaaaaaaaagaaacctaaagtaacagttttcaacctagctaattatcatggacccttggggaaattttaacacagaaatccccagggcttctctcctggaggtcttgatttccctgggctgcagtggggcctggacatttgtctgtccccaggagcctctaataaatggtcaggtgaggaaaccaatcatcaaaacaattgaatctctttcctgctaattaaaaattctacttgctcaaatcagttaaacttgactaaggaaaaaatgcaaattaaatgtgttcacatatgttgggaataaaaataataaatctttttttaatgcttctcaaagtagttacactttatcacgtttgatcttccttacagaggaaagttaggagggggtattataatttttttaaggggaattgacctcagaaaatgaaggatacttcatttttcataagagaatacctgttatcctaaatatatcaccaacagcaaatcttccttagcagaaatgggtataaataaatctccaaagcatcatcaatgagaagaatcatagataggtgagtgaaatattcatgctgggtgagcgatgcttctttcggtcaaaggggtacctagagactagctggcctgatgaatgttcctctgagggaaaaccctcttaaatggtttcaaatagtcaccatttcttcccttcttaaacttctaaatctaaaatgtctttatcaaagctcccactgtattttaattaagctgcttataactctgcctatattcccaattactacatattttaatgtttttattgtttctggaacaggtctgagcaagaccagtcttaggtgtaggtgaagtggacaaccactgatttattcagctggtatttactggccatcttccttatgccaggctctccttttggtacaggggcaacaaagatgaaaagaaatgctcctgcccacagtgtttaatctagaggggagacagttctctctctctctctctctctctctctctctctctctctctctctcacacacacacacacacacatcaagctacaattcattgctgtggcagaattatccttaagttcagatctggtggctaaaataggaatttgttcatccaataagtgaggaacttctcctcacagggttgtagggacagggcagcatgagcactgtctggggagagcaggaccatgagacaggctccagaaagcacaagtagtatagcaagtactgtccaagggggcagggccaaatataaagttaacctgggaggcaggtcatgaaagaccctgtacaccttgctgaagagtttaaatgtttatgcccttggcagtagaaaatagttgaagatttttcagctgagaagttagaaggatccctggccgtcgatgaagaaggaagagacaaagcagacatgaaagcctacactagagcagtggaagtgggcataggaaggagaagggagttgtaagagagtgttatggagtacaatttatagaaccttgatttgactgatgggttggatggatgtataaatggattggattggattggattggattggattggatggatggatggatggatggatggatggatggatgggtggattgaatggatagatgggtgagttggtaggggggtggattggatggatggattggatagataggatgaatcaaggctgactccccattttctggcttgactacctggaatatttgaacagaattcaccaaatgtacagaatgaataatgcttttgaagaggtcatcataataagtactcatcaaataagacaatgacacataattttcttgtagcatactgaagaaggtaatgttcattgtaaattgtgcatgaaaatgccatgattatttaatagttatgttttgatatccaaaaactataaagggagtaaacattttgtgctggtctccttaaagaggctatttagtataattacaaacaaattgagattatgcaatgtatttattttaaatagattctggcacaaacttttatagtagcagaatagaaagtgaaagacttaaaagacatatctggcaacgacattgatcattatgccagtttatatttttcactgatcttttctgcatttccattaactcttatagtcttttgtgcttagagtgtttcaaaagttaaatcatcattttcaatgaaataaaaaatgtaaatagaaaatttttacttcaaatatatcctaaatataccaactccttaagtcgtgaattgtagtttcattttctaaaaaaagtcctcagtaggtttaaatcagaccaaactgaaatcatgggtggatttaaaaagtaaaacagagataacgtttcacatcggtttagaataccaagttgtggacttagaaattacaaagtaagacatctggtaagaaattttaaaataataatgaattgatatgtcttgttaaaacaatccttcagtgtggggaatttgactgtgttaggtcacagagtgagcaatagggtgaatttaaatgaatttttttacccttgcctatctctaaagaaattcccaactttgtctatcaaggagcttttaaaatgtttccatttataatttagtaaatgtttgctgaccatccactgcatacaggctatgtgctaggtattagatactgaggtgaaaaggacctagtttctgttgacagagctgctaggccagtaagggaagcagatgtataacaacatgataagtttctgatcaacaaaaacaggtataaagtaaacagtctgagaaagaaggaattaactctatgagagagaaggaatggttggtagtttccttgaagaggtagcactggagtcgagtaacaaaggatgcgtctggtgggtgatggacagtggaggatatttcagataagctgcacagcatgagcagcggcaccaagaatggggggttcaagagataaatatcttgacttttggtctctactgctgcagattctgcttctactgttctgagggggaccccaagaagctgcatttttgacaagcaccctggggactctcaggcagagcttagtctagctgagtgcagtcattcttaaattttaaattccttgagtagagattgttgtacttatcactattcttaataccttacacactacctggcacataataggtgatcaataaacaaatgttgaggaagaaaatcactggctagacatttgaatcataagagatgctctatttcttaagtaccttctgctttggctctgagtaaacaagtttactgtctccccagtcttctactttgagaaagtagaaggttgactgtcataaagacaaaaattaataaatgacatttttgatggaaggatattaggttattttagtggaagaaaaatagtctgctggtctgttttctaccttttctggctcaaaagtttataacaaggataagagaagtggtaatgaaagtttcaattttttgagtatgtcatgttcactcatcatgctttagacaccatttgttctagacttaatcattggctgatatagtcctaggaatatagagatgaaaaagatgtagcccctgccctcaatgagttcaccgcctagaagtgaagacacgcaagcaaaactcattattctacatagtgataagtactaggaattcaaaataagtgctgagccttgggccaagccctttccaaatgttattgtctcatttaatcctaacagtttataagacaaatattttacagataaagaagctgtgatttaggaagaaagtgattcaccccaggtcacgtagtggcaaaggatgagcctataatttgacctcaattctataaagttccagccacaaacactattattgctcactgcatttcatctgcatattctccgtttgcttatgtttgacttcatttaatgtttatgccaaaaattatgaaatttaatatagatgtgtgtgtgtgtgagattcactaaaatctatacaaagatgcactaacatcttcaattccctgaaaatgaagctcaaaattgaaagatatttcagaggaagcagaaaacctgagccatgtgaacatactacctggctccacaagtcatttaacattcctatatatacatcctaacttgtttcatgctgaaaataagggtttttccattttcccaattcttatgagtcttgagaatattagtttttatgcataaattatatccattacctttgaccaaaagtaccatacttttgtataatgatttactaatataaaatattttccagttggtaaataccaagcttaacttaaaatctggaagtataaattgtgatcagaattcaaacttcttggaaacaatgcatttcattgaatgttaagaaacgtatatgattgtattatattttaagatttgatagcacccatgtttcttaaaaatgtcacttttctacaacttgtcactacataaaaagtaaactatagttcttggatagctaaattcagtttatttttcacatgtggtagttttgcatgaatatatactttttaatgatgaaagtcctaaatcatttgagattcttttcgtaccaactaaatgatctagatttgatttactcatttaggatctatgacccatagtgttcacgcagcttggcaagtaattgtttgagtgttcttagcagtattattaatcctactttctcatggagatctaattgtggcagacccagacaggccaattttgagtccctaaagaatattgttggtaggtagatttttagtttatccattatttgtgcactcatgctcttggatttacagttatttcctttataagacacataaatttaccaaggattggatctttgtgcactcaattattctaccaagaaaaaatcccaaagctgagtataaatatatgttatacctgtcatattttaggctttttaatatctaagagcacagtaaattttgctttattgatatatgtcatggcttaggcaaaatttaactttcttgatgtcaaaaccttttgtgatctatggtgagataaaattgatcatgttcagaaaactttcttgatgatttaattatgctcataaattttaaaaaagtatttaatttttggtataaatttacaaaattatatttcccagagacatgtatttactaatgacaactgacatgcatcaattacgaattcatttttaagaagtttgtttttcctttttaaatggatgcttttagggataccctttattaaaatcccatagtctcattattttgttattaagtagattttttaaccaaacattttgaaaagacttttctaatagcaagaatctgagcaagcaagctctaaatcaggttatgcatctgagctctaaatcaataccaaaagctatttctatattgctctggtaaattacatcaccatatatgaagaatgaaggaaaagatactctctatgaagtcacaacagattgcctgaagacaaatctaccatatccgagccaaacataccatattatctagtatttttagaaacactatgctttgtactactatcatatactatgtgaagtgatccagaaaggcagaagcctgtggaagattcctctataagagcatttcagagatattcaaactcattcatatattgtatctcttccccctaagaggccttagcctgaatagcaatatgtggttgtatttttttaaagaattgcatgaatattttaaatgcaatttggcttactgtgttatcgatcttgcattatttatgttaagattctttgtaatcataaaggtcttgcaaagtgcatgatgggcgggggagttgaatttcttctttgtatttaaggtcattaactcaggggttatagcaacagtaaattctcaaggaaagtgcattggtttcctgcattttgttaatggatgtgagaaagttaatacaaagatttgaagcaaatcaatcgagttggtaaataccagattcaaatattttagcaaataaatattaacttacctcaagaataagacattttcaagatgtgaaagaagcacaatggctgacctgcttgtttcccataaaaaggataaccatagagtacttctcagttgagaatggtttagacaatgaagctccacttacttttttaaagagactatttattattttaagagttaccaaaagtagttcataatctcccaaagggcagagtgcattttgtttattttattgagccatttctcttctttcaagatgtaattcagccctcttctacttttaaaaacactctggagaggtagaacataaatcctcacttcttatgtgtgggttactcatagtagctcctttccaatgaatatagtatgaaagcagaaaaaaagaggaacttcactgcagagcaacctggcaaccattgcctcagccaggtgatcaccgcagtgaaaggtcaggtttatagtatgcatccttgatgtgatgtgatgagaatggcgtttccttagtttccttcctaataacatataattccagtctaatcatgagaaaaatatcagacaaatcccagttaagggatattctacaaaatacctaaatagcaaaggtctgggtaaatagtaggtgttcaaaaaatagcagcttcctataaacttcctataaacggatccccttttattaaatattctgttcatctgagtcttttgctcctgcacttgtgctgctaaattgttagacttaggtgagtactgacatttactttttttagtttcatgtttttatatgttcacaatctcttatcagaaatccttaaggcacatgtgttgtcttgtactatcagcctttgaaaggtaacacagtaccctttccccagtgttcactgtatgttacatacataggctacccccgcccaaccctaggaacaactccctgtcatcaaactgttaacatgaatgcagtgaaacagaaaaaatattcacactaagtaggacaaatacagacttcacaacctcttgccagctcagatcaggttttgccacgaaaaggatgaaaaacaactttgagtttttggtttggaacccatggataagggattctctttagtcaatccatatgccactctgttgagatcatttttgaattctgagtctgttaacccaacagtacatgagtgttcccttttcataagagtgcttttgaagttttctttgaagttactgataaaaacacactgagcaaaaacatttttcttctcacagatctcagaccacatcctaagatgttgtttttcattcatttaaaaagttatgtgtccttgaataagctgaacgactacttggataagcactgaaatttgtttcaaaatgccttattttgagtatttctttttatttgctgtatagtaaatgctgtgggagcttttatcttatttttcattttttttctaattcatgatggtctactgtcttttcttttatattaatttcctctggttgtaaaaatcatgtcacatggtaatatttatcagagagaatatatctgatagcttacaaattatgtttctttcgtgtcaacttcttgacaaaaatttttttttcaaaaaatatcattttttgccagtagagggagtcaaccacaactaaatttacttgagggcattcaaagaaaaagtaaatataaacttcagtttgtggattttaaaatgtaagtgatgggttgatgggtgcagcaaaccaccatggcacatgtatacctatgtaacaaaactgcacattctgcacatgtaccccagaacttaaagtataataaaaaaagtatatgcatataatttttaagtatatacatataatttaaacataaatataacctaatttcatgtattttcatcatagatgaccacaaaattagtctggttgcataaacatattcatctatattctctttttctacctgacatactgttttaattttctacctaggcccgaactaagaaaataagatacaaatgaaaatatcctaacagaacttaaaagtgaactaacaaaatataattctagtatggtaaactttaccatcaccttgaattaacagccttaaagacactcttcattaggtagctcgagtttaaacaaataaaattttagacaggggttaggatttttttttctttaagtttttattacctgtaatttgctacacctgattccttggggagctgtgtctaattctgtttatcaattattgatgtaaaaaagcattatgagcaacctcattccattctccctactgtgtgcatatgctgtgaaatccatgtgtcccaggagacattccagttatgttggagagcactgagattttatggaccagttcactgagaatattcaaaagatattaacagggaattctgaaaagatgtccttttagactattaacagcattattagaatagacactattatggaaatgcatatttcttctatttcttttaaacaattgttaataacctctcccacgcaagatggacctttgactaacattcagtactatgcataattagaatagtcctgcctttcttatattttttaacatccagatagtgtctcatttcaaatgtacgtttaatgacactagtaatttcttttttattattcaggaaaacagtaacatgtaacattttaaaactgatgggaccttgttctagcaaaagatgggttttcagtacgcagcattacagggcattgaaaataattctaggaatggttgaattatgaagactttcaccaacatccaactttgtaaaagaggaatatgcaggaaggatgtggagggagggggttgctaccatcttttcccccacttgcaaaaaatcttacctcttttaaaaagaagtgttacttgaagtgctaggagagaccaaggacattaagcgtctctaaatagcccagcacaggttttccacatcttttttttttttttttttttttttagtcagtgattggcgcagacagttaaatcacaaggtctgtcactgctactcagagaagaaggattgtgtttgtaattttaaatcgtacattagagactgaatgtaagcaacgttttattcatgttgcttacttacatggtatgttttaacctgtcaaaataagtgtgtaaatcagcagtaataataaataattccttagatctcactatctaagggccaattatgggaagctctcagagaaacagctacagcttagaagacttgaagcttctaattttggaagtctctaagagcatgtggactttggggacagagtagaaggttacagagtagaagggtgaacataacatggacagctttatgcatggggagccagtttgcaagttgaaaggtggctgagtttgtttttattttttccctactaaagaacattttttaaaaatcttaaatagatttttgtttgttcaaacttaagtggtagtaattattttctttttattcctttatttcttcttaaaaaaaaaaagggatacatgggcagaacgtgcaggtttgttacataggtatctgtgtgccatggtggtttgctgcacctattgacccatcctccaagttccctcccctcagccaccacccaccaataggtcctggtgtatgttcttcccctctctgtgtccatgtgttctcaacattcaactcctacttttgagtgagagcatgtggtgtttggttttctgttattgtgttagtttgctgaggatgatggcttccggcttcatccctgtccctgcaaaaggcatgatctccttcctttttatggctgcatagtattgcgtggtgtatatatactacattttctttatccagtctatcattgatcagcatgtgggttggttccatgtctttggtattgtaaatagtgctgcaataagcatacgtgtgcatgtgtctttatggtagaatgatttatattcctttgggtatatacccagtaatggtattgctgggtcaaatggtatttctgattctagatccttgaggaatcgccatactgtcttccacaatggttgaactaatttacattcccaccaacagtgtaaaagcctttctatttctccacagcctcaccagcatctattgtttcctgacttggtatcttattgcagttttgatttgcctttctctgatgatcagtgatgttgagcatttttatgtttcttggccatgtaaatgtcttcttttgacaagtgtctgttcatatcctttgcccactttttgatggggttgtctttttcttgtaaatacgtttaagttccttgtaaattctagatattagacctttgtcagatgggtagattgcaagaattttctcccattctgtaggttgcttgttcactctgatgctagtttcttttgctgtgcagaagctctttggtttaattagatcccacttgccaattttggcttttgttgcagttgcttttggtgtttttgtcatgaagtctttgcctatgcctgtgtcgtgattggtattgcctaggttttcttctagggttttcatggttttggttttacatttaagtcttttatccaccttgagttaatttttatataaggtgtgaggaaggggtccagtttcagttttccgcatatggctagccagttttcctaacaccatttactgaataggagatcctttcccttttgcttgtttttatcagatttgtagaagatcagatgattgtagatgtgtggtgttatttctgaagtatctgttctgttccattggtctatatgtctgttttggtaccagtaccatgctgttttggttactgtagccttgtagtatagtttgaaatcaggtagcatgatgcctccagctttgttctttttgcttaggattgtcttggctatacagggtcttctttgatttcatatgaaatttaaaatagttttttctaattctgtgaagaatgtcagtggtagtttgatgggaatagcattgaatctatgaattgctttgggcagtatggccattttcacgatattgattcttcctgtccatgagaatggaacatttttccatttgtttgtgtcctctcttatttccttgggcagtggtttgtagttctttttgaagaggctcctcatatcccttgttagatgtattcctaggtattttattctctttgtagcattaaatggatagttttattagttttacctacatagtaactatttcacagtttagagtattgacttttagttcagtgggtgaactgtatgaaaggatgctgttttgaatggcttccattgctgttattcttaatagaaaagtcccataaaattgtcatggaatcttagggaaaaaagaaaagtaaaaatgatttcagccctacttcttactaatcattaatgcatcccttcattcaacaagtactttgtagtaagggctctgttaattgatgggtatattgtaatagagcagaagaccttcatggagcttactgcctagataagacatctagacaagagaaagacaaactattgtcagaacaagcataataagatgcatgaagaggacttcaggatgctatggcagtgtacaagagagatggcagtgcaatcaaggttcagagacaggctgagacttgaatgaaatggaggaattatctagaggaataatgggaggaagggatcaacaagtgcttttatttttaagcaagaagaaaaatgatatagaaaaatcttggctgtgtttctttaggataaatcattccaatgtaattaatgggtgagagaaaagaaacattttttaaggttcttaagctctctgggaaagtgatactctgttaacctctttcctgccacctgtaggggtacacattctgcagagtgcttgggaacacttaatagatgaaaaccacatctcagtgttctgtttcacaattctgtgattacttgtgatactaaagagtttttcatgtgtttatttgttatttgtgttgattctttacccccactgtttcttcacatcttttgtccattttttccatttgcttgttagtgatctttttactgatccacatgtgttctttatagaataatattaacatttttcttatttatataaaattctttacaattctgattacatttgaatttttaacattagcttttttaattataaaaatctgttttttaataatttcttctattgctttaatactttgaaaatgtttcctcatcaaaagatgatatgttcacctaaatgtttttctagatattttatgttcttttggtttacatgttatgcttatcaaactaaagtttattttgatgtttgtgtgatgtatgtaaattgatattttggagtagttagtcaatttcaccatctatatctttgatataaatatatccttttattgtcatctactatattctttttattctgggatctgctttaggtctatctattcttttttattgacacatgggtaccttctcatacctttgtcacttgtgtttttttccttccctttttcttatttttaccatttgaaccatttttaagtgtataatttagtgacatctgttacagtcacagtggtgtgcaatcatcaatactaactcctcatttccctctccccaccccacacacatggttttcattactatggatttgtaatatatcttaatgtctagtaggcataatgtcacccaacccatggctcttgtttaaagttgatactcttaattttacatatctgtggtgttgttttggctgcttctccttgcttatctcttgttctgtgaatgagtgttccacccttcaccagtcaccaaagcatcaagtttgggcatcatcctggactcttctttcttcctctcctgacacccatcagtgtcagttgccctgttgatcctctgtcattcatattccttggatctctactttctttccacccatcatgagccctgctccttttcagttcctcatcacctacagcaggaatgattgcctccacctcctagcggatcttccctcctctccctttgccctctcccatgcatcctccacacttgctacctgattgtctttttaatatagatattatcatgcctcttctctggcttaaaatctttctgaagttcatgacttttgggatgaagttcagattctttggcaaggtcttagaaatccactactctttcaccttaattccactctccctgctgcatgtgcacatgtgcgtgcatgcacacacagacatacacacatacactgcaagcaaacttaagccttagtagatcacattcacactccaggtgggccagtccctgtcaaggcaccatatctttgctgatgcctagaaccctcatctgctctactccttttctcccggctattagatctcctctctgtgcttcaagcaatgttgcagactctatcctggaagtcccaacactgcagtgacttacatgtccatcttccaaaggtcccgtgaaggtaggagctcagtctgtcatcagtacggtgtatatggcacaatacatatgcttgctttaacttcttttatctcatggtgtttctttaaaactatttaaaattaacaagtattgtctaaaataatatttcccaagattactgtattgttttctctcttgaattctaactgctcctttctattgattgcagaaaagacccttacccctttctagacctcctcttgttaagtagaatgattcattaacttgtaccagagagacgtttccttttttgtcacccactctgtgtttaggtgttgagtaagctattaatgtgcattgcattgtgtctcttttttgctttgttagggagactttttaattgaggttgtctttattacactgcttctgtggccactttgttgtaactcatttcctagtaattggatatgtaccttctctgaaatgtaattttctttgggcttgtaaaatacacagagcaagccatatacatgaactctttcatagaacttttgctgtcattaaaaataaaaatcaaaaaactattaccttgaaagcagaactctaggtatttaaactgactgaaaactgtcaagagaacaaaagcagagaatttagcataagagatcccaaatttggggaggaaatataattctagagcactattagatagaaatatcattgcatcacagtgaaagaagcatttggtccttctctgacagattatctgagaatcatacccctgaagagtaaattaaatgcatctggtgcttgccttttaatggaatatcatgaatataataaggccaatatttaaagattagcccaacagagtatatagcctagtgtaaacagattaaaatggcagaaataatactgttcttcgggtaatacaggagggatttttactccctttttctcatcgtttatgaccagaattctgagtggcattggaatttgtgttgcatgaccagctctgtgatacttgaatgtgttagacttctgaatgactgtattcactataacatcagcatccattaaaaaatcactctttcaactgcttgtacagttagagttctaaaaagagagtgaggaccaattaagtatatagctactgcaaaagtaatcattgtaaaggctgtttgaatgggttcagctaaaggtttgcatgaaatacgccatttaagcaagtgtagggttaactcaaggaagcttaattgatcagcaggtatttattgaacacttactgtgtgtctaatgctcagattagtatgtaagagccattgctgttaaggagacatggcttatatttatgaaacaacttgaggttaattgtgtgctgaattctggggcactgcactgtggataataggaggaatccagaggaggaaaaaagtggtgaaggtagaagttggagaagcctttctatgggcagcctaaagagcttgcagttatttattctggtatgtttcttgtacatctttccagatgtatttcataaactgataacagtagttgcctctggagaaaggatcttggagaggatttacttttttttactgtatttccagttacattatttatgtcttgtaccttgtacatatatttcctattgacaaaataaatgtatttttgtgttattaaagtaattctactaaagtagttgagctaaagtactcgtgcagcttggagctactcaaaggaaaagcatcagagtaagcaatggctaagaggcagctatgaagaggaggaaggggtaaggtgaggcagaggagtcccagaagaacactttggaattcaagtgataggggaaagtagtagaggagtaggaccataatggatgtgtgtagaaaagggagggtttgtgtttattagttgcacgggttttggagtcagactacctagatatgaattccaacccaatcttctattcactaggtcttcttagatttcccttttccaaacctgtttcctcctctgccagacaggagttattaatgaggttagcctgtctcatgaggttagtctgaggatgaacatgtaggtcaagcacatagcatagtggctgacccatagcaggaccttaggcagcccgtgggggattcagaatgggttggaaagaggacatcatggagccagaaagcctcagacagcaataaagcatttcctaagttctgtcagtcatacctccaaaatatttctcaaatccctcctgtcttgttgctccctgataccagcatcctggttcaggcccctgtcatctcttgctagcagtactagaatatcctccaagctaacttgatattctcccccccagcctatccttagcagccaccagagcagtgtgtctaaaacacagtctctgggtaaaagctttcactgagttaggcacagtggcatgcacctgtcatcctagctactcaggagcctgaggcgggaggatcacttaagccaaggagtttgaggctgcagtgagctgtgatgatgcctgtgactagccactgcactccagcctgggcaatgtggtgaaaccccaaatcttaatttaaaaaaaaaaaaaaaagctgccactggcactggttcccatcacctgtgataaagcccactctctaacatgccactctatgtgctccgcagcccatccctttcctgcctacctccccagcctcatgctttgccactcccaggctgaacttttagtaaaaccccagaaatgtcaaagcacctgttgctccagcatacatcacaccatgcctcagatccattccttcactgatgcttttccctctgcctggaacatctttccccttttctctaactttattttcctaacgtttgtttatcctttgagactcccccaggagttccttctctggtttcccccagcccccaccacaatctgggttgtatactcacttctgctgctactacaatactctgaatctctaatgattgggcagaagaagagaagctctccctgccttgctgcatgatgctagtccctgacttgcccctcccaggaggtggactcaggtatctaatgtgttcctttgtgatgctcagttcctccctctctcttctctttgggagctggtactccttgactccttcccgcccttcattctacagggcgggcctcatgcaggtggatgtggttgttcagcactgctagtgacattagcagcttaagtccctgtgagtaaggatgtgccattcagccctttgaactctcatactaagccactttcttcaatatcagctttattagtaacaaaggagatattttgcttgccatctgcctgattccattatatacctctctgtattagtctcttctcacactgataataaagacattcccaagactgaaagaggcttaatgaactcacagttccacacagctgaggagacttcacaatcatggtggaaggcgaatgaggagcaaagtcatgtcttacatggtggcagtcaagagcaaatggaagagtaaaaggggaaaccccttataaaaccatcagatctcatgagacttattcactaccatgagaacagtatgagggaaaccgcacccataattcaattatctcccactaggtccctcccacaacacatgggaattatgggagctacaattcaagatgagattcaggtggggacacagccaagccatatcactctctgttgtttctgacctttgataagaaagaagaaatgttagttattgaaccacagaagccccaccaggtactaacttactgcatttttgcttttaattatctatatatgtctgtctgggacactagacttaccctccttaagagtaaaggctgttccttgtgtttgtgtatccagtatccagtactccaagggaaagatggtgtttagtcatgagtatctgcttgtgggacacatgtggtaacctagtgtgaagtgggtgtggatgagggctggatgatgtgagaagagaatagacaggagatgatagtaatggtagcaacagctggcatttactgagcctgctgcatgactgagaacttcacttaagcctcccaacaacgctgcaagggtagaggctgctgttttccccacttatgaaaatatgagtttgcccacaatcatacagtaggaacagtttttcttactccagaaactgtgctttaaaaagtcaaagaaagaaataaccaagtttgttatggtaacattggtagaggacttgagtggtgcttccacctactgggcttccagagcagctagatacgataggtagattcatattaacctctggaggggatggggtgggaggaccaccctagagccaacaaaggaggtggggggccagactattattatcttcaccgaacaaacaagaaacagggaaggaggaaggcaagaaaagagaaaataactctgccgagatttctagcctaggagacttgcgggttggtggccaaactgacaaataggaaatagttgaaaaagagctgtcctgggaagcatttgtgaagttctgccttgcgtgtgtagaatgtgggttcatggtggaactttcaagtgtttacatcctgtgtgcaaatgaaaataaggcacaggtacagcttttactcttcaacaaatattttttaaaaacacaaggcgtcctgatactaaaaagtgatgtttccccatagttgacaggtaaaaaacactttctttctaaattaagtacaattaattgtgatcttagttactttgttcactcctggttacatttttgacatgttaattcttttcagtgcatgttcaagtctagatacatattgattgaagagaagaattttgagacaaatctcatgaacctccatatctggtggcacaagtctcatttagcaatgtgctccattctttttcaagctcctaatctctgattgttgtaaatattgtagaaagcatattgctttctacaaatataggatcacaaatactgtaaccgtaattcttttctgtatttaatactgcatactgaagattttttctagttgtagaatacagagaaatctagatatatggtccagatcgataacaagaggatcaataagcttttattcttgttgcacttcgctttgttgagggggtcttgatttgcatttgctgattagagccatttgtctaatatatagacatgagaaacatagtttgaataaggccagaacttcctacaaagagagtaacccactaaaaatactttcgaatctgttgcttttcacttccttacaccttctctcctggaatttagttcagatttggagctgtctatggacagagaaagaggcatcagtttcatccctgtgcctgactcagctcagtgcagccagttagcacgcttctcagcccttcaccacaaaaccaaaagtatcttaaaaagtagtctcaaatgtgtgactgccccaaattgagccccaagtgagtctggagctgagggccaggtgcatttgtgttgtcggccatttccctatggttatctagcccattctgccttctgtttgaagataactgaaatattatcaaaaatggtttgtttaaaggtgtaacagctgtgtttctgcaagaagctcataataattaaattaatacctgtagtggctctctctaaggaagtctggaagctttgcacatattaacatatttattctttccacctctctctgatgtgagggaaaggtcattgtcatttttatatttcccttgatgcaaaaggaaataagttacagcaaggatggagtttgagataggtcaggagagaaggaaaattggtcttttttccctttagattttagtccttttgttcatggttgttaaagttcaaactattccattcctctatccattaatacatttgcttgttccttcattcattcactaccaaatgtttataaagcacctgctatatgtcaggcactgggatcacacttgtcttcagagtagtttgaaacttcactgttgtacagaagttactttgtgctttacagaacccagaaccacctctgggaagcacagtttataaaccactgaagtagaacattcagtcatttattcaacaagcaactttttttgcatctaccaaattctattaggtgcaggctgcctaacatccctcttggatcacaaaatctataacagtaattcttttttttttttttttttttttttttttgagacagagtcttgctctgtcacccaggctggagtgcagtggtgcgatctcagcttactgcaagctctgcctcccgggttcacgccattctcctgcctcagcctcccaagtagctgggactacaggtgcccgccaccatgcccagctaattgtttgtttgtttgttttttgttttttgttttttttagtagagacggggtctgtgttggccagaatggtctcgatctcctgaccttgtgatccgcccgcctcggcctcccaaagtgctgggattacagacgagagccaccacgcctggcctaaccataattctttttaaaatttctttttcatgctgagtatgttccacctttctctaactcattctctttgtagcctctttatgactatcaggaataaagaatttgtagaatgtcttctttgttacactgtccttaataatgtttagattggtatttttctttaggctagcaacttactcatcaggaatcaaattcttcaaatgacaaggagcttgcagagctagagttttctgtagattgagagaaatgaataggttgacttgtgtttctgtatgtctactgggtcaaaggaccattcttgagatgtgaaagtaccctaaagagtggcacagctggtaagtgttatgagttgtcctttaaaaaaaaaatggggttttgagataatagtaattttgctaatcattagcttattccattttatgcctatattgtgatttgattctctcttcccctcttcatttagtttttccgttttctttcaagcttcattcccatttgccccatgctaccagttctttcttctcctggaatatttgcctgctccaccatggacagactcttagttatccttcacaatccacctccagtcccacctcctctgtgaacctttcctactgcctcatttatccattcttctcactaatttgttttctcccttttgcatccacacatcctactgatagtatcaataaagctgatattccactgaattattgttacttgtttaaagataccctgcatatgtaaatgacattgcagaaaagatattcattaagtgatatttttattccattctatcaccttcaccaatgccctccccaagaagctccttaaaaacgaagattatcaacctcaattttgtacctctagttccctccccagtgcttgaaacatttgctttcagctagcaacaacactgtagcagttttggataagataacctcctacctgcctagcaagggctttcagatttatgcccatggatcaatcccattagtggtagacatggactagggccaagaggaggagtggagccaaccaccgacaagtcacaggatctcctcctctcgtgtggcccatagctcgtgctgtgtatcccaaccttgggctaatcagtccacttctggaacaggtgttctctgtccagcatactgtggctgacaggagaggggaagaatttgccacctggtcagaatttgtgtaaacagatgccataaaaaaaaaaaaaacaggttagattgcatgctgggtcagcagttgaggagtgctttgagaaaagtgtcttccccctatgagcaaggctcctcctcacacatggtcagccccacttctccacccagaggaggtagagcctgttctaggaactcctgttgaacatctaacacatcgtactgcactggcagcctgatggtctttatgacttggttagagacagatgatttggaagtgggaataaaaagctttcttccttattttaaaaagatttgcctttgttttatgaaattataacaacaacagttatcagtaagactttagtgcttcagagagatgttggacctcagataagacacaaaaggagatctcacttagccataccctcagcctgcaactagctctgcccttaggctctgggtatttcctgatctttgggatgtctactgtggtaatccgggaactggttaccagcatctattccctgggatatggaagcatctcaggaatagtaatgacttataattttatacttagaaaaccaggatgtcagtgtactaggtgactgtgggttggggaagaatattagacctcagaaataataagttaatatcaccagcaatatcaataatagtattactgtttatcacgcactatgctaaatactttactaataatgtaacataatcctcacactagatatttttattatcttcatttatagttaaggaaagtgatgctagcagatgataacaacatataataatacgtactgagcatttactgtgagctggcactgtgcccatctgccaagatcctatcagaatcatgattcaaacccttgtttttattattataggatgaaatctccttggggaagaggtaaaggatatgtggaaactctctgtttccacatttttttgcagcttttcattaagtctaaaagtaattcaaaataaaaaagttttttaaaaactcaaaactacaaagctcataatggccactctctgctgcctcctctggataatggcctcaagtagaaatgcttagcccatgtcagggatgctcacaactcaaatcatgctggaaactgttctgcaggtgtgcactcctcaaggacccctgtctagtatgtggcattctcatcttagatgtgatgaatctatgtagttagtatgacacattttccccagcagatggcagtaaaatgtcttgaggaagagatgctgtttctgatgctcataatagtaccgtctgggctggcagtggccctgagagtgctaagaaatctggagaagaggtagcagaattgagaagtgtttaggaggtgaaattagatagcaagttggtgtggtgttttgttataaagatgccaaatttgagtgcaatcaaatcaaccactaaatttatcatcagttcaaaggatttactcttcctgagcatagtccttcattttatgtatctgtataatttctatttttaaaatcatgggattcgccttgatacaatagtgatctaatgaagaatgaggattaatggaattttcttgtccatgaatagacccataaaacaggaaattttttcatgaatgggctttagggagtccgtggtccacttgcagttgtcatgtgagcatataaatttgtgtacattttaccggggagagctccagtaaaatcatattctcagatgggcccagaatgtgtttaaaaaaattctgtctgagagcatatcaccccggaaggcctaaaatagattcaagggagaaggacagcaaactcaggtgcctacaagggccaggcagataacagtgaatgaaggaaccctagtggggactggggtgacctggagaatgtatgccccaaatatccaaagaggccaccattgtccagccccaactgagagttgcatgcgggaatgcaggcccaatgtgaaatgagctcttgatttttaaagagaatccacaaacccataactttaaataaactatagacatttctgaagtgtgcaaataatttaaaacatttctaaacatagctcaggcaaaacgagcgtacttacaggtcacgtgtggccctggagctgccagtttgataacctgagtttagacatcaccctgtcattcataagctcatgacctggctctcttgggacatactatgttaaggaactctggtactactaattattggttactattataacaacattcatagtaataatgactaacaccctagcactttttatgtatcaagcactatcctaaacactttattcataactcctgtaacattctcaacaccctatgaagttaggttacagtggtttccagcatttgttatatgttaggtactgttctaggtcaggactcctcagcacaagtcatgacttacgaaataattctgtaataatcctatgagtagctagagaaactgaggcacaggaatatttagtaacttgtcgtagctcatttcctagattcaaacccaggcagtctggtcccagagcccacactcttatcactgtgctgtcctgactgcctctgggatactctgggtactggttgtttttcaaagaactctcagctgtggtgctcagtggtcctagacaaatcccctcctctctgccatgacaatgtggcacttctgaccaaatgcagtcagccccaggtcttctgtaaaatccatctcatcatctcattttcatgtatcaccagacatactttattcaatctttgtttttttttaaatctcctccaaaatgaacagatcataaatcctttgctagatgaaatttccaaataatggtgatagatggccttgtcttttgtctcctgactagtttggccctgcctgtcatcacagcaatcaaagagttgtaagatgccatgtagacgcagtgccaaaaaaggaagggacagcttaattctccactcaaatttctgtttcatttgaacttcctcatatgagtgaaacttcctacagggttacacaattggaactcctgaaataagtgagaaattacagttgtaattttagagaattgactttaatctgcagctgcaacctagaatctgtatctgaggaatgagaattgagattatgacatgggagcatgcagtgatttgcagaatgcacttgtttccagttctgtctattggtgccaatgctgaaatccaaaccctgctgagagattgataatggaaaactgaaggtgggaggaaaaaagcagggtataaatctactccaaagctgtcaaatgcagtgaattatatcaaatggttctctaattttctacttggaagataccttttattttttaaaaaaagataaatttggctgttactttacagctttgcacttccatcagctcaccagttttatgatgcttcctgtgagcagtgggtcttagcggttggtgcatttccattagcatgcttctgcaaaatagttcatccttctgtgagtcccttttgatcaattaagcgcctgcatttccctacgcaaacaagttaagagagagaatctatggaaggactctcttcctagggactaattttaatgtcatttctaaaaataaagtattagatataaaggcaaaagaaaggtagctttagaataaaagatgcttgtaaagaggacactttcattcaccactgggacttagaaccaaactttcggaagaatgagtggacaagggcatggtgggagcattgtcgaattccaggcttgataacgtaggcaaccattaagaaccattcagagatctatataacaagaaaggtaaaagttgatggatctaactttggaaaagtatatgtattttttaattccttgtaaaaacttgaaagtaaattcctccctgttgtatttttaatgaaatatttagacttttccctttgctttatggaagaaacctctagtgtattcatttgatagtttttcttattcagcctaagcacaaatcacagcacttgaacaaacccaatgtttctaatagtttgtgcttttgccttccaccaggaccacagatacaaatgactgaaggcacattccttaaagaaaaaccttgactatgagaagtgacaaataaggtttggtttagaagtcattgaatttagtagtggttgcactggagttgagtggtggaggttagttctgaagttaaagcatgaaacaaaaatctcataaaatgaaaattacccttgactaattcttgtatttcttgggttgagcaaatagcatagctggctagcatggagaaaagggaacctatttacactgttgttggaaatgtaaattagtgcaaccattatggaaaacagtatggaggtttttttgttttgttgttttgtttttgacactgggtcttgctctattgcccaggctggactgcagtggcaggatcatagctcactgcagcttcaaactcctgagctcaagcaatcctcctgccttagcctcccggatacctgggactacaggcacacaccacaatgcctggttaatttttctaagcaacatagcgagaacttgtctctaataaaaattaaaaaaaattttttgaaaaaatttttttttaatttttattagagacaaggtctcgctatgttgcttaggctggtcataaactcctgagctcagctggttctcctgacttgacgtcccagattcttggggttatagacatgagccatcgtgcttggtctaaaaaattaaaaatagtactaaacaatccagtaatcccacttgcgggtatatatccaaaagaaatgaaatcggcatcttgaaaagacacctgtaccctccgtgttaattgcacagtagccaatatgtggaaacaacctaagtgtccatcaagaaatgagtaaataaagaaaatatggtgtatgtggtgtgtgtgtgtgtgtgtgtgtgtgtaatattattgagcaatgaaaagaaggaaatcctgccatttactacaatatagatgagcctggaggatattatgttaagtgaaataagccagacacagaaagaccaatattatatgatctcacttatatgtggaatctaaaaaagtcaaatttggctggatgtggtggttcacgcctgtaatcctagcacttcaggagaccaaggcaggaggattgcttgagcccaggagttcaagaccagcctgggcaatgtagggacagcccttctctacagaaaatagaagaaattagccatgtgtgatggcatttgcctgtggtcccagctactcaggaggctgaggcaggagaattgtctgagccctggaggctgaagctacagcaagccatgatcacatccctgcactctagcctgggcaagaaagcgaggccctgtctcaaaaataaataaataaataaataaaaataaataattttaaaattacaatacattaaaatgtccaattcataaaagagtaaaatggtggctgccagaggtctgggagtgggggaaatggggagatgttgatcaaagggtacgaactttcaattacaaaaagaataagttctggagatctaatgtacagcatggtgactatagttaataatactgtattgtttacttgaaatttggtaagagagtagatcttaagtaccctcatgacccccgtcacacccacatcaatgctgagtggtgatgaatatgttaattgattgtggtcatttaacagtgtatatatatattaaatcatcatgttgtataccttgaatatatacaatttttattttatgccaaatacacctcagtaaagctaggtaaaaatgtttctcctgcatatgccttttgaaatgtatatatagacttaagccatggctagcacacagagaagtaagtgagtgctagccatgttgatgatgatcatgatgacaatgacaatgattgacttgattggttcccagaattctgaccagaacccaggttcccctgaccttccgcctgcttttcctggacttcggctcccccttggctttcccatgtgcccctcgtttcttgacaactcggcctctgttactgtcaccagatactgtgctaaatttttggattactgtcaacacaagctttgttatactcatctaagaacttagagggatcccatgatccttcctgtcttttgatgggaaactggaccgaggttgtcttcaagtatctggcctcaatttggtcgtctggtcagttcccagccagcctgcctgagccctgcactcccatttctgatcctttgctgccctctagtagctgcttgcctgactgtgcagctgtgcagacctgaaagggaaggtgtacttgctagactgcagggggcttgtgcacctggatgttaagaaggtgcctgatgagaggaagagacccagtgaagaatgtccttcaaccctgacttcttttatcttttccatggtttttcacggcgcccatttttatagagcccttttcccctttagacattattagagggttgtttcctcctttgaaggaaaataaaatgcctttccttttttttttttttcagagtcagtgattggtgattgaaagtgtttgcaaaacatccccaaggagcactttaatgtcatttttatggaaataaagtggaaaataataggcactgtttttttaagtgaaagaaaaggacccttctgggttttggtaatgaacttaggaagacaagatattatgagcagaaacctttgagatttggtaaaatgtgaatttcctaagagagaagcacaagagtgagacctttttctttgttgttttctgagtctatgcttcttatataactatattacaaatggaatggactctggagcctcctaatttttcagtgtacacacaaatacacatatatttgaatattattttcatagccagtcgtactctttgtaaagcacttgaaaattgacaaagtgctttcttatttattatctaatttgatcatcacagcagcccagtgaaattggtaaattcagtactgtaacagaatggtagaactgtaaggaattttagagacacaactgccttattttgcagatcaagaatctaaagcttaaaaaagagtattagacaagactctttgatcccaagtgacagaaatccaactccaactaaattagcaaaatggagaccatactgaccgaagtaactaagtccggtgtattagggatttagaaatggatgaatccggatgttccaatggcatctccaggaatatgtcactctccatccctcgactctattttcctctgtcttggtatgattcaaagtcagcttttcccatgtggtgataagatagcaactccaagtacatagcctgccattcccagtggaatgcagactatcttctttgcagcagttctaacaaaagttctgggattacatctcattagcatggcttgtgtgactgcctatttctggaccagtccccgtgactaagggattgtatgttccacttagtcagccttgatacccatacctggaggggtagacgtaggggagtgccagctccatgcacaccacatggaccgagagtgggtccgcaagagaaaattaaggtgttattccctgaagaggaaggagcccttgatgctgtttaagcatgagcaattcatgtggattaactgacctttggtataaatgggttctgtagcttttaagttaaaatttagaactacatgtttagtattgtgagttagaactttccctgtgaatatacttttccagcaaaggaattgtattttttttttcacctttttacatccagggcccatcatggtggctggcatagggggtgtgctcagtcacttttacccaagatgaaacagccaatatgtaactacattagaattttaacctgaggcttctgactccttagacatctttcaactctaccatcctattgcccatgtttaattttccttttccttactttccaccattattacagttagtgatatttgattaaaatattctaggtgttagtatttgtcacctaattgcatgtgttttggtgactcatagtacacattgcttgaaggggtgacagagtatttccacttcattgtatcagaaaagataattatgttaatatatactcgataggataccttaaaatattgtcagtacagttttatttgaaggagtaacgtgtcttagaattgaggaggctttattgtagtggtttttgtttttgtttttgtctgtttgttttgttttgttttgttgagatagggtcttgctgtctcacccaggctggagtgcagtggcacaatcatggttcactacagctcaacctcctgggctcaagcaatcctcccacctctgcctcctgagtagctgggaccacaggtgtgtgccatcacatgagcctgctgagttttaaaatattttggtagagacaaggtctcactatattgcccatgttggtttcaaactcctgggctcaagtgatcctcctgcctcagcctcccaaagtgctgagattacaggtgtgagccactggcctggctttgtagtttgtttttaatatatgcattcttaatatggaaaacttaactccttcctatgccacaaaaagaaagtcatcaaaatagcagctggaacagcaagaaggtcttgtagttagtttgtttttaatatatgcattcttaatatggaaaacttagctccttcctatgccacaaaaagaaagtcatcaaaatagcagctggaacagcaagcaggttagtttggaggttgttgtagtacaaagccctattgaagatggaattacagagtttttagcaatgtattactagagcttccaaaaacagacgcatgaattactttagagatacattatgtccttgacaggctataattatgcatgttagaccagaatctactatcaggatgaatgtgtatttggtatttccttcatacacagaccaagacaaatttttaattttagcatctttactttgcctttttctttgttgctcttgctgcctctgacttcagtgaacaactagctgggctgtatgtttcttcatatttggtgaacaacagggtccttatgatcttgtcagaagcaccaggaatgaatctgaggtgtgctctggaaaggtgggcacaaaacacatgccttttcctttttctcctctgcaaacagttaacattcaagaatcatgttatttggaagaattttctcttaaagtggcagagctattgttgtttttttaaagtaatttatgagcgtcctcttttccataagagttttacaaacagtattgcatataaaagaaatccactagaagggaaatcctttcacatttatttattcgacaaaagtttattgaacattggcgctatgtgctaggtactgttctaaacaatgaacaaaatagaccaaaaaatcctgccctcagttttaaaaaaagccatgggcagggagcagcagacaataaacagaaaaataatccaaataggtagcgtgttagatggtgattagtgacataggaataaaataaaacaagaaagggtgataagctgggtatggagggagtactgtcaataaactacttcatccaacctgttttagaaatctaatttcttcccttgatctaacctagctgctgtgcgcacatcactgctccttatggttggggttggatttttgaagtagctgtgtttctttccttcctagtagcgcataagcccaccaccgctatatcctgggagtgtggaaaatgaacattcttttaagacagctttagtctatgtattgaaaattaatctttttaatttggataaatatagaacctctccctattgggtttccacttttctttattattcaaataatgtgcttttatctgcaaattgttggtcaaagtatctgacataactcagctgtatgatatcctaaatccatgagattatttatattaaagtacttattaatttagcccttaaaaaaaaagaacaaaatttgactagccctacaaaatttgaaaagtaatacttccccctgcccccaaagaactactcagacattcatacaaataaaagcaagtgttggtcaatgattctgggatgagttaggaggaagaacccatgtgtggggcccagaacctcagtgcctagaacaaggtaatcagtaaaggtctgtaggagaaaactcctgtgcacagtaactgtgaaggtctggactaggatgctggcagtcaggtgggagtatattaagaggtattttaaaggtgagcttaagaaagagggtgatgatgtagtgagctcatggaagaggaacgtgtgtcctactgggaaggaaatggagcttgatacagttcaaatctagttggagatggtcatgaaggctgcccacagatgttggactcaaggatgagagaaggtagttttgtttcgtttcgtttcgttttgttccatttcatttcatttcatttcgacagagtcttgctctgtcatccaggctagagtgcactggtgggatctctgctcactgcaacctccgcctcttgggttcaagtgattctcctgcctcagcctcctgagtagctgggattacaggtgtgcaccaccacgcctggctaatttttgtgtttttagtagacacagggtttcaccatgttggccagactggtcttgaactcctgacctcaagtgatctgcccacctcggcctcccaaagtgctggcattacaggtatgagccaccgtcccccgccaggggaagggagttttaaatgagggagcaaatttgggctgacagttgagatttgagagtcaaagcaaagaagtcattgctggagccctaggagaggataaaatgctgaagaaggtgaccaacatgctgtgacagagcttgggggaattccgacatttaagggtagagaaagaagaggcatgagaacaggaagaggttgcaggagtcaaagaagggaaattacttcgtgccattgtaatgacagaaaatgttgtggaaaagggtgcgttttacttgttaatcccaattccacctgcttatgatttctctgaccaaaccaatccatactaatcacatggagctaatttaaggaagagtctgggttctgtaagcaagtgtcaaattgtacaattgtatttcctaccaaatacaaagtggctaataaaagctgttactgctctctgttctaggcacgttacacagataaactcagtttaccattcaaacaagcctagaaatgatttttaccgttttgcaaatgaagaacagaaaggttaagaaacttgcccaaggtcacgcagccatttagtggcaaaagccaagagtcaaagtcaggcaatttgattccaagctgtgtttttggccattacaccattctctcctacataatacctccataaacagttggacatacctaggctcttaggaggatgatttctggtagatttttcctcttgtacaagcatttctcaatttctacatattctatctttaacattttccaccagatgcttttagctgatgaatttctaaggttgttaccttcacaggagctttcctggtctcttcatgttcagtggaggcaaccttctttccttggcactgttacgggcatcagagccctgcctagataagcaaatgacacatgaagtgtgcattatacccacccttttatatcacaacacaccagaggccctgagctactaagtgctttttaatcaccccagatttgcaagagtatgtcctaatgacacttcctaaagggcatcattacttctataaaaatgttttctcataaaatatttgctttaaaaaatgcctgataaattctgtcttgggcaattacaccaacttttcacacccttagaacctgtgtcagcaaattgggtcttgcttttttaatagtccttcatgacagctcattactggcgagttctgttcagtgtacatctcccttgtctgaccctaatgtttggtctcatgttgacacactagttgaactaagtagcagacagtggtcacaagaattataacatgtttgagctcatggttgcttttggcatctttgaaaagggaagtaaaaatggccgattataataagctaagaatgagtcagtgacgttgtctgtaaggagatgaaaaagtgggtgagagtcgcattttaagacctccgagaacactgagttttaaaatacccggaagatttgggaaatacacaacatttaataactgtgtatgtgttgcagggtagggggtgtggggatcagtatattcaatactagccaagtcaggatgttccatgctgtttaaatagtgagctaagcatgttaagcatttttaagcaacagcatgcaaaggaaaagaaatgtaatagttaaatgaataagcaaataaatgggatctatcaggtatattttgtaacagaaagatttatgaagttgaagaaagtgcaaattattttagcactttaatcaaattgattctaatgatataaaatagttgagtatttgtgggattaacctcattgttttggttttttgcaaaatgaatttccaggtttaggcatatggcagaacatttttggtttatgatgattctttcttgttaagaatcagaagaacctccaaacagcgctatttatttttgggatggagatgttatataaaagaatgaatacaatggcggagaatcaaggaaatgagaaaattagaataagattatggggctatgtgtgccacctgctgatgaagctgtggaatgctttggttttgagactatattggaatctttgagccaatcttaaggttttgtttgtccatacaccacaacccacccccttcttatgataaaattagtaccatattgtcaatggaggtgatattccaaatatttcaaaaccagcatgacacaggccagtcaggatgggctaaccatgcagtgagaagggattcctgtaaacacttgatacgtaatggtctttcaccagacggtacttgccttaactgtcacctgtttctggttccttctggtcagggtggtcctagaaccatgagctgtgcttcagaggggagaaggtgataggcactagtttttccctctgtcaaaagataactgcacttaaaggtactttgttaattgaatttgtccccctgtaaactagatcacattttgtattggtggcaaggaagcagtgaaaaacaagaggagaaagaatgattagccaggggtgagaagctatggttctttcctgttctttaccacttactagctgaatgactttgatgaaaaacaccttctctgaaaccagttttccttttctgcatcaaaaacctataacagagtcgctccatgatacattatgtgtgaaagtgccttctaattcattaaattctatgtaaacgtggtacacttgtattacaccttagcaaaactaatgttttaaagaaaccctgaaataagaattatcatcttaagggactagtctgccctgaatccagcaaacccatgttttcatgtattgaggtgtttgtgtttttaagaggggtaaacctcttgaactagctcactcactcttcttcagatcacattggggcttaatcaaatctgtattttgtacaattttacctgccttctttttccataacccctacttggtgaccctcacagagcatgttgtaaagtttgaactgtctagacagctgagccaccataattaacatgttcatgacaggtcccaaagacacatgcttacattgatctggtagccaagaaatgtaggtcactctgccttgtagtagctcatgttaggagcctgtggtccacattccaccggttgccttggccatttgagaccttcatcctacagatcgatacattttgagatagaaggcttgcattgttggaaggcattttaccagtgctagagttcaggatgggaggctaagcttgcattaggcaaagggaggacaaagggtttagggcaagaaggttgacctgggagtggctccccaggaaatctccaagcattagcgaggccagaaatggaagaagatgggaatacctggtgaattcgttcattttctggaaaagaattactccaggaggctccatttctgtaagattcctggggctgcacctgggcagactaataggatagatatggattggcagccacagtattcaaagagagaaaaaacaatcccctagtttgggctctcagaaacctttcaaagagctccatgatgggttatttcccctgccaaagaaataggacattttagtagttctgaagacctttcttgggaccagaggatagagcttttaaaacaaaacaaaaaaaataagcatattaggaaaaggggaaaatatttgatcattttagtcataaggaaaaagcaaattggatttgagtctgcaaaatagcagaaggcaagagattcctgtatggttttgagttgtatttgaatagactgggctggggtggtggtgttccacaggcaagattctactaatagtaattgacagctgcgtattctgagtgcctggattttaggaaatatgttagatttggagaagaatcttggaaagagctaactgtaagtatttatctcactttagctagtaactcagttctctagtactaaggtatatttctatttaaagcaaaaaaatatcaaggaggctaaactatttctagggataacctaatagagatgaacataatatgggttgaaattcaaagaaagatttatgctaatcagaacaattataaaaatttgattttgcactgcagtccatttaatatagtattttctattgattagtggttgctttagctagaccatccttggtaaaagaattctgttcttttcaaaaacctttaaagtagatgcttatgatattcagatgtttttcacacacaaattatttttctattggactcaaaatacaaagcatatgcatttcaatagcagtggattgaaattgtttgagttcatattgaatttatgaatgaagaaaagaaagttttaccactaaatttggaatgttggaagttattttaaaaaccagcttgaaagttttttcacagcctgaagagtagagaataaaactgtatgaataattcataaagtcctagaaatattaatcaagtagtttagacagtgatatatcttttcattttgactaattgattttttttttcttaaacttcctggccaactgtctaattttttgtcctgaatgtttatgttaactcctgtgggagaattctggattttgattaaaattccctaccaaatgttagttcgtattgactatatggcgagcaggctgctgctggcagatgaggaggtgtgctccgccttcttatcactttgtgaatggattgtgaagggtttgttaatttgctcttcactccattggagcagatactcacaaatatctgctatgtcgcaagaccgttttatttgcataatgagaagaatggtttgggggatggttgtttgggaaatagtataataaagtatattaaaaatagaaatacttggccttgtttgcctttatttctggtatctttagaaacagtcttgactgtgttgctttccagccaagtccttttttggaagggtgattaaaggggctgggactccatctgcctgattgtctgcctagccctaaccctttcttgtattccctctataaacagacactgccttaactctcataggttcaggaagtaccaaagaggtctctgtcctagagctgcttccccgctataggcagaactgtgattctttcctcaatcccaaatataaacggccctccctctttttctttccttttttttttttttttttttggttgttgtttaaagaacatagtacatgacccatgcatttcttcctaaagtaagagtgtaagcatttcacttgcatttcccattaaatgagacatataaaggacactgacttgatgctgagaaggaaaggggctgatggtggctgaactgactggatacatcgccttttgccttaaacagaatgcactgttcagtgcttagcgttagatttatggaatggctcctcacacagtgtcgtccctgctttgtacaatttggtgctttgttgctatcgaaacggcattactttctaagccattgtgattgtgaagggggaggaggctgtggcaggcaggggtggtagtagtagtgaatgacacagatttgccagatgacatgtagcggacctctgcatcagccaagaggaattaagctttgtcactccccactgggactacctttctcctggtatgtgcgcaaggaattcatatgctgctgctgctgcagccaccagagcagagagccttgagtacactttgccacagaaagcagtgagcaagaatgatagctgtctcttttaaatgccgttgtcaaattctgaggcgacttactaaaggtatcgtgctttccttgttattccctcagcgagtctgttgcagtatcctataaacacagtttaatggtttttactttcaaatatgactgcctttgcaatttattgtcaggcaacaaagaactcagtgaaatatgtatagatacatatgtacaggtagactcggctttgctttctgtccttacatctcggttgtgttcgtgctgaaattatgaaagcagcttgtgtgattttttttttaatgacttcattctttgctgaaaagagaatgtgtttgggtccggtgctgaagttattgtgggaaaccgtcattttgcatgctgattaactggccaaaaggagtcaagtgtgtgttactgtcctttctatgatacatatactaaatgcagctggcagattcaggactcgcacagctggtggatccacagaataattgtttgttctatgactttccaacatcttaagagctttttccctggacagctttaatttctttatgtgttagaattgcatgttcagaaaagtatgtaattccaaatgctttggtcctatgtaatactagaagtttatttgaaagtaaaaatcattgctcggaatcttatcatcaagaattaccagcttcagattgtcactcttagaactctaaaatagtaattaaatttctctgtaatatttaaggtattattttatttgaaaccattctggatgtgccatctcgtttactttgtgagcattctattgcaaagttagtaaatggatgccttaaaaatcctgccttgtgtccatatagatatgtgagctctcttgccttatttcctttagatagaaccttccttagagaaaatttattatttaaaaaaaaacttcattctgagtaaaagtatttagttgcaaatgcctttctttttcagcctgtaatatagagtactgttgagtaattaatggatataattatgttctagaagctctgaacctataaatatgttaatggatgctatttctgtcagtttagcttgacatatcagaattctttgatcaccagcagtgcagctaaaaatgcaattaatattttatctggcagaagaatgagcacaaagcaaatcatgagaaatagatcttgagtcaataacaggaaagagaataaatactgtagaccaacttaccgaatgcatttgcaagttgtttggatagcagagtgagtcctttaaaaggtactttgggggaaatgtagggaagattatacattttaaattaggctattagcaggaggctgtaaattctgttttgactttatcctctacaattggtacagacgtacaatttctgtttataaatcatgactaagagactatcctttctgttacggttttggctgagacttttaaaggcaggcccttattctgaaaagttcttttctgacctgattttggcatttacttatcttgatgttgagaagttgatggtcttcttacatcataaacatgaaacaatcagtattttctattcatctgtatcagttcttttataagtactacatacaaggaagagagtgaacccaagcaatttatagttcttacaaatatttttaactttctcagttttctgaattttatggaagcattgatctcctgcattgaaaggagatttaagtgtttactaagatagtcgctaaaaatctagataattgaggaaagtattgataactgctttggagttgctacctcacacttttttccaaaatctttatgtctgctctatttggtatttaacttaagactgtcagttgatgattaaaataaaatctctttgcagaatcaatttgccataattgggttcttctttgtgtttaactggctgtccaaatacttacaagaatgcacctgagtaacacggtaccttgccttgccatctgcttcagtcttgtccaacaacgttcaagttccacccatgcttcttgttccaaagtggattcattgagttctagcaccccacccatacttgtggtgctgttttcttaagctgtaatgataaaaccaggaaacatatgtaattacaatattaaaatgacctttcttttagggtcaggagtgtatttggggacaggggtggatatacacttgaagtttctttcttgtcccattctccctactcacacaactcccacaccctcaccctcaactcccaaacatacatatttctttatacccattgagggctccacctaacactcactcttccagacatttagcacaaggcattacacttagtaggcacttcaaaactgtttgttaaaatgaattggatttgtctagttgaaagtagtagggcatttaaatcttctgtgagctcttaggaaatgcttcaagagctttattaggcctcttgtggctaaaaccttacccagatcttagcagggggaagtttgcttcatgactccaaaactaccttgctatttgtggttgatatcacccacaagaaaaagcaatatggcaattgcaatttcttcttaattttcttaaggagaaaatgatggaataaaagggaaacaattttctacaaacacccacattcttgatatttttacttgattcttacattcttcatatatctaatacatacttaacaaatatcgattaagtacctactatgtgccagacactgacatttttgcacttagaattctgggctgggacaatttataggtgtaaaaagcatttttaaaatgaatatattattgaacaataaatattttttctttaggtcagatgtaattttaaaagatgtataaaacatgtatttctagacaagtccttggatcactccacatagacactgatccacagtattatagtagaatatatttcaggtaaacttagcacttctctgacttgggaattgagtcattttcttattaatgtttcaagccactgtttcaatcattttgccttatcaggtacctaccaatgtagaacaagagcaagaaaataacctttacccaaaaggcccatgcctgccattatgagaggaactttggttcatgaaaacaccaagcaccgtcaaaagcattccgtttcccatctaatattgaaatctaaagaagcaatgccgttcttttcttcctccagaatgagagtctaccaattacccaaccttagagccaaatcccaaaataacattttgtgaggtttccagagacatctgacaaaagggttttctggagtgggtaaatctaggcttcttggcacctaccttcacagctgtttacctgggacagccctggtttctcagctaggggctaccatacctcaggggaagggagtatgttctcagagaaggggagatattttcatggctcccacagactttgttctttttctcttgtcatgattgtgtgattacttttccttgagacagtttggcctcatatgcagagaatcactttctctggtgatatgggatgtgactctgctgcttgctcaggtgctgccattttgagctccgagatctgaactttcgtgctccactggcaatggcatttttctttcacaagcttcactctgcctaccaatgccaacatcagccaattaatatttactgacattccacagggagcacggctctgggcacctttcattgttttgctgccacccaccctctctctctgtcttttctctactggctcaaagctcatgtcggaaacctttgccttcactttagtatagacttcaacatttttcatcatagctggcctacgtgtcattttattttctacttatcttcactttctctctcttcccaaatacacatatggcctaaaatagaattaactctccctgtccctttcccactaacaaactataagcagccccgttgaccttcatcccaatggggtgtctaagtgagacatctgtggctggcagggaactgctccctgctgtgcattctactttctttctctctccctctcttcttcctgatttctcctcccaacctcagtatcttttctccttttctgctgtctgggcatgtatgggtattgctctctccactggcactgagcaagattaaaaggctgggttgtgatcacactcactctcattttttcagtcattgttccttacacttaccccaatcatggaatcattatgcttgaaagggaaggtcagacattcgtctaggacttgtttccagagagaactgaaactcaaccatctcagacaaccagtaatcttattctcaattctctctgacaagaacaatctcacagtttgtctgataaacttttaatggattactcaggtgacgtctaaatccctttaaactctgacactcatcctgtgtttaaaagttcttctatttagaaactcatttcctaagtgtaatcttaattaaagaaacacatttaaatgttttgtcttaatggaagaggaaaaatatttcccatcttttctcatctgcagaatcttttaatccaaggaattctgaatccatcacagagttcagtatcagtgttccaaacctgatggctcctttgctggtggccttggattttctgttctggtcactttgctctttcccatctgtctgtgtctagccttgtggttccttcagcagtcttctctaatgattcctcatccactctgtgatatgattcagaactgatcatcatctgggttgagaatgctctctctctctgtgctggacctcatttctcctgtctccccatcctcatccattctgctaaccctcgctggccttctctgtcagatcctgccatctggaacaacttaactgtatcctccacctcgttaactttccacccctttccaaatctcacctgcaaccatgtcctttctgctttgcctccaccccttcatttcatgccatcaaagctagtgcatttaacgtatttatctttctagcctatcaactttttaaaataatatgcacttaatagatatttcacaaagtaagtctgtcttgttttattggagtttcatctattgctagggcatggggcatatttctcttgcaaatagagagaccccacttgaacaggagaatgctgcagctgggtcccaggcaggtcttgttctcgcgcaagtgctgctcgtggtccagattgtgatggatttcttgctgtgcttctagcccatgctttgagggagtttacattgaacagtggcttggaccgctttactctccactggactgaagcttttcgtttatataactagttagaattatcataatggcgcatttatttctcccctgtcttccaaatgggaattggatgctagaaatactttacctcgttccaggaggtacccatcctccagaggaaattttggctatgccttgtatgaccccatataaacaagaaggagtctacacccttcttatatgattgtagcaggttaggaagaaatatctggttcattactgggaaaaggagggccaatgtaggataggcattctaatcgattaacttatatacttttgggaaatgtttaggaggaagaatggaaataaggatagctaacatttattgagcacttactttctgccaggtactattctaaacattttacatgtactaactcatttaaatcttgcaatattatcgtcattatccccaccatacagatgaaaaagaagaggttcagagaagttaagaatcattcctaagatcacaagtggaggacaggaggaaccccagtgtttcatttttgccattttttttctcttctagaaacggatagaaaccatagacctgcctatctagaataataaagagaaattaatcaagacaacaccacactaatctctcagcattccttatggtaggggaaatagaatagacttagaaattagaagatatgtcaacctttcctagctttcctatttttacttgtgtggcaaaaacaaacaaacaaaaaaactgaatttcccccactaaatttcagtttcttaatctgtaaattaaaaattacttgtgaaaactgttttatactcatgttagctataacaaaatgatttaattttctactacagttgatttatttgaaattcttatattagtaaattcactttattctggcggaaaatatataatttgataacttcccactatttgagaggaggcaaaatacatagtttctagggataggcaagccgtcagtgtttgaaactcatctttttctctcttttagtttcttaccacttttttgcccatatacatgagaattatgttaaatttaaaattagtaactgctgctttattaaatatacagaagaaaatcttatttgcagatttttaaaataattatttgtttcagtatcgcatatatccaaaaaaaaaatgcacccagatatttattacatgtagctccttaaaggatgttactgcacccttcaaaccaaggaaactttgaccttgccattacaaaaagcaataaaagcagtggtcttggatgtctcagtcaatgatgaccacctaaattcaggcaaagctcggggtattagaaagtgagaaagagcttcttactaataattccaactacattattaaatagctgaatatatgaagaatacaataagttacatttgtactaaggaaatttctattcattttcaaaacagatgaattaggagaaaaggtaaaactaaatatcactaaagatatgttgtcatcataataatggaaaccaatggaggaaaacaaattgatttacaaattattatgctttttaataagttgaaattatatgtataatacatgttttgtcttacatcttcttcctaatattctgcccatttgtgcacattagcacacacttgtcataggaaactgttactgtctctgtagtatttccttatgtggataatatatctttagtttgtttcccagttttcagtctaatacatgatactgaattgtctttaaagaatttattttgtgctttaaattgttgccttcatgtatcttcactttcaagtcttctgatacatattgtctgagaaatgtgtttaggatacacgtcccacacattttccccaaggctttcttaagctaatagaggtggcagagagaaaaacagtgggagaaatagcgtttggataccgtaatatctaaaaaccaaagcaaagatgagagaaggagaggcgagaagcagcccttctgttttgtaagtgggtcattgctgacctttgagagaacagttttcacagggtattgatgtccaaaccagattataaggattctctgcattaaaggcaacaagggcagaccactcttttaagaagtctgaaggtgaaagttaggctgtagatgggcagcagcctgtgggggtggagggcggggtcatgggggataaggaaggctattataggatgggagaaatctgagcattttttaaaaggatagaaccagtagggaggtaaaatttcaagatgcaaactagaagagggatgaactctagaaccaggcaagacagtgtgagtgtgagaccacgagacagatggcagccagctagagtgagcaagagggacactcttgtcacagagacaggaaagcataggaagaaagactttgaggtggacattaaggaaattaatcaaacttgactttcttagtaaatcagaagatgagtctaaaatctcctatttttatgagcacccaattcaggggtttctaaatttttctctccattggaattaccttgtaaccttaagaaaataatgttgcctggatccaaccccagagattgtgatttaattgcctggaagtgtggcctgttctttggcattttaacacattccccaggtgactttactgtgttagctgagtttgggagccatggacctaacgtactggcagcttcatagagatgctactagatatgtttcagccagagacaagcccaggaattttactcagctgctagaagggagaagctgagcagatataagggctatgaaactgctatagccttcctgtgactttgagggcagagcctgtctgaaaatggcagtggatccaaaagaaagagacaccatatctgactgtcatcacttcagcccctgctcaagaactaccttaagggagctctgagctctcccttagacttcttcagttaagttagccattaaatgtctttaacacctaagcccattagagccaggtctttctgttatttgcaatcaaaagaggcctgatacaggttataacgcatttgtgtgtatacattttggtgagagttttgaagacatagtttaaaaatgacagttgactcaaccatttgctgagtccactcctgagttgctctcattccacagaactgtgtgaacacccctgcaaatctgagcctgcagtcctgtatgaagttatgagcgccactgctaacgtaggatttccagtggatcattttgttaagtcttcaagtctgccctccttggcagtccacatcagcatagactggaaggaatgttccatggggatggaaatgaatattgtaattttcatgtgattttttgtccttactatttagggacctaagggctaactgatctctccctttcttctccccttatgcggaaggttattatatggagaaaatagttgaaaggcagggttataaagttttctgctttggttgtatgcggtgcaatgttctgagcatctcagctcttctcattgctccctcttctcttctgttacttgtcttctttcaatgctaatggacatagctactcatgcaaaggagttcaccctcatttgtatggtgcagaaagtctgttgccctagcccacaatgaagagtagacttcattggttaaagtcatcttctatggagccaattgttaaatgttaaagaattttttgaactagcttgtaaacacaatcatttaaaattatataaatttgcaattaaatgatattaaaaacggaggtaatgaatactaacaattcatcattttctaatcattactacattttatgttctgtgctcttgaagtctactctatctatgtgggagagctactctataatggtgtgccacacatctcttagcaactccacattcaatgacatcaagttggtagactgaaattggccatagtgggagtatttacaccagagacattgatggatgctataaatcaaggcatgccccgacaaagccacttgttaaacatttaccagcacaccactgaataggtactcctgctctgtgtattcataaacctgtatagatggctttcattatgctttctacatttgatgataattctttgtttatctgtatacaaccatcagactatgaattccttgaaaattagtatccatgctttacttaccattatgtcactggcaagtacaaagtatttggtacaaagaaaatgcccaataagtatctgtcgaatggataatgttaatatttatttatttatttatttatttattgagacagagtctcactctgtcacccaggctgcagtgcagtggcacgatctcagctcactgcagcctccgcctcctgggttcaagtgattctcttgcctcagcctcccgagtagctgggattacaggcacccatcaccacacctggctaatttgttgtattttggcccggctggtctcaaactcctgaccccaagtgatctgcccaccttggcctcccaaagtgctgggattacaggtgtgagccaccatgcctggccaaatgatgtcaatttttaaagatctccgggcttaaccaatcccacacatttgttttgggcttggagtgtttcagataatgccttttcttttcatcagagttcttgatttttcacatcacatggggaaagaaagctccaggaatattctgaagatctttttattttttgcttatttgtttcttttgagacagggtctctctgttgcccagctggagtgcagtggtgcaatcttggcttactgcagcctcatcctcccaggcccgagcaatcctcctgtctcggcagcctccctgccactcccccaacccccaagtagctaggaccccaccatgctggtattattattatttttttttctttttgatagtgatgaggtctccctatgtccctatgtttgcccaggctgatcttcaactcctgggctcaggctatcctctcatcttggcctcccaaggtgctgagattacaggtgtgagctattcctgcactcggccttttctgaggatctttagtatcctctaacatctgctgatttcccaatttcctatttaactagaggggtgttccataccttcctccttcccctcctcctcccaaagcctgctcaaggctgtctggaggaaaatactggcaggggaccagaaacagcaccaggcagctggaggctgaaggacaaactattgttaattctgcatgacaaaattcccaattgaattcaatctggggaatatctaggaccccacagagtttctgattgaattgagtcttttctaatctataaagctaggtgacctcatacagatcaaaaatgaatttcgtttattgcctttgtttttctaaatggtttgttgataaatttggtttacaggctatgaagactcagaaagtatcagagtaaagatagtttccaagagtgattaattccttgtgatattttgtatagatgctacttgtttattttaaatgtatgccttccaaatgttaaaatctatatcaggattagtgactcaaggcacactgaccacaaacttttgcctcagctacatcccaaatatcagcataagtaaaaagggcagttctaaaaataggagaaaaggatatcaagaaacaagagattttcagaaatttgtggaagatggaaagtggataaaccaagcagacattacaatccagagcaaatacaagaaaagtagagggaggagccacccttcctggccatggaaccacagacaggcttcaaacttgtgtggtttttggaaatcaggcagaggaaggaggcagagaacaagatgattttttgaaggatggaacagctgagaaagttaaacacctccttcaccttcatcaccttccctattgttccctaatctaaaattagaaagccagtctcttaagaaattcatggatctgtagtgatgaccccccaagaaagccctccccattttggtgtggagttgaggaataggcaagtgtactgcctgctcaccctgctgcctgtctcccacccgaggccttgggtgaagtctgccagtgatcatgccctgttatcctggggaaaaagtggttaagaaaacatagtgctataactcacaccagctacttgtattaggcaacctagttctttattaataaatgtaaactgataactagggatcattgacatcttttggactaacaactgacctgaagaaagaagaggtgattcaggaacaaaagagagatttttaaaaattctaatgagtagcctcagaagcattcaagtgaatattgcattcaagaaggtatcacatccacaaagcatgaccagctataatgacaagggagcaaaagagaaatatacagaattcacagaatataaaactatgactgctaaaattaatattcactaaaagaaacagttgacaaagttaaggcaaatacttgaaaaatgtagatacatagaagatcaattgaataggtacaacatcaacctaaaaagcatttggagagcagacgagaaaaggggaaagaaattataatggaaatgattggtgtaaattctccaaattcaaacatgttttcagattgaaagggccctttgagctctaagcaaaattactaaacaaagacataaacaaatcctcttccaggacatcgtggaaaatgagaagatcctaagaacttctcaagagaaataaaaataggtttcctataaaggaattagaatcaacttcgtgtcagatttttatcaataccaaatcaaaaaaaaaaaaggtttcaatgtttgagaagaaatgcttcaaacctaaaaatgtctatcaagggtgagcataaaataaatacatttttaggtatgcaatgattcagaaaatttaaatccaacacatgctcttagaaaaaaaatgactggagattatacttaagcaaaaatgtatatagaagtaatctaggaaagaggaaagtgtgaaagtcgagaagctgtggatctaatttaagagtgcagcagaatgatatcccagaatagcagttatatagtagagtacagtcaatccaaatgagaaccagtcatcagagtcaaggcagaaggcctgatgaagaatatggatttcttaataatgacaaattaattataatatgatagaattttaataatgtattaaattaatgataaagtaaagatataatttttcttttgtcaacaagaacaagaaaggcaaatagaaatcctaagggggacaaaagctggacaagaggtaaaaatccaaatatgaagcaatgtaaaatgtgtcatgtttttaaaaaatttttggcagatgaacttgacctttatacttggaagattctccattgagtagcacagatttaggaacatagaatgcatctcctgctttagggattccatcatagtatttgattctccagtgaaaaatatttacataatcatcattttataattgttattcatatttaaaattttatattctatctgtacagagaaagcataaaaattataactaggaagggaacgtaaatgttattaatataagtttttacagtataaagatagttacatacctgactagctttatgtttgtgggggaaagacaagtgcagggaagtatagggctgttaactgtgttaacttacatagaatatgttgtaaaataccatgtgaagttgacatggtaaggaaaactacaattaaaaggactgacagtatgaaaagttggcccagatttaaagcaattggaactttcatatactgctcatagaagtataatttgatactactacttttagaaaactgttcggtagtatctgcaacagaacgtatgcatatcagatggcccagcagtcccactcctagttttatacccaaaaaaatgcatgctacgtgactcaaaagacttgtacaagaatggtcctagcagcactgtttgtaatagcacaaaactggaaacaacccaaatatcccttaacagtagaatgcataaatacatgtggtaattattggcatactatgcaccactctgccatgcaataaaatgcatgattctcacaaacataatgttgagtcaaagaagctaagcaggaaaaatgtgtatgatatcatttatgacagatctcaaaaccattccaaatctatctatgagggtagaagttaggatggtggttaacttcagggaggacacacacacttatggggataccagagctctgctatttcttattctaagttgtgattatataggtatgttcactttctgaaaactcacctagttgttcatttttgaattgtgtactattctttgtgtatgccatattgtaataaaaagtttattttggttggttgtgttagctcacgcctgtaacctcagcattttaggaggctgccatgggagtattgcttgagaacaggagttcaagaccagctcaggcaacatggcaagaccttgtctctacacaaaattacaaaattagccagatgtggtggtgcatgccagttacctgggagactgaggtgggaggttctcttcacccagggagatcgagactacactggtgagcagtgatcgccccactgcactctagcctaggtggcacagcaagaccctgtctaaaaagaaaaaaggaaaagaaaacctagtaagccaagaaattgcaacatttattctggtattttcagaagtttggaaactgaagcagtaaaaagaaaaaaaaattcctattgaggaaggggaatgagggagagaaagaatggaggaagaaaacttttactttttatcttttactctcctgtaccattaacattaaaaagagaaaaacaaaacgattaaaagtaatattaacattactaataacaatagctaccatttatttcatgcttatcataattgagatactgaactgggtatattatgtacctatgtcaattaaattttcataccttacattcttcaccacaattattaaggtgaaatttattaacccagcttaatgataaggaagctaaatatcaagatacccaattataatataaaagacacaaaatattatttaggaagaaaatttttcagcaacccagaatatgtttcttgttgtattaaggcacattttagttctctagcatttgagggttaggcaggggaagctcttactgtgtttataaatctcattgcccattaatgaacctgaagacataatcatacctggcaacaaattctagaaggaatatatactatgaatgtttatctaatgtatgttagagactataattatggtgtggcaaaaatataaagttatttttaaaactctttctctgttgactcactacaaaagccaagggcacaatatgatgtcataatgcagggaagtaatttcttcaggaaatgcaggtagtagagtctgagcatattgatttttggagctctagctcagtgtttcccaacctttgttcttcataaaactaaccctgctagatgtgaatagttactccatcagaaatgggttcgagttaaattgtcttggaaatgcaaaaaaaaaaaatgtaatctcccttttgtagattcaaaaccatattagcatattaaagacccttagaagtttgatagaaaataaatccaattaattttgtttaaaccagtattttcccaatttatttggtgataggacctttcttcaagtagcgctaacactgtagaaaccagatttttggaaagcattcatttatctcaacacagattggagcatagatgcaccagccattcttagatccttagacagtggctttcaaacgcaagttgtttcaagtgcacacttggcaggtgcaaacggaaaacgttgcagtgaattttgagaattgcctcctgtgccagtattctctggtattgtttacaaagttagacacacacgctttagagttcatatgtgtaggaggcaaagttttcactttgttacaaaaatttaggagcctaacaagttctttcctagacagagtctccccactcacttctgcacagaaataaactacagacatgtctgtagttgaattggactccttcacccaccccacacatacctccaaagtgcagagctgtctgcattttgaatctgtcaaatcatttcaagtcaattctgtcaaaccattaagctctgtgccatgaagcaaaaagagatgatttgaactcataacatttaaaaggcagctattactgattggccccccagatggtgaaagaggtagatgaccttcatacactctacttttgaatacagcttcttcctgagaagcctgaagcctggcaagttaaattctctacacaatgtaccttccccccatatagatgaataagtaaacttttgggaagaggttcagttttttatttatatattagagaatattcacaaaatataagcattttatcattagtgtatctatgctaagctctttatgacaataattaatacaacttcataataaaacaatgacataaagaatgatagtcatctttcaatttggtagagcttgtgggcataattccaattgatctcagaacattatcaagttgctgtgataaaggttaatgagaaaggggatgctataccatttagaattagaatttgatctgtcaaacaagcattcttatccaaactgattctgacagcagtattatggcacaccctttgaaaaagcattgatagcctgggctttaatccaagattgtacagcttgactcatagatggttcctgtttatggaatcaaaggcagaaaagatcagtgaacatgacaaaatgtctaacctcatctcaatgagatcaggaagggtagagcagtaatcgacagtggaaaactagctccttaatgcaagagattagattgagtggttcaggcttaccattgctttgtttttatgaagagaaacagggtagaatatcaagtattctggtaggaagaggttattttcatgagatctttttcaacatttaggtaagcaatagaaattttttaaagtagttcttaccaaatcctaggaagggacgggcttgtataccacaaaatatggaaaatgcatcatgaaataattcacccaatcatctaaagaaaggtgtgcttctatgcttccctttggagaagttttataataggcacaagaatcttgactcatcagctgctagcagaaatatattaaagttcccttttttgccctcaagggaatatgatactataaaaagatgtgaagttaaacaggttatgcatgatttccaccatactgtgtttaacttgtatagacttttgagggccaggagtgtagaatggggaagtggagagagagacttcagaggaaggagaggaaagaagcagaatttttgactacagcaggcaatgaactgagaaaataacaagggggcagtcaggattaatagatattagccacagttagagggaaaacctctctagaggggcattttgaatggagtaaatctcggtctttctcaacctgggttactcatctgaaccgcagaaccctgaaaatgctttgattgattgttttcttaattcttccaaggttggtacacaattaatatcattctacatgcgcaggagtatggatactttagaataatagggctccattctctcactgaacccagggtgggaatggctacagtgttacgtatgagaaggaaaagacctttgttctatataaatcatttctggccaaaattttactatcccaaatggtacacagtgaaatcttgaaatgattacattaagtgccaaagacttctggatgaattaatcatttgacttaaaatgtcttaaggatagagatggaaagaagaatgggttgataactatagaaatagaatactggccattgtacaggcttgagatgatactacagtaatgctaaatgtaaaactagacaaaaactcagaaaaatatttgcttgagaaaacgaaaatgtatgaattatctgatctttcctacaactccagtgaaattttagacaacaccaagggtaagatatgtgttacatggtgtttaatattcatatggaagccctctgaggttttgaaaaagattatgctaaattctctagacaggacttcccccaagtcaaattgaaaatagtagtaagtatggtttattttttttcccatctcccctccaccttttttttttttttgccaaaatctaacaaagctttcattttcgtacaaccttactttcagagccaactttttgttgtttgatggaagtaattcctcttttgagaaattaactcctagggattttgattgtttcagtgctccaaagacttggcctttttcactggaaattttagatgacttaaatctccaacggaagaactgtacactcttcggccagttgatattcagcataggaagctcttcctgaaatttctcaaattggcgatggaagttgcctcctaatctgaaggacagttctgctttcagattactgtataggagccattttttcaagtatttctcaatttctaggtgcatcacaactggaaacttaagcatgtttctgtcgtttccaggaaagccattatttatctgtatattatgcttttattttcctaaaatgataacattcattccaacttcaatatttatatgtgttcagagtataactatttatatcctagaaagataagatgatatatttgtataatatatatttgtatacatgtaatacacatgtatacatgtatacataaatatatacacacatataaacatatacacacaaatttattggatgctctgcaaaaatagccactactctaatgggcatagcccatatcttattcctctcagtatccttaatacctagcacctagcagggaatcaataatataaatataaatatctgaataaaagcaaattgacaaactaataacgtaggcttcttttcaaacatcacttcatgcagcagaaatgtgttatgtgctgccatatgaaacaatgggctgaaactggtttatgagaaatgtgtatgtgaaattgctttgtaaaattttgtacaattattatgtagtcttatggtttcatgaaatataaatgttgaagatgttgtaattatacaatacaaatcttgtttaacagaccttgattaataataactaattgatactttgttattagctgatggataagttcttgatttaaatatcaattagaggataattcattaatttaatcatttttcctcagtgcctcaaacagcattgaaggtttacccatgacataagaacaatctgataaatattccaatactaagctacagtcattcatttgaatacgtaggtgcattattataataggagatatattatgatattgattttgatatttaatatttagctattattttagggtatgaattttatagaccattttaatagccaaactaaggtttgaagatagtcacaaattctaacgtgaacacaatattgattccttacttcaaagacagctaacagttcacaagagaatagttgggctgaggccgtcacattttatgcatttaggcatcaacatgagaatcatagaaaacagtagatactttagtttttctctctaaagaagcatgaacattgatttattttgatgctatcttggtacagcaaatagaatcattttaatagaaaaacaaccctttgtttattttgtgtgttgaacctgtgtgttaactctatgcgttttgggagtttatactatataagaccatttctgtggtctaaaagcaaggtagaactcctttttcttttccactagagagaatttacaagagaattgcatggcaacaagtcaccaagagttaatagttattgagtcatcagtgagtatatgctacaaaactgggtccttcaagaactatatctttaaaatgtccatgtttagagaacatacaaaacatactgtcagaatgaacagcaattttaaatgtaaaagaattgttctattagattgtgtacatatagagtttatattaaattagaatcaatacagagactggtacatgtgttcttttttaggagcttatgaaatggaaacaccttaacattcacatcctcaaggattatgtgacactgtattaatgcatgtggaaatgtaacttttaagtattttgttatgaaataaatagagcaaagttgtttgcaaaaagaaatgcacaatgacaacttcatttattcattcacaaatatttattgagcacctacgtgtgagataaaactctgggtggtgagggtttacacagcagcaaataaaataggccttgtctctgcatccatggagcttcacttctaatggcagagtaaaacaataaacaaatattcaaataaatgcacactcaatgttatgcagaaagttaacagagggtgtgaggttacagagtgagggggaaagcgctatttgaaatggagtagtcaggaacagcctctgattaggtgatacttgagccaagacatgaaagccacatgactatctagggtagagtattctacacagagagaagagcaagtacaaaagccatgcagcaggaatgaacttggcatgtaaggatcatcacggggcacagtattgctagagcagggtaagcaaggcaaggagttcaggagccgctttttatttttatccttttatgttgttgttgttcgtttgtttttgttttattttgttttttttttggagacaagatctcactgtgttgctcagactggagtgcaatggcatgatcatggctcactgaagcctcaacttcccaggctgaagcaatcttcccccctcagcctcccaggtagttgggaacacaggtgcatgccaccacacctggctattttattttattttatcttattttatttttatttttagagacaggatctccctgtgttgcccaggtctcaaactcctgggctgaaacagtcctcctgccttggcctcccagaatgctgggattacaggcatgaggcaccatgcctggccaggagctgctttttagatgaaggatttttttttcttttttttttttgagatggagtctcgctctgtcacccagcctggagtgcagtggcacgatcttggctcactacaagctccacctcccgggttcacgccattctcctgccccagctagatgaaggattttaagttggttgcttatcatatccacatgcagtcatgcccccaaaaggatgctcccaaaaggaatggattacaggaatacaagactacaattttaattactaccgtactttacttactaggcattccttcacatttacaaggatcttttctagctgcgaagagagtcctcatcccaaacctacggttagcttaggttgcattaagttctcaaagtaatttgctaattaatagtagcaaaaatcttgtgtatcatttgtatcattcttattgatttcttttgtctttatttttcagaggtttttttgcattaacaaatcagttgtataaatattcttatatatatgtttatttatgtttattaacttttgaaataatttcataccattactttcactaataagtacactttaaatgtagagaattcccccttaagggtttatcaggacttaccttcttagggtgtgagaaaactgtaaactactgactaataaagtttaaaataccttttatgtttctgtaagaacctaaatttaagttaaattcttgaaacatgactttttcagacatttaagagcaaactttaaaatcccctaaaatagaatccctcctgtcgccttggagacattacggccatcgtgctttgtctgttgtttttctcttatccatctaggaagagtcatacattttcatggcgattaggttcatgctagatatgcgggaatagctttaaaatgcagtggaaaggaaacccgtcagggctggaaattaagtgtctgaattcatacaaacatgggataagggatggtgtggcttttagaatctgcttctccagcaagggttcagatgtcccctacttttaagtctaataacattactttctaacagaagaccatgttttctataaaaataaacttctgttaatgtaacagacctgaaagatctattttatctaagatgatgattggagtaaagcttgaatagaggctcagtttaggacagaaggacaccctacttgagacataaagccagccagtccctgccaccttttttgacactctatattctgtccagttatgaggattgggtgctaaagccactgccttcccatcccaaagtcagaagtggttcaacctcacctgggcagtggtgtggcggcgaatggggcgggaccagggtggtggggagggtcctccttcagtagaggctgacagctacttctcatcatcatcttcctttcaggacccttgctgatgagtatccttgattgataaattgtcatttagagagctgtcttacatcatttaaaggtgaaaatttggtgaggcaaatctaaccttttgattaattccctataactggcaatcctagagttagagttaaaatgaattgctcccatttttttttcttgtttacatcaaaatcaaactgatttcaatttttggaaatatttgctgatagtaaattacacaagaatcatggctggttctactaggtcaatctagtagagaaaattgagattagcaaggtttccaggttattagaattttctattgggataaaaaccaagtgagactaaatactaaaaagccaaagagaaaattcattttctttaaagttcatgtaaatactgcatttcttaaaagtatctgagaagaggaggtcgggttgcaaactgaaataccttcaagagccaggcatttaatatttatttaattaataaataagtgccatcccccatgacctagatacactgtttgcatattaaacacctaaggatacagcctttacttttgcaaagaaatatgttatttccagttttgcatgaagcactgggacctttcagtccattttaattttttccctctttcttagaagctaggatacagtgaaatatgccgtaccataagaaaaacaacagtgcaagcaataatccgtggtaagagacaattggtcttggtgtcagagaggcactgggaagtggtaatgtcacactggaaacttagtctgtttaaggagggctgcagctactcaccttgattattgccaggctgaagtacaagccaggtgttgtcagatatttagattttgcaataaagcccaggatctgtttttttttaaaatgggaaatctcccaatcttaaaagatttattctattgaaaaaaatacactgttggctaacaaaattcacttatagttcaaattttgcctgtggctgccagtttccaagctgtgttgcatattctacagagagagaaaaagttgttcatttattcatttgacaatcatttgttgagtatcacaccatgactggcaccatgtggctttcaaagataatgagacaggctcattgctctcaaaaacctcagagtctattggatgcctggagaaaaaatttatactcagagttcaattattccctatatatttataggtgtcaaatcaatacttacagttccagtccttcacctgatcttcagtatatctaatttccctcaaatgatatatcaatacactagctctctttgtattaacatatatatgtgttcaaagcataaaagtacagaaggccaggtgcggtggctcacacctgtaatcccagcactttgggaggccaagacgggcagatcacaaggtcaggagatcaagaccacggtgaaaccccgtctctactaaaagaatacaaataattagctgggcgcagtggcggatacctgtagtcccagctactcaggaggctgaggcaggagaatggcgtgaacccgggaggcggagcttgcagtgagccaagatcgtgccactgcactccagcctgggtgacagagcgagactctgtctcaaaaaaaaaaaaaaaaaaaaagtacaaaaaaactgcaaaaaaatattagtgtatggtggatacgtgtcattatacatttgtccaaactcatagaatgaaaagtagttaagagtgaaccctactgtaaactgtggactttgggtgataatgaggcatcaatgtagatacagctgtaacaaatgtaccacactggtgtgggatgttgatagtgggggaggctgcacatgtggcagggcaggaggcatatgggaaatctcggtacccttttctcaattttgcagagaacctaaagccaccataaaaaagtctttaaaacaaaacagaaagatttgcagcatgattttatatgaattgttaaagcacacaaagtaatagtgtataagaacatccaaatgtgggaaaagcataaaagtgcacagcaggaggataacaacccccatttggggatagtggttgcctcttgggggaacgtggagggatatgagttggagaagttgatccagagtagtatctggatcattttgttactttaaaaatatctgatacaattttaacaaaagatatacatttgtgaaatcttgatgatgagtgtttaaacatctcatgtcttcttcatgttcctgcgtacaatactttaaagaggtaatgaaaataaaataagaatgtaaaaaacagcatgactaaattagatttttttctttattcctaggggaatgtcttttctaattttcaccattgctttagtggcaccagcttcccagacttacaatatttaaattttccctcttgtttatccccagtggctaacccaatctgttccttatgaattctacctttaaaacatctctttccatctttattgtacataatggcgcagacatcctcatgtcatatcttaacaactctcatcacctccccaaacatctgaggaccccacagccctcctctcctccttccagtaaatgctaccaccttgcttatcacacctttgtcctgctgccattatttagaaatcaagttcaacttctcttcctggtatttacataccagcatagtttggccccatgtcaatttataaagcacatttctctctccaactactcctaactcctcttttcttagtgctctgatacttaaccagggaccaagcaacattccacattcaacttccatgattttgcgtatggtgtttcattttcacaaaattttccttccttttttacctttccaaaaatcctctctacaaccctcttctgtaggacttgacctatatttgttttccttatcatgtttttggcacaggttgtattcacttagatactttattttaccttatctttgcaagttcatcttgaatagttttagtgtggtttaatttggttttttagtcattttgtgatttttttttctttaagatcacttcttcttgtccaaattttttgtagttgtctcccttatcactgctagggattctattcctatgttgaaaaagtttcaatctatcacctatgtttggtgcctgatagctttgttctttccctctaccccaatcaatcagtggtcacagtgctgagtggtgaccacagcgttttcagcctctgtagcaaggatgccctgcctcagccactggttcctgcagtgatcctgaattcattgacttttgcatgtgaaaggcttttagtctctgttctctgaggctgtgaacatcaggtcatcacagcctctgtccagtcctgacccagtaggactggacacctctggtctctactcaattgtgtatatttcagttcaaagtttggtccacagaggtataaatcttgtttttgagtatagatatgccccctaaattttgttttaaatttcattgctatgtgttaagcataagcagcagtctattggaggtatccactgaattgtgttgatgtttcaggcagtcgattatcttgggtgtggtttacagtgcatctgccaaatgcttatagcaaatagtttcttcctagtctagtgtgcgtcaacagtttcttgggttcgatatcctcccacagtgacataaatgctaaactgccaaatttaagcatgtaagaaactgaagataaggcaatactgtgctaaagcttctattctactacatgagattaggaagtggaggaatggctaatacagaggtgtgagattgttcactgattctgtttaccaaatagttctcattctaggtgatacttccaggggataagttggcaagttcaaaatgcctgaatattctgcaaaaatgtgagctgttcagcttacaggggcacctaatgtttataaaggccctggttttaacaatttggtattttacctaaaaagagatatttggaaagttatgatggggtaattagactgattaaatattaacacttgtaggaaagaggtttttttttattttaagtttagaaattcagtgaaaattgtatgtagaaacggagagcctgagatctagaaatcaatatcaagaaatccaaggattcaactcttaccaagagcaacaaagccatcacacctggaacaaccatgacttttctgacaaaatctagttgtaagcaaatagaatttatcccagaacaaccaatttaaactctttactcttgtactcttttaagatagtcttttctacctctggagtctttcaagtaaagcaactggcattcttactttacagatcaaacaagctagggatgaaaagctgtagtctgtttcataaccctcatctggctctccaccatatgcaaggcatacacaggccctaatggaagtccaagagtgtctggagtggaaactttttattgaattctaaaaggccagaccagacttcttgttattgaaatcagctttggtcacagagcaggaaaagcacctggagtgatggggacatggccactcagatcagcagggaaatgctttctagcacccgctgtgcagagcgtctacctctatttgttggctctagtcattagcagactaatatgacctgcccagtgccaactgctaactttcaaacacatttttcttctctcccacagcatcagaatctccatgaaggcaaagcactatctcctacgttttcttgttttctccctgtattagtccattttcacactactataaagaaatacccaaggtaatttgtaaaggaaagaggtttaattgactcacagttccgtgtggctggggaggcctcaggaaacttacaatcatggcagaaggagaagcaggcatgtcttacatggcagcaggtgagagagaaaagcccaggggaaactgccatgtgtaaaaccatcagatctcatgagaactcactcactatcatgagaatagcatgggggaaaccacccccatgatccaatcacctcctaagaggtccctccctcgacatgtggggattataggggttacggtttgagatgagatttgggtggggacacagccaacccatttcactcccatagctgctactataggactttgcctagagatgtagtgaaataagaatttgtttcaagtcatttgatttttcattaagaagaatcacctttcccaaaaggcagaatacttctcttccattaaatttcaacatactcctcagaaccccctttgcttcatagtatttaaatttttctcacaagtatttccagatgccacaacctccactgagaaaactctcaaaatatggtgtacattatggtaggaaatggatctgggcagcctgtttggtcccttcttcattctagtatttttttccttaattaaaaaaaaatatttagaagtgatggatgatattatatttagtttagaaaaaaatgagtaaatgctcccctccctcctcctcaaagttaggtccatagagattttccccaagcaaatgaattttttttcctcattacccagtattgtcacattctacttaacatgttgccagtgtgccggtaaacagttataggcctacagatataatcctaatgtgcttgtttgctcttttccccaattagccatggtgtattaaagtgaataaaatcttttaaagtctttcagcagctacatttgctcaagtgctcatatccacgttaaaagaacaacaatcatgagtattctctgatttggaaataaagaggattgagaatgctggggaaaaagctaaatgacatcgggagaaaagcagtccctagagcagaacacagtatctctcaaagcttaagatttgggaaatagtttaaattttgctgatgcctctcctccagcctcaggcttttctgagctctacagatgattccagtgtgtgaaataaaccaaatattgatcctgctttagggtaatcccttcaactatggaatgtaaatttaaggagataaatggatacagggaatgaaattctaggtttcttttcttggtgcttaatattccagagttgctataccacctgttgactaggtaggctggaatcccctaaaaccaaaaagtatatgcatcatgataggaaacaaatgttctactaggaggagctagcacatcatctgggtcatagcaggcaataataattactaactgtgtacagtagtactatgtacatattgtcttaaatattttactcatattaacccttttagtccttacagcagtgctatgagttggatatttttaccatgctcattttggagatgaagcaatttagggagagagaagttaattagtttgcccaaggttatgctgctagatttgaagctggtcagtgtggtgtcagagccagactcctaaactctactgtgtgttacctttctacattgacaatagagatttgttgaataaacaagaggcagtagggtagtagtttgagggaagagttgaaccctcaagattatagggttggccagtcctatgctctatgtatttcaaacactggtttcttctattcctcattcgtgaccattaagatcagctaatggtctaaatgctgatagttaatcatagtgaccagcatgtgtaagttatctctcaaggaaggtattcttgatcacagtgtccagtgattgagataatgtgtgacatatttccattaggtcttttctaccagaaagctatgcaactcatcttactgactatattctactaaaattcaaattccataacatagcatactcacagcttgatttttaagggcttataatttcttgagtcagactgagaatagttaagatggtatctatttcataaaacatactttatttgcttaccaagttctttggaaaaagctcacaagattaagaaataaatctgtcatggtgcttcttgtctcccccaagcagcctgagatacaggtggcatagatggacttgggcccataagatcttttaagaatacttttaagagtattcttctatcagtggcttaaactgaggtagagatttctgagaactgcacaggtggagtgggatgccctcccttggatgtggagctacccgccgttgggcacttggaaggaaatggccagtggagacggtgctggcttcattcagctgccgttgggcacgacaggcaaagtggacactgtggtgtagtggaaataatatgagctctataactcgctagacacattctcctagagcctttaaaaactttctgtggctcggtttaccctttctgtaaaatagatacaatagctagccctaaaacacaccactttggttcataacatagaatttctagcctgctcttccacagaaggaaaggagcccaaggaaatctgatatattcctacatccatatgtgtgtgattttactatttaatgtcttcaactgtgtttcttcttcctgacatatcgattttcctcatttccgtgtatccgaaacctacgtctttttcatgtcctagtttaactaccctgtctaaaatgaaactttaccaatttccatcaaacagaagtaatttccctctcctctgtgtttcagccactcttggggatgctcgatggcatttagcatgcctttccttgggttacattcatgtgctgcttttatctttcctactgggctacaagctccttgtgagggaaataatgcctagcccatctttgtatccctatacggtgctcagcatggttccttgcacattgtcagtcaataattgtgtgtttaattgaattgaatgagagggagaaactgaacttagtacaaatttctggacctttttctctgcccagacttgagggactcagcttatctgactgagtttgacttagcctaaggtgataacaaatacagagctgatggctttctctagtccctctacttgaaatattgtctattcttcaggaagtgggttgcctcctggtagatgcatgcaccctgaggattttataggatgaatacttttttaaaaatactatcaagagaatcgagccagaccaacttcaaacatgaaattgctagggaaaatatctgaacaatctgcaattttatttgatatacagttaagaaatatatagattctttttttaagctattgcatatggtcctcttgctttttaaactacaagaatgttcactttcttctttgcttaaccccctgtgagcctatacggtgaaaaaccaagagaatgaatttgcactttcccacgtacatgataaaatgaaagtcaccaaataaacttgtttataaatagtgttcaattatcaggatcactggcgtatcttacacattgattttctagattgttttagaaatatttgtcaactttcctttacaatgttattcatgcaactaagtggatatagaaaacgtctttaaatctccagttaaaattggactttgagctgtggaagcatactggacagtctggtgttaaagatttgccataagtgaacctcaaaaatattactaacatgcatgataatgtcaccgactctgtcatcaacttcttgctcgctgtgcattcagccattctctgattaaattggtgactcgaatacattactgtatttgcctattttgttgcttctcagcagctgtcaataaacccagcagactccgtctttcagaacatttttaccaactgcatcagtcacactggaatgctttatggtgaatggagtattttggctgaagtccagttcagcaaacatttattgaacaactgccgtaagctgggaactacaaatacccatccattccttattttgttggaacttagagaagggagaagccatattctcgtgatcatttggtcaaatcatgatacatatgcagaatagagaaaggcaaagcactaaaggatgaggaagggagaaacactaacacttactgcataccacggcccttccgggatgatattcaaaacatttaacaatctatatggccaggcaccaaccaggcagaatgggcatgagccacaagccaggagcgggatctgtggagccagatggtgccccttaagttgctggatcatgagcaggtctgaaggcttctaggtgaagtgggccagggcctcggtagcaagaaggcactggtggagggaggggggaagagtgggtggagggaagcagcttttagcaactattttcaaagtatttcaatgtcttacccctgaaatggctatgctagtgcaaagcagcaggaaatcaaacagatgcagctactctacaaggtctaaagattattaagcagaatttaaaataaaggaatcatatgttagggaggggattaaggcacacagctggtaaagataaaccgaatttaacccaggtctctttagttccaaaacccatcatctctgatctgtaatagtaattaattcatactgacaaatccagagaaggaggaggaaaaagacgatcatgatttacaaagtaccttttgagcagggcctctaaagtcaaaagattttttaccatgatatctctaagaatatgtgatgttggatttgtttgttccatccctaataagggtcttatttttcttttcctggttagccttctttctcttcctttcttttcacttctgtcaatttctttagacaaaagttcttaatctagaattcagatgcaggaggaccatgaacaagcctcaggaatcctggaacccattgcctctgtgtctgctaaagtgcatttttgtgggaaggtgattcatagttttcttcagattctcaaaagcttctgtgtatattagaggaaactgaaaaatattccacagatgcaaaatttatgtattatgatgtcgtataatgtaacattctgaaaatacaacatgtccacctaaatttcaaagggctgaaaaagtaagtatttaatctttggtacttatgtgtatattattgtcacatgaatggcatttcgccccacacataccaatgagtaagtatattggaaaccacagaacctcggcacccaattttggcagacattgatgcatgtaacttgtggtgaacgtttagaggattacaggtcatctgggcagttactgcactcataaggcgggagtctagcacaatggttaagttcagactcagaatccacagctggagttcagcctggctgttgcttccctagtctgcagctttggacaagttacttaatctgtgtgtaccaccattttctcatctggaaaatgagggtactaattgtagcaaccttttataattttgcaaagagtaagtgattgatgtaaggtgagaatagagaggtctacagctgctgaactcctgtaccaaagccagagtatcacatgagaggacaccctctcgcctgaattctactcctttcagcactcacctcttcttgctacctggtctctatttgccatcactattatgccagggccccctgttgctttcatcttgaatttatatgtgactttccttatcccatcaatggggtggggacaggtgaagggaatgaaaactagaatgtgataatggaggactgccatcttttaacgtagcaaataaaaatatctcaagattccagaacacttgtttaatcaagtaaaactgaaaacgaaggaaagcagtacctctcttatgtggtcacctagcaaggcttatgttccgggtttaagcaattctcctgcttcagcctcccaagtcactgggactgcaggtgcgcgccaccacatccagcttatttttgtatttttcatagagacggagttttgccatgttggccaggctggtctcgaactccagacctcaaatgttccacctgccttggcctctccagtcgctaggattacagccgtgagccaccgctctcgcccttcccccaaatatatttctgaaacacagtttacacttgcagtcatgccaatgaaactaatcatctatcaatcaatgaacattgcttgaaagtcaagtatacataaaacataaagggagataaagagtaatttcatttttaataagtaattacacatgaaagattagcaaggattccaagagtattattatccattcctacttaactgaaaacttaacgtacctttttttgtgtttagaatttcttgaaagatgaatggacattgtggcccattgtgagaaagccatggcagagtcagttaagaaacatcagtttagcacttctgaatcttatcttccagcaactttaatactgaacagcatatcctttaatactgatggctccatacagtataaagaaaagctgtatttctctgcctccgaagccctagacgcttacattgatgattttcacttaaactatgagcctcctgatattgatacaaaggttaacctggatcagagtcctcttgaatttcttgctaagtcaaatagtggtaagctttcattattctctgagttcaatttttaattatctatagaaagctgatgctttgagaagatgcatactctaaaagatttttttcttggaaaataattatcttgaaatttatgaatctttttataagattcttatataattttacacttaattttatacttccaaaacttttccagcaatggattgcttttaatgggagttaattccggaaaacacatcccagcattgatttgagtggcaaagctctggctttggaatctaaagcactggacttcatgactgaaagtgttacaaagtcacttaaattctccaagccaaagttaatccctttgtaaaatgagaataataatagtaatactccacatggttattatgggagctcaatgaatgagagaacattctgtaaattgttgcatgtataaggtcctcagactttctgtagcgcagtgaagaaaacactgtaatagaggtcaggcgacctaaggtctgttttccaatctgttaatgactgttgagatatgagaagagctgcttactttctctgggctttagtttcctcatcaataagataaggagattgaactatatgtgctccataatttaaaaactctatactatgcagatggcagaaaaattcaattagcccattccagtatttcaatatttttcatttaaaaattgttatttgtagaagttgaaaaagataccatgataaaactaaaactgggtgtgaatctgaatttgtggttgattgaccataaagccattggggaaataaattcctctaataataactcatttttattagtagaaatactattactaccagtaaaaatgcctgttcttccactaaacatggtcttttaaagactgtatgctaatttaaacaagagtattgaaaaattatacattacaaaactaaggtggcatttattgctactgattttagactattatgaaaacatttaccatagtattgtatgctgtgcttgatatgcaaaattaaaatagatgaaacagctttttattctttcataattgcaaaaacagaattaaatgagtaaatgagaattcttgcaagtcagacagagtcctacgtaagataaagccatgtttctttatgctaagttatctgattataatatttgacatggtttgataaatgcagagatgtgatatggggattgagtgtgaaagtggtgtatgagtatctacattatctgtgcaattgaagtgcaaaatatgttgtaatttattcaataatactgctggttttcctgataaggattttcaatcttcttttgaggtttggtggtagaaagtttttctgtatcagtttttcttttgaatccacagagaagaggctgtggagcagtcacttgttaatgacttgaaatgtgatacaggcaattgctctttctgtagtttctctcaagttattaactccaccatcaatgttattcttggcagttcttcacaaaaggaaaaatgaacactatatgttttttctgatcatcagagtaatatgtactcttggtgatatggtttggccctgtgtccccacccaaatcttatcttgaattgtactcccataattatcacgtgttgtgggagggacctggtgggagataatttgaatcatgggtgcagtttctcccacactgttctcctggtagagaataagtctcacaagatctgatgggtttatcaggggtttctgcttttacatcttcctcattttctcttgccgctgccgtgtaagaagtacctttcgcctcccaccatgattctaaggcctccccagccatatgggaccgtaagtccaattaaacatctttttcttcccagtctctggtatgtctttatcagcagtgtgaaaatggactaatacatatggcaagacaatttcagaaaatacgtaaggataaagcagaaaccaggccaggcatagtggctcatgcctgtaatcccagcactttggaaggatgaggcaggaggactgcttgagcccaggagttcaagaccagcctgggcaacatagtgagaacctatctttacaaaacatttaaaaattagctgggcatggtggtgcacacttgtaatcccagctactgggaggctgaggtgggaggatcgcttgagccagggaagtggaggctgcagtaagctaagagcctgggtgacaaagcaaaactgtgcttcaaaataataataataataccaaaaccaatcataattctaacaccagagaaaactactattaataattctatataaatttcccttttttctaggcaaatatgtatttcagaattgtactatccccactatgctataaccttgtttattcatgtactgatatttgtgactatcatttcatgtcattaaaatagtttgatatctttatattaagtggttctataatatttcattgtctcaagacattttagttgtcactaatatatttattattcagaatgttactattgccactgtgatacatgcatgtttgggtagctgtctagttatttccttaggatgcatttctaggaatagggtttctgggtgaaacccaacgcacattttaaaagttttggttccttttgttaaactgtcttccagaaaggacatgcctatttaaacactcctaccaaagtagagaagggtccttatttccccataatctcagtgcccctggatattatgaacttctttaatccatgccaatctgctgggtaataattggtatctgtgtttattttgcatctgcttgtcttgttttatgaattgcctttactttgttttgcgtatttaaatctttgtctagaatatattttgttattacatatggtcaaagcctagtttattttaaaaaacaattccacttgcctcccttgtaataacctgagttctcatatatacttaggcttcttgactttttgttccattgattcatctgcattatttctgtgctattatcactgtattttaattacattagtcttaagttgaatatcttagatgggatggggtagagggttaggaaggaggtatgcctattcttactcatttatccttccaaatggattttagaatcattgttcataatttgcaaatgttagtctttggattacttagatcagattcttaactgcccttctgggccctgactgatccctttcaacccattctccacccggcatccatagggttcttcctaaagcaggaatctgcttctgtcatttgtgtgctgaagacaccatgatggctccccgtcatcctggggataaggctccgactctttaatatagtctcattggtgacctggctcttacttaacaatctagcttcaatttctctctctgccctaccacacacacacacacatgcaccctctttccccttccactgtactcctttctagcagtcctgaactgctgctagcccatggactgcaccaggcacatggtgcctccctgcctttcacatgctggagttctagctggagttccctcttgctggagttctctcctctccatcccccttttcttctgtaaacctttctttccagccttgatttagatgtcactttcccaacaccaccctcctccctgcaaagtctggtttagttgttcctgttgtgttttctcttggcacctgtaacatcccctaggatggcatttaacactatattgtaagaacctgtccactggcttctctcccccacgagactgataaggtcgtccaagctctgtgtcttgtttggcattgtaattcacattgtaacttggcactgagggcacacagtcaattctgttgaagaataaagcagtctacaacactatgatctttattttttccattcaggataccctttctattggcagtatggctgttatgaaaactattactctgtccttcacttttaaggtgatgcttatttctacttcgcatatgttcagtaggaacatgatctgaacaatgctaggtgatggtagcactgcgatccttataaggcatggccaaggtaagagagagagaggtgacccacagaattaatgcccttgggaatccttccaggtctttacaaaattctcagggttcttttgaattaacttgtattaactcaaagaaataacatttcctcagagcttgtctcagctcccattttagttctactagtgtaactgtgcttgcactaaattcatccagttgctcctatgtgtcatgaaagaatagcttttgctcattttcatgtgtgataatttttatagaaaaacggcaaagaggatatgtgaagcaggtgtattttacaacttttatctctgaaagtttagacttttagggtagaaaattcaaaaatttaaaaactaaataagaatgtgttcagggatccaggcccaccccttcctcccccaatctgacttatttaggctcatctcttaaagctcccctcagatgtcccacatggttttgtcaaagcgcccactggctggcttagctgcccttgcccctggttagtggtagcacctgtgcagatctttgtgctcaccacatttgactgcagacatctgtttctgtgaattctgtgaggcatcaacagtgtctcagttactaccatttcctcagagcctggcatacttaagtgaatggataaattgacaaattatcctaaaggattactacctcagcatgtcagataaagccatgtttgtctaaaatgaggaaaaatatgactaaactatgtatagttaatactcagcctcctctagcatagaaatttgtgcagaaatttaggggatcctctggaaaaaaaaagttattggcactcttgcgttggattttgtcattgtctgattcactgtgttgttgttctgttcttgttgtataaggaattttcccccagtgggatttatgaactacttccagacatgtattttgtctgtttttgctttaaaagtcaagtgattttcctttgtacagaaaatatgctttgggagaaccagagagaaaattcccttgaaagattatgacaaaacccagaatggcttttgcttgaaacattaattctttgaataattctctcttagtttttttatgcttgtgtgtggagaaaatggcccagtaatgctataatggcctattttgtggatgtgagagttgttcttctttctcaagaatgaaaaatcataactgttgatttgaaggtagactgatctggaaaccaaaggagttttaatggacataagaaggagaacattctcatcactctcaaaatcaacttcgagagacatcgtttgagtcttttcttctagcttgagtatctctgggatattttgccatataatctatttgtagttttgagatggagaaatcaggaatctgtttaaaagacatcttgttattctagggatgaccaatttatttttcagtctatgcttgtctgatgttgaactgacaaattgcatatttttattcagcaactaatatgtgctaagtaatgtgcttggaattagagggatagagtcaggcctggtatctattctgaataactatgatctctgtcttcaaaaacttcatagtttagtagtaattcaaataagcataacagcaacaattatactacggtgtagaaagagctgagatggaagtatgcatgagatgctttgggaccaagagaacaagcacctaaagctggttggaaggttggtggaggctttcaggagaagtgacccttcagctgaattttgaagaccaagtagaaaatatcaggccagaaagaaaggagtgaaggacattctagagagaggtgtgggtatgtggaaaggcatagcatatgttcaaggggttgttggtcattcaggatggatagagaatgatgttgtttaattctgtttcctcagagcttgtctcagcttctattttaattctactagtgtaactgtgcttgtactaaattcatccagttgctcatatgtgtcatgaaagaatagtttttgcacattttcatgtgtggtaatttttaatagaaaaatggcaatgaggatatttgaagcagatgttttttacaacttttatctctgaaattttagacttttaactagaagattcaaaaatttgaaaactaagaatgcaatgatagttcaaagggacattttatgctggattatttatcattcttttctgtggttctttctaactcctggaataactatttaatctcttcacaacccacctacctgaaagagtcattttccacttgctatccaatccttaatgaatccacttaaatttgatctctgctcctcccactttgctgtaattggtccctgattttctccctcacccatccagcctgtacattgtgctgttctatgctgtgtgctttcacaaatgccattccctctttcctggaacgccctcccccaatgcacacatcttcttcctttagctaacttctgcttaccctttgaaacataactcaagctcagcctcttccagaaggtctccctaatccttttctgcctcagtactcacttcttcccaccctacatggcacttcagttcgctagtagtagcatactctgtgattagtaatactattagtaccctactaacggtggtatactaatagtaataggaatacctaacatttattaggcatatattacaaaatatataatatttacacatatgtatatatgtatatctgctactaataataatgccatttattagcctcttgttatatgccaggattgactacatgctttagctattaaactgcaattagatttgcaccaacctaatacattatattgtttaatcctcgtagccaaactaatccccatttcacaaagaaactgaaacacaaggagcttatgtaaaatgcccaaaggcacagagctgttgagtattgtccctgggtttttacccaggcactgtcacctcacaactctggctgtaggccagcactatatcatatgcactttgtgtgtgttacaagtaaagctatgggatgtaaagctgagaccaagacaaaaaaaagagagagagagagaatgagatcccaacactcaccttagacatgatgatctgacctttaaagaagggcctaaattgacaaaattgatttcgtattttatttcttgtttatcttactaaaaactaattagtaggaatatagccaaaaaggtaagagaagtgcttaaactagggaaagaatcaaggagcctggctgattagctcttgacttgttaactattttgtctgtcattataaaaaactattttgtggggcagtaagaaacagtacagtggccaaagtactggggtttgattaagaagaactaggtttgaattttaacactcacctgctcacattgtaaccctgggcaggttatttaacctctttctctttatttaatgtacaaaatgggagaagtaatacctatcaagggtatatattgcagattaaataaagtgataaatgtgagtacacctaaaacagttatatgtaacatcatcagaaccctcaaaataatttgtggaataaaatgcaaaatatggtatttgttaggggtttcaatattcataaccttttactctcactctttctaacaacttgccatcgctctcaccccaagccataacaaaaataactgctttcataagaacaactatgttctcattctgagagggaaagttgttcttgatcattgtgtatagaagcctgtggcatatatctaaatggccctcagactttacatacaccatgtggagtcttggctgacagcgtacaaaagaatttttagtgttcacagtgcatttggtagccagcatggatttttgtagcacttccagtaaaattgtgatttatgtagctgactctttcaggcagttcaagtaatttattatatcagaattttgcttgcttagttatctgtcccagttatgccctgaaacttgaagttttacactctgtttatttatgaccttccatttctctctctcctgcattatcatatgatagacagatatgctggaaaattgtgtaacggagctgagcaagactaggaggacttgggagatcagtagaggattctgcagtctttatggaaaattggctcccagcgggctcagattttgaatgaataaaataagaagttgaaatttttaagtcgagcttaattactttaactgtttatcttctgtaaatttaaaaaaaaacatacaaaaataacaagaggagagatataaaattattaacaaaaatttctggaccaagattaataaaattaagctatatgcttttgggtttgcatatttttattcatttaaattgttactatgtatactagatgtgtaaaataagagtatgtagtatgtagatggacatacatgttttaaaaaagaagacaaaagaagacattcacatgcccatcacccagcttaaaatacagaatattggtaaccatgttaagcccctctatatccctcaaagatttcatcatcctttatcttcccaaatataaggttgtcctgtgtttttaaacttatttatctttttttattatttatttatttatttattttatacagtttctactctcccatcagtgtacattttggttgtttccagattttgccaatataaatgatgccccagttaacttccctctacttgtcttatgttacacacacgctaggttccctggaatgcacaccatgaagcggcctggctgggttatgggcctgcaccagtgcagctgtgctggaccaggccagactgttctgtgtcccctcccatcagcagcatgtgacacccgttgctccactgttacttagtttgctcaggctgtcctaacaataggtcatagactgggcagcttagacagcagaaatttattttctcacagttctggaggctggaaagtctgagatcaaggtcccagcaagatttgattttctggtgagggcccttttcctggtttgcagatggccaccttctcttcatgtcctcacatggcacagagagagagagagtgagacacacacacacacacacacacacacacacacacacacagagatctaatgtctccccctgttttataaagacaccagctctgttggatcagggcttcatgcttaagacctcattttaaccttaatcagctccttaaaggccctatctccaatgcagtcatattgtgaaatggtcaaggtagggggaggttagggttcaacatatgaatttagggtggatgggagacacaattcattccatagcaattaacagatgcttgctattgtcagaagttagatttttgttttcaatctagtggatataaaatgatatctcattgtggttgttggtaaacattcacaacaaactttacaattttaaccatatttaagtgcgtagttcagaggcattaagtacattcatatggttgtacaaccgttaacacaatctatttccagacctttttttcatcatctcaagctgaaactctacctattaaacaataactccccgttccctctcctgtcagcccctggtaaccaccattctctttcagtctctaggaatttgactactctggatgcctcatagaaatggaaccatacagtatttgcccctttttgccttgcttatttcacttagcataatgtcatcaaagtttatgttatagcatgtgacaagactttcttccttttttaaggctaatattccattgtaaattatttgtaaacagaatattttgtttatccattcatccatctgtcgacagtagggttgcttccaccatcgggctgttgtgaagaatgctcctatgaacacgggtgtacaaatgtctctttgagttcctgctttaaattagactaagggtatattaccatggtttttagtttgcatttccctgattactaaagaggtgaaatagctgatcttacttttattggtcgttactggccattagtgattgtgttttctcttctttaaaatatatgtttatatcttttactatttttaatgggtaactggtatttattttctttactggtttttagaagttatttatgtattctggatactaatcctttgtttcttttatgtgttgcaattttcttctcttgatttctgatatttacaatctctttatggtggctttttgttgagtagaagcccttaatataatggaatttacgatgttttcttttgatgattccttatcttgttgaataattattcttccctgaagacattcagatattaattatttaaaattccagtcaaagcaaacatggatattttaggaagtaaaatgtaacgtataaattttatttcttttttctttttttcttttttttttagagacagggtctcactctgtcacccaggctagagtacaatggtatgatcacagtttgctgtaaccttgaactcctgggctcaagtgatcctcttgcttcagccaccccctgcaagtagctaggaccacaagcctgcatcgccacgcccagctaatttttattttttttaataaagatggggtctcgctatgttgcctagggttgtcttgaacccctgacctcaaccatcttcctacctcagcctcccaaagtgctggaattacaggcatgagccactgcacctgacccaaactatgtattttaaacaagaatgtttaaggttaaatttgaaattccatttaacaagttatttattgactcctactatgtgccagacaccattagaggtcacagattatttgtcctcctggagtttatatttgttgaaggagaaaaacaatagccaaatgaacaaataatatgatgccaggttgtctagatgctataaagaaagactaaaataaatttctgttattgggtccagagatctctcccacccatgtgggttatgtagaaagcacaagaagagtccaacattggaagcagagtgtggctgaaatggtacaaatgataccccgtaggcaggggttctagtcccagctctatcactagttctgtaaattgggtgaagctcacattcagttaaatgtgtggattgaattagataatctatatgacttctttgccttgaaacattttcttaagtgtctgaaagtcaaagagattttactgtgttaaacctctttgggataaactgtttagaagggaagaatatatgatcaatttaaattttttttctaaagctaaaagaacttagttcatttccaattctgattcttaactctgtgtctcaggaagagtaattttttatcatttccaataaaaccaactttagattctagctgaagcactgtaaatggaaagccatttgtaaagggatttccctataattaagatgactctgcagagaaagctataaaagcaagtcttccatgattggctgcaaaaagtaaagcactaaaattgccaagtaatactatagatttcaaaatttatatgtatcttttagagctagtctcataaaaggaatggttatttaacagtctaaattcctgaaaatggttttcatagtgggaaaaaaaatgtaacacatactgctatacttctttatctatggacattaacatttaaatttcacattggaaatgtatgggaaatcttttcgtggaatgaatgctaagttaaatgtgacaggtgattgtgataaatcactacttattacctggaggagaagaaaagaagcctttgttgcctaatgaagtataacacaacacacaaagaaaatgcaaagatagaccattcttgaagtcgaacataaaccattttatgtctctgaaaaactgaaggaaaggatatgaatcatatgcctctcatccacctgagggttatcctggactctgactcttttgaacttgaagctttactgtttttgcacaatcacactctcaagtgtgcttaaaggatgttatttgactgcctttggcaacttcagttaagaccttgccaatagagatgagtgaagccagaaattgcttaggctgtggccaggggtcacatagcagagggggtaagagcacagcttatgaaatacaacttcttagtttcctacttcaaattctagttctgtcacttatagttaaagaaatctgggcaagttatttaacctcgggaaatttctacttttctgtaaaatgcagatagtggcaagttaatccatgtctttactgactaaaagaaaaaaaatgtggccatcttcaggtactcaaaagttacaaatgccatttccctctctctccacattctctttctggattttttgaatttgtgatgaaagttttatttttaaatagtgatcttaaaagttacagacatttggctgggcgcattagcccatgcctgtaatcccagcactttgggaggccgaggtgggaggattgctggagctcaagagttcaagaccagcctgggcaacatggcaaaaccccatctctactatatatatatagtatagtatagtatagtgtagtatggtatagtataatatatatataatatatttttatatatattatatataatacatataaaatactcatatatatatatatacacacacatatatatatacacatacacacacaaaaattagccgggcatagcggcacacacatgtagttccagctacttgggaggctgaagtgggaggatcacttgagccctggaggtcaaggcttcagtgagccaagattgtgtcactgcgctctagccttggcaacagtgagagaccctgctcaaaaaaataaaaaagttacagatattcttatatctgctacagagactgacatattctgtattctgccctcactgggccttaagcaagtcacttataccctgagcttcaattttcttctttataaaatagaatcaatcccaattcataaggattataggtccctcatagactctgatacaccttatcactacattaatggataagagcaggattatgcacagttttcttaagcagtggttttaaaacttggattccagtatgagtttctaagaatcttgaaatccctcaaaattgtatgtattttaatttatatgtctttgtatttcaatacattcttaaaagagtttatgaccccaaagagattaagaaccatttcctcaacatgagaccaaagaattttataaagcaagacctgaatgtgacctgaccaaatgtgtctatacaaatcgataaggaaagtgttcattagaatggaatttggttctcactggaaaaagggaagaaaccttcctttttggggaaggaagcatgggaaaaaggaggatggcagaaggaaacattggcaccatccagggaagagagggtacctcagctagtggtcttcaagtgttccaagcccaataactagatcatccctgatgtaaagatagagaggggttgttgctgagagctccaagggctccaattacaatggctttgccttctctttagataaagcttattttgtttccattccctacttgccttgtgaccttctggttttattttttctcccatgcagttctgtttatagcaagtgttctatacctgtgacaacaaatgtcttactatacttccaccagtctcattatactccagtccccttggtttggtgatgcatttcttacttctgagaaatggggccactcttgacttgctgataatgcaagtttctacacctacaagggagaggcccaaagatgagaaccatggtaaaataaccaaggagctgaatgccaccttggaagccctggtaggagacaggctcctgagatcctctcagtattctcacctccccttcacagtcccacatatgttattttccattatgagcttgtgtaggaagaaatacctacctcatagggttatacgatacttaaataaaataatgcatataaaatatgcagccagtccttggcacatattcagtgttacatgttctgctctagttctgtcacgttaaaatactcaccttgtgacaatcctctgcttagatagaaatttctatatcaactgactcacatggtaggaccactatgctgtaatttgtcatcagtctcccataataataagcatagtatcacttgtctttttccctttgttacacagaaagtcagatgatgacagtagatgggcatcgtattaaaaagagagagagagaaagagagaaatctcgcatcttcttaatgcttgctaaatggaggaaaatggcagcaatgaaaatgggtacactctatatgactttagtagtgctattatactcaatgaaacagttaggtatagatagtattgttttgttagtaggttttcatgttctatttgaatatcacctttaagatctcttttatcagagcagtaagcagagccaatgaacaaatatttatcaagtgcctataatgtacaagatgctctgtgggaaacaaaaatcaataagaaataacgccagcttcagcggtttttttcaatcaagcccatgcccaagaaaatattagctttcctgatttgcttactgtcattggagtaatagaaagttttagccaggcgcgatggctcatgcctgtaatcctagcactttgggaggccaagacaggcagatcacttgaggtcaggagttcaagaccagcctggccaacatggtgaaaccccttctctactataaatacaaaaattagccgggcatggtggcaggcacctgtaatcccagctactcttggttggctgaggcaggagaatcgtttgaacctgggaggcggaggttgcagtgagtggagatcatgccactgcactccagcctgggggataagagtgaaattctgtctccaaaaaaaaaaagttttatttttctcatctattattactaaaattatcccaataaatatagccaacaaacgtggagatttagttttgcagaaatgctttctggctatttcttctctacaatgtaatctcagtaaaatcctaagaatagacagttcttcaatagaggctttcacctatttgaaaacatcttttattgcactgaaaatgtgataagatgcagaagcagactattgctttgattcataagagagtaactgaaccactctgagtctctgctcactgccctcatgtccatgccctcatagacagtctcataatgatagcacagctaacttttgaatgtatggcctttaagacacccaggaagatagactccattttaaactgttttcaactaacttctccaagacttacttttctcacctggcaaatgcgattcattctttcactcaaaaaaatttttatacaaatcaagctctaaagtccatgttttttgccccataagaacttaagccccttgagggaagagaccagaggaaaaagtccacatccagagagactgagagttgggatttgaggacagggattctgatttttttttttttccttgacacagagtctcgctctgttgcccgggctggagtgtggtggcttgatcctggttcaacctctgcctcccaggttcaaggagtctcgtgcctcagcctcctaagtacctgggattacaggtatgcaccaccatgcccagataattttgtatttttagtagagacagggtttcaccatgttgcccaggctggcctcaaactcctggcctccagtgatctgcctgtctcagcctcccaaagtgctgggattacaggtgtgagccaccacacccagctctgaatttttttatattctcttcaatacctagtagaaagagccttggatattgtagctgcaaaatttattatttaaaaaaaaagtgtgtaaaggcccccaagccctggcctatacttaatagagtaaaaacccgagattcaaagactttcaggaaaaacaacaagaaccaaaactggcttgtgggtctttttaaggtaaaattaagctatatgaaactagaatcttgacatattttctcacacaaaatttcaacatgggaatgtaatagatgaatgggttagtattctttcaaatgaaggctctatgtatatttaaagaattcactccctcatggagaaagcaaacatttctggatgaaagtaggtccagtgtggtttgtaacatgcttttaagtgttattttagtacattgtttcagatttggtttaataattaaccacgttcttttccctgtgtttttacattgtgtcccttccagaaattgacttctgtggaaaaattacatttgaatgttcacttgagttaaagctttaaagcaaatattacgactcaagattataattagaggctttagaactaccagtcatcgaagacatggctcagtggaatccaagcttattgttattagggagcggagatgaagtataggagcttgtatcaccttttgcttcaggaacatgacagtgccactctgataactctgtgaaatgctggtcatcacatgtgttaggcttcatgccatttgtgtcgttaaggcttgtcagcactatgtgctgcaaagtgtgagggactgctccagccaggctcattcattttaatatgtcttgtcaacttcccaagaatatcctaatgtactaaaacaaatattttcttgtggaatagagcctcctcaattacaccaaaatccagccatacaattcagaacttttgtttctagaatatgataaatgaaaacagagaattaaattttgcatgctaatatgcatacttgcaataaagaaggaaaaattacctgaatggtgtattgtgtttcagagaatagatttaacattcctttaatgatagcatttaaaaatgattgttgagtagctactacttgtgagtgtgtggaagtacaatggtgcaaaacagacttagtccctgcccttttggaattcatagtttggtggggtaaaaaatagatgcctaactctaaactgtgattatttatataaggggtgcttaacttcagccctattgacattttgggccggatcattctttgctgtgggagctgttctgggcattgctgggtgtttagcagcgtccccggcctctaaccactaggtgccaacagcaacctcttccccagttgtgacaatcaaaaatatctccagatgttgtcacataatctcaggaaaggagcaaattcacccctggtggagaggtgccctgatttatatgaaggaaaattacaagaaattttgcgaatacacaacaaggaaaactaggcctaaattggcaaagctttcagagaagtggcatggtgatgtttgtattaaactctgatgaggggttaacaggactaaaagggctggaggaagcaggagaggaggagggaaaatgagaaaaggaacaagctagtttagatttcctgctgaaggctggttccttgtacatgttagtacgggaaatcccttgaaagcagggcagtgttagggtcctgttcagacccctgctttcactggaggcctaggtacacaggggaactcaaggaatttttattgaaggcataatgtatattccctctaacaggcacagtgatgagctctagagatataaaattaccaagccatgttctctggtatctgtgagctcacaatctatttagaacaaataagggatctagagaaagcctgctctgaagagatgacatttgaagaatagtgaaggatgggcaggtgccaggtggctatggctttccccagctgctccaagcagagttgggggatttctcctcgatgcttattttgtggtttgttagtgcttctgtcatcgtccttacagctctgggcacaactagatctaaatgatcaagtattggaattcacaaacaaatctctttcctttctccctttctcccctagcctcctcctcacactcctgctctccagccctctcaggctctccctccctctcaccctcattcccaggcaggcaggcttctccccagggagcccttacacaatcccagctccaagactagcagaaggagattttcttcctttgtaaaatttccaacaaagggcctcaagtcgagtcctgctatgtctgagggaatgactccccgactctgaaccagtcactacacccaggggatccagtgttctgattgactagaactaggtctctgcaaccccttcttcaaatctgcagggaaaatcagctccactcaaatggcatggggctgacttggggaaagacgtatcctcagataaatccagatactattagaagaaaagggagaaatggatgctaattagacaagaatattactcgtccactacagtaacttactcaccctccccaactacactgtgagaactgctacagtcagctttgacacttgtcagacatatacttgacacatggaaaatattcaatacatactgtggatatttgctgaattaatgagtgaatgagaaagtgaactgatattttcactttgttttgtgtactgagctctgatgaaatgaagaagaatcagggaaatcaattaggagtctgtttggtagtcctgccagagatttggtagacttggttgttgtgttgaatttcaggattgcagtctccttagcagtacagaaacatcttaaggataggcaccggaatctaccacaaagaaatcatctgatgaagagccaatagtaatatagtatttgtaaagtgagtgtgagctaccttgactgatgagaaagaacatctaagtattcttcatcaaaggaatgagtacagctgtcataatgctttgtagggcagatgatggcccagcagccagtggcaggttaagcaagagcctaatctgtaagcacctgtggttagaaaatgggaaggcacagtgtacaatgacatttggagcttaatgtccatggaaatgaattacttggaccatgcagggatggtcagagagcatgagagcatgaatcctggcaaaatagcatcagtgccaagttctcgtttgtcctgactcagagccctttcttcttgacacctgcagagtcatttctacagaaagaagcaggactgtttctcatcaggattctatgctcgtgtccagaactgtgaaatgaggagtggtgacgctgactatacctccttttaattgagacagtaaggccttctcaccttccccagcttactggggatgggaacagaacataagacaccagcagaaagagaagccaagagaaagtaaggacagagcacatttatcagggcaaactaagcaaatgctttcagaatataggttatccagatactcctagctatgggtggtttatattcaagacatttaagaaatgtttcctcagttttctctagagaaatactatactatttgttgtgcacacgtagtatttatattcagaagataatatgtactttagttataaatatattgatttttaattgaacttttgtttgactcttttagcatttggttttaaaagtaaatatacttttttttttttggagatggggtcttactctgtctcccaggctggagtgcagtggtgcggtctcagctcactgcaacctctgcttcccatgctcaagcaattcacccacctcagcctcccaagtagctgggagcacaggtgcacgccactatagctagccaattgtttttgtttgttttttgtatttttgatagagatgggggtttcaccaagttgcccagactggtccccaactcctgagctcagttgatctgcccacgtcggcctcccaaagtgaaagataaataaactgttttgtgtttttgagactgataagcttgttcttccctctgcctagagaatctcccctccagaagtgggctggttccttcttctcatttaagtgtcagcccatgtcacatccacagagagtcattctctttctgatagtgcttcctctctcccactctggaactctcagtacccgaaattcttagtaggtataaaataaatattttattaaatgctacatgggagacacttgcaaatgtctctatatactctttattctatttatatttttatcaaacttctcatctaaggaatagcaaccccttacatttgctagactatcttaaaattattcctttttggaagctccatttaaaatttacgtttgcataatttttccacctcagtgatgtttctcattaaactcttaacactttaaaactgcttatgttggctcaaatttcaagggtaattccatcattttgaatttcttcattttatacctactgtcagaaagcaattacaataaaaaatcacttatactcactatggtttttcatataatagtataaatgactgtatttcaatataaatgtgtaaattttattactttattgagtccctttaaaaattgatgtaacttaaagcactgtaaattctcagaaaaatgtgttataagatctactggtcatctattcatatgggaaagtacgtatgtgaaaatatgtctgtatgcaagtaggatgcataacccagatcaaggagtcagttcagtttggggaaaacataatgtataccatccataatggaagcaagacaataatgtaaatgataagatgcgagttacattggttaagaacaaaatgaagctattataatatatgcaacttaaataacatggcagcccatctggtcacttgaagacctttctccaaatctgtccccagattcataagtataaggtcatgacagataataacatatgtctcttccttcctgagacctttctgccttgtgttttaaataaagaatgacattacaagcttaccacctacaccaaacctatttaaaaaaaaaaaaaggaactgaaatacatgatctaaaagtaaagtatagtcttgccttgattttcatttgcatttgacgttttaaaacatggcaaaacccagtaatgaatttttactttgagccatttctaaatgttttgctggaaattagctgtaaatattacagtctctggaacaagttaaattggaaatgttgctcgtgctaaatgaaataattaactatgaatgaaaatcctgatagaaaaatgtacttttcacacatcttttacagatgtgctacactgcatgggaaatttcacatggagaaagtcaaataaccactgtctttccttagagatatatttaaaaggggtaagaggtatgaaaatgaatgtatatgctattatccatcagcctagtacttgctgcagaggataatttcaattctttgctgtatgtacttagcctaaatgattgttttacatgctttatttctctaatgcattcagagagaatcaataaattatatttattattcagaggcaagagacattttgtaatctatccaatcatgaatttctaatgtatctattttactttaaaatgttactttacttctaatttttttctctctttagggattaatcacaatcatagcaacctattacacattttgacgtgaaattgtaaatcatcttgttacatatttttgcactttccaaaataagacattttgtttaattattcaaaccaaattaatggtgctgatctctgtgcaacataatctagacctttgagagggcaaacatgcatatggaaacagaggaaccaattgaaataatgcattttcttacaaggtttttaaatattcaaaatcagaggaatgtttaacttctatcttattgtagaaatctgtttaggtgggaaagatactgactcctagaggataaaattgtatttccatcatctagcacagtgcgttgcaccctgaaattactgaataaatatatgaacaaatgaatgaattaattataaaggagctgtgtttcaaaaaatgcttccctgcaataataataatagtgtagctgaagattggttttattgaaggaaaccaaaagataataaatttaaaagaaaaaattcatatattcctataaaatgttatgtggagctacgaccagctaaaatgtcctatggtcattttaagtagttgtttgagtacattgatcaaattgaaaccaaagagacatcaaaaaccaaataggaaatgtctttaatcctgaaaataaatatggtccacttgcacttgaaatgcccagtgcttccagcagctgagcctacagaagaaatgaggaagtgactcaggttctgagaagaaacagaaagagggaagggatgactggtatgtgagccccagttaggaaacttggggcttccaggaggaaaactagaccataaatctgagggtgatgtgagccaagtttagaaaaattataaattccatgaacttgaccatccttgtaagactgaaatgttcaagtatatattgtttcccatttagttggaactcatcataccaagagatgatacagactgatcaactttaagtaggcccaatcccagttagcagctatgtgacaatgggcaagctacttaacgtctctgtgcttctgtttcatttcctgaatactgcagataagaatgccttatcaagttattgtgaagtttaaatgaattaatacttataaagtgcttatgacactactttgattaaagatttatgaaataaagttcattgaagataaattattaagaaaagcagagagacttaggctatatctctaaatgttatgcctctccatgaaaatatttcttgtaactacttctagaaacagaaaacttttggcaaggctattagtctggttcattcattcattcattcggcagttacctactgagcatctactgttcatcaggaagtattctagatactgaggatatagtaataaaaataaactaaaatcatgctcaatgtcctcatggaattcataatatagagggggagacagctaagtaaacagtaattctgtatagtaaatcttgtagtaaacaacatatggggtgccgcaggagctcaaactagcacatcaaccctttcactgcatgaatagtaggtggaaataggaacagatcatgtgaaacatcccgaaagaggggatgactgggttgagactagaaggatgagtatgagtaaggcaggtatagggaaaatgaagagtattttagagacagagaattccagatcattgaagttagatggcaagggggaaatgaaactaaaaaagtaggcagggaccaggtaacagagaaaaccatgtgccatgttgtctggaccttaagatcaattggaaacagtattcagttgcctggcatgcttgctctttagcctctcacattgtatatatattttttggttttaatgggtacatagtatgtattcatggggtatatgagatgttttaatacaggtatatcatgtataataattacattagggtaaatggggtatccagcatctcaattatctttttttgtgttgcaaacaatccaaatatatttccttatttttaaatgcacaataaattattgttgactgtagccaccctgttgtgctatcaaatactagatcttattagatcttattcattctatctatatttttgtacccattacccatccccacttcctctccctcctccatcacattgtatttgtttggaatttatttggggcaaaagtgacttgtagcataactcaagggttctgcttagaaattaattgtattataggttaatcaaagtggaatcagtacagtgatttcttggatatgacaccaaaagcacagccaccagaagaaaaaaaaggataaactggacttctccaaattaaaaccttttgtacatcaaagtacattattgacagaatgaaaaggcaacccatggaatgggagaaaatatttgcagatcatatatctgacaaagaatatccaaaatatataaagaattttacaactcaacagcaaaagcaaaaacaaacaacctaactcaaagatgggcaaaggactggaaaagacctttgtcgaaagaagatacacaaatgggccataagcacaagaaaagatactcagcaatactagacattagggagatgcaaatcaaaaccatagtaagatagcactttatatccattaggatggctattaaaaaacagaaaatagcaagtattagcaggaatgtggagaaactgtaacccttttgcattactagagggaatataaaatagtgtagctgctgtggaaaacagtttggggattcctcaaaaacttaaacatagaattaacatatgatccacaattccacgcctacatatataccccaaagaattgaaagcagggactcaaacagatacttgtacctcactgttcagagcagcattattcacaatagccaaaaggtggacacgagccaaatgtccatcaacagatgaataaacaaaatgtatacatacaagggaatattattcagcaataaaaggtaatgcagtttgatacatcttgaaatgtggatacacttggaagacattatgctaagtgaaaaggccagatacaaaaggacacacattatgtcactgccctatgtgagttgcctagaataggcaaattcatagagacagaaagtagaatagaggttaccaggaactgtggggggacaatgggaagttattgtttaattagtacaaagtttcagtttgggatgataaaaaaaagttctgaagataataggggtgatgggtgcacaacactgtgaatgtacttaatgttgttgaactgtatacttaaaaattgttaaaatgaacaatttgtgttatgtctattttaccataatataaaaaatgtaaatgaaatcgctctgctttgcaatttataaaatgcttttccaaaaatatgttaaaacttttctaaatacagtaatttctgaaaacttaatttattcattatcttttgcctctgggatttggaagagtctaaacctgagtgaattagggaagtttgggcaggaaaagtgaatcatcatgctgcagcctccagtcttcaaaagaatttctacaaccaacccttaatttatgatgaggaagaagcagcttatgcaccactcttccccctcctcccctggccattaaaagtctgggggggaggggttgggggggtgaggggtgggaagagtgtcataagaagagaaagagagcgagagggagaaaaggaaggaaggaaggcaggaaggagaaataaagaaaaagaaaaaaaagaaaaagaaagagaaagaatgcactgatcagcagctttgtaaaggcacagtatcctcagagagctattacctggagtgtaaaatcaatcccaccagcttcttagccatgtttattgttctttgaacatctcttattgttaacatcagcctgataatgaagtagaatgtccagaaggtgagagtggaagctttcccatggttctaaagcagcctactcaggaatgtgaatcaaaggaaaatcaattcattgctccactcatggctgaaaattatattgtccttttgggtacagggaatcaaaggtcctggatggtggcattgcatccatgtgtcttcataactaacattgaacctaattttgagagctccctcagcagatcattggcagaaatcatcaaaatacctttaggccctagctagtcactcttgagaggaattgaatgactcattttaatctaagactgccagggtaccgttacttgcacatattcatattcttcaggatgtgtggagcacacaatttgtgaagtcatgaactgagtttgaatctctgctccactactttctacctatgtaaacttgagcaggtagcttaatgcctctgagctttgatctccatatattatctgtattatatggatgatagcgactcatcaaatgaagtaatggatgtaaagtctcactgaaattatgaaatgttttctaaagaagagttgttgctactagaggtttttaagaggcagtaagttcaaccccaaaggatcaattacttttacttcccctttaacaattaaaaacaatataatagtaactggtattttaaaatcttaccctttttaaccctctgtacatgcagaatttcctttggatgttgctctttcactggacaataaaattagatggataatatctagtcatctgttttttgcaaccacttttagaaggtttttgcttcataattgccctcaaatctttttatttcctccttttggttttcttgcacaaagcagataaaaattaaaaagtttaataaattggccattgtgtaaccctcattgattttatttccatgttcatgtatggcccttttttcttttacttctggcacatggcaacactggaaccttactgctctaatttttgaagtgggcctttagtgcaaattttgtgggctgctatttttgtcaaaggtgccactaagaggaaagaaaatagtccctaagtgtggttgatttgtggagggcaaggaaatctacccgtaatggctctctttccttatgttcattttttctactctagaatactcattaggccctatggtctagtacctggttctcatgggtcattttaaaattatgaattatgaacataatgtgcccatccaaaagtaccttttataggctttgtactctgttttaaaagagaaatagcactcatattttagtgctgcttgctgctcaccctatggatcccaaactatttctctattcacagggtttactttgactttaatgtatatgttctagtttatcttattttgtcttatcttgatcttcattccttgggttctttctttcatttttaattgcacaaagaagacctcaaacaactgtaacaacaacaacaaagcttgaaggaaacgttgtttacacttttatctgagtatttgcttcggttcatatctgcctgaacatccttttttgaaacagaataatacgagttcgaatttctcagtattcaaaacctacgataaataaatatattctttatttatcctaccaagatgacgtgatagctactgaacatctcattttttgtttttactatagatgatgatggtgcttgccttttttcagcagtctccatccaataagctttaattcctaattgttttacaagtatgaagtgaaggaaagttcattcacaacatgcattagtggatattgataaataaacatttcattatgcacatgtattaataaaatgtctttcaatgttaatctttttatatttactagactttgttggcaaagaaagttgcaaaagatattttaagtatattcagtaatatatatgcaatatgtttttggaaaattcagaaattatgacatcctaatcaatcatgctttatttttacttttttttaatagatagattcaaagcaggtagtttctagtacagccttatgattcaaagctcaaaacatatgagaagatatatggtgaaaagattcactctcctccatatcccccaccagccagtttctacttcgtacacaaaatgaaaaccacttttattggtttcttagaattcttccagatgttctttatgcaaatagaagcaactataaatttatattcgtaattttctgtttttaaaacaaaatatagcatatgcacactgctctgcacttcgctgcttccactgaaaatatatcttggagatctttgcatgttggcacaacaggtgcctgtcactacacctactgatttcttgttgttgtactactctatttagccaattctttatttagaaacatttgagttgtttccagtctgtttgaagttttgagctatttcaaatattgtgttattatgaaattgctataacgaatatatttattatgtacatgggaagacatatctgtaagataaatcacagtagtagaattctgggtcaaatggtatatgcatgtataatgttgataaatactgccaagttgtcctctttaaaggttatatcagatcatattcccacctgaaatgtatgagagtaagtttccccacagcctgaaaagcatgtatgttgatcaacttgcaagtttttgctaatctaagaagtgaaaaagattatatttcctgtggctttaatatgcatttcttatgagtgaagttgaacatcttttctttcatgagccagtagtatttctttttctgtgaatttctgttaataacataagcccattttataatgttttttggttatgatgtgttaaaatcaagaataagttaatatcccagatttggaatatcttaaaaactgagctctaatcaaagccagtctctctgtggccagactcttggaatatgtccactgtgggtagtaaagtgggatattcagatcatccctggaacttccactttctttggaaagtggttctaattaatattgagagaaataaagagagaatgtgatgaagcattcatattgctaaattagttcatgtggtgattcaagttcgctgatatcattagctttgattaaacatcattcttgtaaaaacaattaagaactaaagcctattagatggataatgtcactaaagaagactaataagaccaccattgcagtaacttgcaagcatctttttttttttttttttttttcttgttggctgtgtggaggaaacaggcagacctgagatggattctttttgaataattaaagcaaagttgtctcttggtcccaacacagaggttattttctgaaatggaaagggacctacagttataactctcttcacctcccccatctacacacgtgcagacacacacacacacacacacacacacacacacacacacacaaaacgtctgttgcttgtcaagttgctccctaactcttagggaaacaacctttgtttcctttctcctgtgccttccctctcaggaacagatagacctttcagagcatgcatctgcacgcccgaggcccttgtgatttattctagtagatgggtattttgatttggtttccgttcacatctggaagatgcatgtcaggatttggctgtggtcacagcaggtggtccttgttctgggctaagccacagtcactgtgaatctcaaacagctacttggttttccctgaggaacagagaggcagtgctcagagaagatgaaggaggtcccatcagttatcagttggttttgcttaggttggctttaaagttctgagactgagaaggttctgtccctccctcaccttttgtatacttagtttttgctggcttttggaggctaagatctccccatcccccaccatcctctccccacactgcttgcttgcagctggatggaggtaaaaaacaaaaacaaagagatacataaggcctgtcatgagtgttgagggccacttgaccaggtctccccttcaaaagcctcaaacttagactgttaccattatttgcatgcacatgtcacagagactcacagaagtatgaggagtacaattgtataatatgtgttcctgcagtagatcacagaggctctagtgcactaagactaagcattttttaaacagcctataattataaaatactgtttttggggttaacatgttaatttgttaaatacaaatgttttagttattttgtcattttagtaacaccatttcagtatttttttatttaaaaaaaagaataccaagaatcccaaaaatttattgtggcccaggcctctcttgattttcaggaatgccctaggtactcaagggggctgcattatgtacatcattatatcccttagttaaagccattcagataataagacacagctatacagattctctggaagtgatatttagggatgtttatgaagagaaactgtaagcatcagttaaaactttcctgaatatatttttaagagatatgtatcatttaattgtccccaaaaaggccttctacgtttgaatgcaggcatcgtggttaattcaaagtttgccatttaaggccagatgcagtggctcatgcctgtaatcccagcactttgggaggctgaggcgggtggatcacctgaggtaaggagttcgagaccaacctggccaacatggtgaaaccctgcctctactaaaaatacaaaaattagctgggcatgatggtggatacctgtaatcccagctactcgggaggctgaggcaggagaatcgcttgaacccaggaggcgaaagttgcaatgaactgagatcacaccactgcatactccagtgtgggtgacaagagtgaaactccgtttcaaaaattaaaaataaaatttttttaaaagtttgccatttattaggaacactagtgtattcatttaaggtagatgaaatttatgattcaaagtcctatttttacttgctatgtagagtggatatacactttggtgctgaaatggagttactttgtactgtataatcagtgagttctaacagccacccaggtataatatacgataaggagcagccagctctacttgaagctgcagtggggatctggtcagcctgactccacctctctcttgctttgtgaactgctagtggctcccctcctctgagcgtcagaacattgtaaaaaagagggttgcactataacttctaagacccttcccagtccttgaactctatgacaaaaaacatgattttattatttaaattactataaaggatcttacttgtttggcttattttataggatttctgtacatcattatatgtgtatgcaggttagaaatgcattcaaaatattcagccaatacttactgaatatcaactatgtgccaagacacatagacaatatacaagactcctgctcttatggagtttatactctagtaagggagacagacattaaacaggtaaatacatagacatttcagatagttctaagtgttgagaagaaaataagttaatggataggaacttgggaaaggagaagcagcttggaaaaggatgatcaaggttaagagataacatttaagtaagattagaataattgagaagaggctggtcatgccaaggcataagggaataatattccaggcagaaggagtagcaaggtttagtcaaagttctaaggtgagaatgagcttgacacgttgaaggagtgggaggaaagcagtgaatgaagaggagaaagatacaagacaaggtgaagatgatgggttggggtcggattacagacggccttgtagaccatggtcaggtatctggatattattctaagtataatggaagcccctggggaactttaagctgggaagtactgtgattttctttaatttttaaaaggtaacttcagcagtcatgcatgcatagtagatagataagtttcaggggttgtctcgaatggtgcaggcaagaggtgatggtggcatcgaccagggtggtaacagtgtaagtggtgagaaggaatggatttgcaatacattctaaggaagagcatacagaacttgcatatgggcttagggcagaatgtaagggcaagagaggatccagatgtttttggtgtgattatctgatgagatgaggatgctatggtgtgggggagggctgttgggaaatcaatagttctgtttgggacatgttaagattaaaatgccttttagatgttcaagcagagatgccagatagacggctgtatgtcctgagtctggagttcagtggggaggtcatggctgcagatataaacatgagagcttttagcatttaaaggcatggaagtagatgtgatagcaaggaaagaaggggcataaataaaagaagggggctgaatcctagggcatatacttatttataggtctgaaaaaggaagaggagaaagggaaggaggcaccaacagaggttgagaaggtgtggtcagtgaggcaggtgggaagccagaaccacatggtgtattcaaagccaagtggaagattcctgtaatactgctgaaatgtcaagaatgaaaagatcagtgaatgctttaaaatagcattaatgctgatgtgtcttcaaacatgatttccaagtggaccttctgaccagaagtggatggtacctaatactgtgttttaagtgttttaaactccaggatgcaaaagcattttatttcatccttgcacagaagaaacctaagtcgaataaaaagtgactgcaccctaatagtgattcagggaaagaacaaatcgatttgccctggccagctctccaaacagaactctcttcctagctgggagatgatttgtaatacccaagagtaatcatcttttgccgtatttcactttttaaataaaattttaaagacagaaatcggaaagttcttttttttcatagttgttgccaaactggataatgatactaccctgtcctttgtcatcatttatcatgtaaagcaaggataccagtgcttacttattatgtaaagattgtagatgccttgtttttcaattgtttctcattttatttaattaaaattctgaactgaactgtaacatacaggaacctttctatgcctagacagaaagtacatctcagatttggggtgcagacaaaatgacatcattggaggtacttaatggaataaatacaagccagatttgtgcagttagtggtaattatgcataaaggatcaggtgagcaaatcttccccctcattctaacttaaacctttataaggagcattagttctagggccactagggccctattaaagtggtaatttaataaatgatatcctcgtgctatgaaagaattggcatgtgcccacctgatgtgtctggtttaggggactaagttatgcctctgggaggatttaccatattatattttaaagataagttttatacttaataggtttcttgtgtatttaggggattatttaactatgcttttaaggagccatttttagccctgcagaactcagctctaattaattcaaatcattacatgtgaacagcagtgttctgattctctgttgtttggatgctgtctttccccggtaattgaatagaaacatatgaagaagaacattcttttaaaaatcttcatttgcatgagttttttctacaaaattttgtttgatcgattaatgtttatcaaattccctaggggtccatggaatcgcaccaggccaaagtggcatggagaagatcatacagtggtatgctgcataacaaggtttctgtcagcaacaaattgcttatatgatggtggctccataagattatagtgtcatatttgtaccttttctatatttagatatttaaattttttttatttttgttttgtggtttgtttgttttgaacagggtctcactctgtcactgaggctggagtgcagtggcagtcatgactcactgcagcctcaacctcccaggctcaagtgatcctcccaccacagcttcccaagtagctgagactacaggcacttgaaaaactttttaaactcagggtccccctatgttacccaggcttgtctggaactcctgggctcaagcattcctcccacctaggcctcccaaagtgctggaattacacacagaaccactgaacccagcctagatatgagatacacagatactattgtgttacagttgcctacagtattctgcacagtcacatgctgtataggtttatagcctaggagcaataggctgtaatatatagcctaggtgtgtagtagaccataccatctgggattgtgtaagtacactctgatgtttgcacaaggaagaaatcacctaatgatacacttctcagaaagtatcttcatcactaagcaacacatggctgtgttttttcagcctatgctgtagaccaaggtcattatatgcattatattggttaatttgcacaagtttgaaaaaaatatattagtattcctatttgagagatgaaaaaaattgaagcttagagatttatgtaacttgaccaaaataaatggaggaaccaagtttcaaatattttatgatataaaacctgtctgcttccacttgccatgttctctctctacaaaaagaactctcattcttatgttcaaactgtttgcagcaagactagcttgagataagcctagaaacattaggcattgtgtgaatgttgtgtaatacatatatgcactctgttgtataaaccgtagaagaaaaataaagaattgccttctctcacatttccaaccagcttatctttgctgatggcagaaaagataaatgtggtaaatgtatgccttctttgtatttataaaatttataataggtttacataattcagtctaaatgagaagagatcatttagtggctatacatcaatctttaatttttatagacactagtcatagaacagctattcctcaaatgtttctgagggcttacagaatgagagttcagcctttgcattatatttcatcttaattatgcacaagtatgaaatgcaaaaaggaattcctaggatcaaaataataaaggtaaaggcaatgggaaaagatggtctaattatgcaagttgcttaaggctttctggtctttctccactaaatttaacatcttttttcaattaggtttgtagatatttgacaataatggcaaagctttctacttagtctaacaaaaagaattttttgacctagtagatttttagctaatgtctctcatacttggaaagaaaaaatgtcatttgaaatcatctcctagagggaagatgctgacaggagtggcatcagtggtacttacatatttcaggcttatgatctctgtttacataaatgtgatgatattcaggtaatgcacaaatgcttttacttattttgagcaatacatccctaattgttaaaaaagtaaacatctgacccttattgtattcataatagccattatgtgttatttattctatcacgataaatgtcaaatgttttttgttaagcttgtcttaagcaaaagagaagccaataaaggctatagttatacagtggagaaatgtgaaggcaggctgtgcttaaaatcagtacccaaatcattcagtagatctgcacacaaatgcataacctttctaagctatttctgtatgcagtggatgtatgaatagtacatattataaatggtattcattcccacctctgcaatgtctgttgggctgagcttgagttatcacttttgacccctgagataaactaatttttcacatagctattcttctgttcttttacaagctgtgaacctggcattgcatatgtttcatatttgtaggctgtctctaagctgaattacaatttctgtgaaagcatctctgaatgtcatatggcaatctcaaatgtagaaatccaaagtccatgaattatataaaggacaaatttagcatacattttctgaaatttcaaagtccctggtatagtacagaagctctgtactatcttggttcttaccattggctctaagttcctggtcattctaccacagggctccataagaagtcactgagatagagatggtggtttccgacttttgcccattgtattttgccctgcaggataggagaggagggatgtcttaagattgaggagtccttttggatctactgtttatatgtatacttgttcttgtcagtgcttataaatagatacatgtagatgtctacatctgttaaatatatatgaatataagtgtatgtgtgtatctatgtatctgtatatatgtgtatgtgtttatatatatatatgcgtgtgtgtatatatatgtatatattccttcctgattttctcataaggcattgatattcaactgatatagaaactttaaacaatgtttacacaaaaattctgactgatttgcgtatcaatattgtatttcataaaaattatgtttcaaaatataatggggttcagttaaggccttaggagtacacttctaaagctttgacttcttgatttttaaaataccttaaggcaaaatacatggctgatgagactgagtcagagaaaatttcagttatcataaatgaacctcctctaaggtattattactaatagaattcaatatagttttacatgattactttcatgattgaagtgtcccaaagcagattcaacaataaaattgacaaacagtgatggaaggaatggtttcttttattctagatgtttgtaaatgtcagtaactcatttactgcaaaattggaagagtcctgagtataatgctccaaaatcagttcaaaattaaacaatcacattttgtggaattgaattgcattttctttgtttatccaaattgaatctttgttcaggcaagatttatggaagaaagtagtgaagttgatgaggtagacataacccaaggagagttagacaagcaagtaatttgtgaggaaattatatgtctgaataatttgtcttagaagcaaatgaagataatttggtcatctttggactattaaatctaagcatctgggggttttaatttttattttccattgacaaattgagtcataatagaccatttaatgtcaatgaatttcttcataaaaactcaggtatgatagcccatagcttaaataaaaaaccaaaagtatgtcaagtgtctgcatcattattgtggtagaaagttaggtataggtttgagttgcatgaagattagtttataatggtcaggtcccagttttctctcctttccactaatgattgtgtgttgtgcaaaccccctctattgaagcagtgtggcgacattgggaaaaggatggtcttttgtttcaggcagacctaagttagaatcctgtctctgattcttattagcttttgatagccttagacagatttgtaactgagattcagttttacagagattcagttttagtatctgtgaaatttgaggtaataatacccatgattgtaaaagtaaatcccctactcaaaggagttcacagcatagcaataagcaggttgatgattttaaggtaggattataagtgctgtaaaaaaatatatatataatataataataataataataataataatttgtttcatgttactgtgggattcctactggtccttgtctatcactcagcttcctcatctattccagataaaggaatagagccaccacttcttgaactcagaccactctgggtactttatttacactgctttgttcaatcctcacagcaatcctatgtggtcgttactatttccattttataggtgacgaaactgaacctgtccgaggtcacacagctagtaagtggtagagctatgcagtacagtaaaactctagtgagttgaaaatggtgttgatgttgtccatacaaaaactatgtctgggctgggcatggtggcttatgcctgaaatcccagcactttgggaggttgaggctggctgatcactgaggtcaggagttcgagaacagcctggccaacgtggtgaaaccccatctctactaaaaatataaaaattagccagtcatggtggtatgcacctgtagtcccagctactcagtaggctgaggcagcagaatctcttgaacctgggaggtggaggttgcagtgagtcaagatcacaccactgcactccagcctgggtgacagagcaagactgttgaaaacaaacaaacaaacaaaaaacctctctctggtctaacacttttgtgaggttttgtgtttataatcactatctcactgtaaaaccagagagtatccaaactacagctttgaataacaaaaagcacagactccctggattctgacagccgtgataaatcctactttaattgtgcattaaaaacacatgtcatctgtttgataagcagtcatctgctattgcctgatccagcaatgaattaataaagcaaaatatgtgacaattcaagtcatgtgtatgaaatatgttattcccaaggcatccaaatgtgatttctgcccctgcctccctccccacctgctgcccacatgagacaagaaggtgttggttctaagatggtgtataatgacactggcctgctcttaggacttgagcttaaatttgggaattttcaaaactaaagtctataaaaaagtgagttctgagataggtcctgaaatgatccaaggccaggagggatgacagtcttggaaataatggctagtgggttaatcaccttggtttcaaaagttcctcagaaaattcttaagtctagcaaaaaattcatgcctgtctacccagtgactctgctgcatgagctactcctgagtctgagaattgaggtggcagcacctctgccatggagcttggctctttgtagagatgagcctggagagccagagggtaaggaaaggcagactcagcgatctccttgccagctacacaagtcataccaccattttcttcattgtgttgctagatgtggcctggtccaagatttattccccactctggctacatgaacactcataaaaggtttgaaatattgtaagcagaaggccatgaacttgttgtctagaatactaaaggagaaaagagagtgtcccagtatttattcattttaaaatgataaaccatttataggaacaagttcataaatcctctatctgtagagaatggttggctcagagtgggagttagagaaataaattcagccagatttcatcttctaaaatgcttggagcttcttggctaaaatgcattcattcaagtgatttgtttatgtgctggaaagaatcttgcatcttatatcataaattaaaccaagaattcatgatgaagaagtgatgtctaaaaattgggtgaggtgatatattcttttctaaactgcaatttcagaagatcttcaaatgcagccccaagtccctatatcagtgacatttagtcatgcagaatatacacagtagtggctactatgtgaaggagtgcctttctttatacacacatgtgcgcgtgcacacacacacacactctctctctttctctctctctctctctctctccaagtaaggatgtgaatcaaattttggtaaacagtgtatcgtggtggctaagagagatacgtatgttaaagcttcatttttgcttgttgcttccagggtaaatttaggcacataatttcatctctataagcctctgtatccccatacttcaagttatgtaattgtacctgtgcaattacattgttgtgagtactgataatgtatgtgaggtaccaagcagagtgctaggcatgtaatatgcctgccctgccctaggctttaatataatagcagttccatttcagatttgccatgcaacctatttagatgaggacaaattctttcttaaaaccactactccttttgtaaaatggaattatctgttttgttattttacattttattgagttattgtgagaagagataagattatacatataaaggatttagactcatgttggcatctcatgaatgctctgtaagtattagctctaattatttataaagttattagtatcatttacattaaaaaggcttctggttgactgaagtacactcaaactgaactcagaatgaaataacagatctctaagaaattatttagattacttatagaggaaaccagtgggattgctgtttaatgaaagaggcatctaaaaatatatgattataattaaactctcatttttcttcgtgtaacttataccccttacatacaaccagggacatcaacctgaggtttacttttcctgccatcgactttgcactctgataagttctgacttaatccattttctccattaccacaaagtcccatcacctatttcactgttttaaaaattaatgaaaattgatgcctggaaaaatcttggtttcccttggcttattgggaacatcctttggaccattgtttctaaggccgttacacacttaagacacgagagagggagttgagagttgcacagtgattttcacacatctaggcaatcacacatagcccttgttcctcagtcaaatcaatgaccctgggaagaatcatctgtgctcttagctccaaaatgttactcaaggttataaatatatactatacattgtccccttgttattccaggatgctagatatagaggcattttcattttgtgtattggaaactgagtctaaacagtggtgataatacttttatttccattttatttagaaatttctcagcagtggtgactatctgatcaattatttatataatttgcctgcagttgacatgtatcaatttacactacacttgattaacagaaaaaaagaaggaaagatcatagtgagccactgaaccaggttttaaagttaccgaagttataaagttttatcctgtcaccgattgtcagagcaacaggtgagagcattaaaggctaatttctcaataatcaaacatacacaggaatgctccgccccacagatatatgtggatcattttcctagacatcagtgctcattcacacactggcacaagatttagacctcttcaaatgaagtcatcctgattgcattttgctgctgcttgttttcccatcagtcttgacttcattctagcagctatcatactgaaaatttctaaatatggaaacctttgcagtaatgtcatgtaaaagaaggactcttgagagccctgatttaacagaaagctccctctttttctctacggtttacattagaaatccaaaaacgttccaaacaaggggcaaaaaaagaagcaatttaagtagtcaagagatataattgtttaaatgattcagttttgaaactaatcattcttatttgtttaaaaatcactttcagtcttttccatgagaacattttaaacattctttcttgaattatctaaggaaaacctatgtactattttaaattttcccctaaatttactgcagtccaaattgtgaatatatatatatgtatatatatatataagtgacttctgaatttcatattcattagttaaaaaaaaatggagaaaccttaattactccaaatgtattattgatttctattaatcctaccactcagttgccattacatgaaatcaaacactggttcttatccctccaggaatactcggatatgttctagcaagtttatacctgttaatacatactttttcctgaagaatagtgtgctttttaaacaagaatttaaaatgtgattttaaatagccagtactcattactctgaggtaatccaaattttgcaccaaattgtcattctaaagctagtcacttattgaacctatgagagactgaaaatgtcagctgaggcaatccaaattttgcaccaaattgtcattctaaagctaagcatttattgaacctatgagagactgaaaatgtcagctggcataatctgatggctaaaccaaagctttaaagcacatagccctctcacaaagaaaaaatgtgaaagatatactgaatttaagattttaatgtttttaattgggatctgatatggtcatgaaaatgaactttatggaatacattccagcccttgacaaattttgattcttcggtgatgaggcaggtctgtgactgccattaacagactggttcagctgtccttgctggaaacaatattaggaagaagcataggagttatcatttgtgattcagacacattaggaataggaatgccagaggcagaaaatgtgcaatttcatgctcattaatttcagagaggatttacaaattaacctggctaaagatattactttcccaaaaggcctgcaggcatcactgagcagactagctagcacagaccacttccacaaggttgtccagatgctccggggccatcgcagttctgtttgtccctgtgtgcagatcagaggctgggttctgtgctggagcccttcctggttgcaggagaactgtgcagatgcaaggaagcaaatttgtatctgaggaggaagaatttaaggagacagtgccatggaagattcttccctcatgtccctgccatgaggcagaatataactttttattttcatttgacctttactagctaaggggtagtaattcaataccatttcctctctccaccttaaaatgtaaattgactaatagattattattacaatcagtcacttgctccagtgaatctgaccttagatagatctagttactcctataattcagccatttcaggattgttgagaggtttaaaatggatcaagggaagattgaattcactcaaaaccataccattacaacagtttcctttccatttgaagaaaccattccatgagcaatttgatcattgcaggcctggggatactcttggaatttgctgatatgactggcattctgccagctgctttgtaggctgcctctgatgcaaccaagtgagacattggaacaggtgtatcctcactacctgtgcagttgctgttggtcgtatcagttggagcagggctttccaaacatgaacgtgcatacaaataacctggagattttgctaaatgcagactctgattccctgggttggggtggaggctgagattctgcatttttgacagttcccaggtatgctcctgctgctcatccatggtccacattttgagaagcaagagttagataatagagcagtaggggaagaaatgatcttataacacaggcctaaaacaatgtgagctatattgttgccattctttttagcttcaatatttaatccctgaagtgtttatcagattatggttaattagaagacattctatcattgtgaagaaaccactctatatttgttcttaaaatgaaattgtgctctgtttgggtgtttttttttttccaaagttcaaaagtaaaagaaagccagatgtggtggttcatgcctataatccagcattatggaagactgaggtgggaggatcacttgaggccaggagtttttgagaccagcctgggcaacatagtgagacctagcctctataaaaaataattttaaaaaagtcaggcttggtggcatgcacctgcaatcccagctgctcagaggctgaggtgggaggagcacttgagctcaggagtttgaggctgcagtgagccacgatcatatcactgcattccaggcagggtgacagagtgagaccctatctcaaaaaaaaaaaaaaaaaaaaaaaaaaaagcaaaagatctggtccctttaggaatatagagcacatttgtgtctgaattatgaaacaatgaggaaacctgcagagtcaaggatagacattaatgccatgcagatgcaaaacaaataacaaaagggaggagggaaggtagaagggggaagtcatcttttcataggaaagagactatcacagggaagcacactgcctctgcttcttgccatcaagctcagatcattccctaatcttctggtgtaaacttagctgtatggaccactccatcagattagggaaggaaatgaaatgttgcagcctccacataccaaagctgtagagccaaagcctgtgtaggacttggcagccttctgactctaggagagatcatgaatgcactttttgcttggccctagaaaaatagggttatttggatcaggaattatgaacaatttaatttctttaaattatgcggggcccccgtgattgtagttacacatcattttagcaagaagagaaagatataattaagctctgttgtcaaaaagccttaacagttatccttcaggaaatcttgcttaaatttcaaagtgtgctgtcaaaccaccagggaagcaaatggaactggaaggctggtgtctatgggagagaagcaaccatgatatgttcatgctgactgggataaaatgttcacaggacccagttactgaaaagattatggctccccaccacacaaaactaccatgttatctgaaagcctaaaatggcttgtttcttgacttttctgattaaaaaaccatagataaattcctaatggtggatctccctttctcatcctgtgcttcacctccacctaaccctaagcccatgctcactcaccccgtcgggtaatccagtaccatgttctagtctcaaatgtaggtagtaatgattctgccatcaccactccactgaaggtgtcattatcttttgtgtatttttagtcttagtttgcacatagtaggtactaaattgtgtggcatttaattgaattcaagggacagattgtttcatccacagcggattttattttgttcattaatggaaaccagacttttctttcaagtttgtaaggacatgcatgaacactgtggcatgccctgcctgtctcctctctgctgggaaatggtcataatgtttaactgcaccaaatgccttattttttcctaatcaagatgttaagggggtctgctggcttagcaggtgcctcaattgtgcataattagttgctaggaattgtttagcataggacgattagtctcagccaaaggaaattaaattttctttcttcagcaaagctttgaacacagctagagattcctgaaaccatattcatatcgggtgcctctgcatagcccagagtgagaaatgagagtctcaggaaatggagaaacaggaaccagcctgatgacacaaggatgctgtttgataccaagcaaacgttggaggatttgagagcatgaggagacctgactcccttcctcacaatgtgattctcccagctccagcataggcagtttgtgatgcagagtgaagcattgctccttaggtgcccactggttgctttccaagtttataaacaccagcttcatgtgatcaaaacaaatgatctgtgtttgcccctccagtgtttggcacatgaggagactggccaaattggggggaatgagagggacagatggtccctcctattgttcttcttctgctttaagtgtatgcttgactaatgctttctgtgcctttgtcaccatgtcaattctccctgttaatggagggcatttttccctagcctcatgagatgtcactctaaagggacccatgttcttccttattgtgaccaacatgtaagcccctgtggagggccatcatgtgtgacggtgattacctagctgctaagatgtcgttagaaaaggctggcagtgctgataccctgagatgcccttaatgattgcttggagcattcatttcagcgagcagtagctcactagctgaatgtctgctttgccccgtagtgacttttagtgagaatcccttgttaatatgatcatcgaagtctgggctgagagtctgctatgaaaatcataattcttttgtttaaagacattattttaaaggttggtcaataaatcattctataatctgaatgaaaatggaaggaaatatatgtagataccatttttatagtcagatttttcacattaagtcaatacttaatagctattggatgataatgtgactttaaaaggaataggctatcaacctagaaaaagaaaagcagaagtaggagggaatatagctttataacaaatgtttcactttcttcaggttctttgattacaataaatgctctagtttgaaaaagtgaatataattaattcacatattttatcagcaaacatttagtgaatgcctacgatgtgctagggatggttctgattgatttctttccttgtcatttgaccttttttttgttcgtttatatatctggatgtaacttgaaagcctatttagtatctctccaatgaaacaaaggaaaattattaacatagatcttataattcagtgactcttttaaggctcatcctggggatcagtgagctatattgacattgcttttgaattttatcttcaaggaaatgaactgaaaagcataaattagttctgtagtaccatttgtaagtgttgtttgctttaggcaacaaatatgtggaggagggaagaatgggatttatatacacacgaaaataattggctctgtggctcaggctccttttcaaaggcttcactgtagcaattaacttacaccatacaaggtctctgctggtacagtgtgcccactcactcactcctgtgacacagcaacatgtggacccaatgacttatgaaatcttattgtctatctaaaaggaaataagataaagaagaaagaacatgggactaagaacataagaaatttcatctagactcaatttagatgtgtgcccttctataaatttatctttctgggccttagttccatttataatgaaagagtggtctagattatcccttataagcatgaaattctagggatatatctataaagctgcatttagagacgcaagagaagatagaagcctccatagttctccatgactttacgctcaagggtttgaaatgcaccctggacactcttgtcctttagtatcctactgtggagccatcagccacggattcattcagtgtgttttctccatttctattttcaaacaagtttgaatcaagagttgactttcagtaaatcacgtcaagagagctggtgtttattctgtgatgggtagctttttataaaaggccatggtgcctctaaggtatttaaaataaagagacactcttaaggaaagtctcttaaaaaccaagtgttacattgtgccatgctgctctgctgctatgccctccttaactctgatgatcaatgttgccaagcctctgcctcccttccattaggaattattgcttttacactgattggctttggcagtgagggtgaaagcaataacactgcttgggacaacattagataacactgaactttttcattctgatcctttaaccaatacaagatttggcttctagataattatttacttttgcctgtgctcagtaagttcactcttgatactgggagcaggagtggaggttgggggtggtgatggagaggctggccaggtggtcatctataattcagtttcaaccttttaaagatgtgctcaactagactatctcagttctaaatcaaggaagttgttttcaaatataaatgagaaaaccattttaccagggttcactacttctgaaatgcaaactgggtacatttctaaagaactagctccttaaaatagagcatcaagtgcagataaccccagagtctcctgggaaaatctcttattgccctttataaaaatccaacactggattcaattcaagactttaattggctggaatcttgacaaatagaaaactgaggaaatcttttaggcttccaagatgccgtacctaagcctggttgttgtgattattttctggctcagtgctctatgctcataaacacactgtttcaaggttttggacaatgaaaggaaatacatttttaaagcagtcttataaagaatcccaggttttaatacatagtacgtctgttttaaaaggtgctaaatgaagcatattgcctgtttattaacactgtgagaaaagcgctcaaatattcaagtgacaatggtgaggcaaagggagacttttatagtgtaatgtttacattttgtattttgttttgtggattttaattatactcaaaatggtgtttgcaaagagaagagtcgaagacctaagataccacttctaaagcaaaagcgatattgattgaattggtatctgaaagttggtagtttatctttatggttggaagaatataaaaaattgtgtgacaaattaaatataaacatgaaacagcgtgacttctattttttaagttaattgccacttacagcagtgttaatcttttccttttgtcattgcgtataaagaccttgttaattttatgaagaaatcatgaatcatttcaaaccagaagttcatcctagagaggaaatgagttcctcaattttgaaacacaagctatttagttgggagaattaatattctcagatgataaggccttgttctgaataaatccttgttatatgtaatagtttgtcatgcacagtatggtttctttaaattctttaacgatttcctgctattataaaatggtaacaacaacgatacatcttatagcgtggccagcagtgacatttagattatctagcttgactgaatatgctagataattattttacattctatttactcaagccatgtgcatcttattcttgaaatgtttaagggtgttattcacatttcttttactttttataaatgccaccatcccaattaggaagaattgtcctttcaattttaaccttaatatttgccatcctagattactactcctttattcctagtcagataaaatccttttcaaggttaaaaaaaaatcaccttacttagagctggatggacccattgtctccatgatcttgtcacctgctgttttagtcattcagcttcttacctaactctcacacatacattaagctttagaccttctgtcttctcagttgctcttttaataattctgcaagttattttcatctctttctaaaagagcacaaaccagctcattgcaatatatgtcttcttttgccaaaccatcgttccttccctattctcaacctagctcctctggtcttccctctgaacatctctatccctctgctttgcactggctgccagttcacactcccaggaggaacctactaactctgagtggctttatttcccttgcaatactaactctctgtcatctgcttatctgaaatattaccttcctttttactttctttgttcttctttctacctgattattcttagtgcccattgaaccattttatttcttctttgtcttcattacacctattcactggtatttatttatcaataaatgtaggtgacaaataatttgtatactatatttgcatacttcttaccgtttcataaatatcttcacgagcactatagcttttgatcctgacaaccctaagaagtagatgagaattttatctctcttttataggggaagaaacatattcacaacattttcaaagatttatcccacagctaacccaagtataggacccaggcctaccgacactttccactgtactgtaccacttctctctcgcagaaggattgcaatccgttaaaaatcttcactgcattagaaactggatggaaattaaccaaacgcttcattgtacctttgcagatgagagtccctacactaaatccgccagccagacaaagccgcctgatggagcgttggctgtgaggagacagagcatcccaggttagaccagactgttggatttttcagctgttttacttttgaatcctgttatttggtgattctaaataattccaacttggtaaaaataataataataataataaatcatgttatttcacagagcatagactgaattctacaacacttgttcaaacaatattcataaaagctagactttggaaaaccttgccaacttgtgagaattcatcttgtaatccatcattgtaaaatcctttgcaaaatgacttgaatttgtatcaactctactcatttacttactctcatctcattttcaggggatgactttcacaatagcatccatttctttactgagccatagctggcagaaataagggattcacaattgccgcaacagatcatgtatgctgaatgcaaaattattcttttcttctcatctctttgaacctgagtttgcttccattggacagctcttataaaatttgtgattttgtttccttaggaaagtgtgagtcatattattgtaatacaatgagtcatatatatgtctttccaacaaaacattttgaagaaatatctttaaatgtctttaccccaaaacgtcaatattttgaagctttgatttgtgaatgacacaaaaacatgtaagttctgaaattaaagaggaaaggaaattcaaaatgctattcaaacaatctgaactaaataattcatggaaaaattccttatggaagcaattgtacttagaagagttaaaagcattaatgcatttaaacgtttatgtaaaatgatgtattatatattttatacaagcaaattgagtacagctaaacctcagctacaggattttagagtacaatagttttagcaattcaggagaaacaaagtggtgtttcctacattaactggaatggtttggcaaatgtgtcagtgaaaggaagaattttccatttgaataaagagcaagatgaatcccatttgtgagtaactctcttcatgattattctttatttttataaaaatttcaggtggttattttcactcttattccaaaggctcagattcattttgaaagtataggacttatgaagacacatattatgaatatgttatacatccttgttttggtgctttgaagattctaaagcaatttgaattctacaattagatggcatcacccagtgccgagatgtcttctattttatcctataaaacatcattcttcatgctggtcgcatttagaaaaactattacagtcagctctggactgtgttatcctctttctccttgtcagcattaaagaaatatcccgtttgaagttcaagaatatcagttacccatcaattctttcttggctaccctacattcactggtactgagtattccactgctgggaagaagcaggagacttcccagtgtccttacaactctatgggatactaagcaaatatgctattatcaatgttttcttttcatgggttctctaatgccacattctaaatgacaacacatttgaaggccttcctttttcttaaagtcataaagtagttttttaagttacatgttaaatacacagaattggttcatcataatccctggtttgtggcacacattatttttcatcatgaattttgttttttccttctctttatgttagatttaaaagtcactggaatcattaactgttggtgagttttacgagatgttttcctggagcttgaccattgatagaaccctttttgttcatctctcttaaggtaggggccagagatattaggagtgttcagaattttcttagttatttagaacagttcaagaaaaaagattgcaccagccagagggctaagaaaccaaagtagttaacagtagattattacttaatagtattttagggagagaattaacaaacttcttggaaattgcctcctgactgactaatgactcatggagttctgatcccttactgtcttacttaaaagtacctatgaacttttgttctggcaaaaagaagagtattctcagatctttggccaagaagtaacttaaagagaggtgaaacccaacatccagaagtcttgagcaatcacctaccatgtccacttgtgcccccactaagtccatgagagagagaaaaatgcacagaggaaaaggccaagtaaatgtatcctctttattatttaccagagcttcaaatgaaaaatcctgaagtggtctcctgaccactcctggactaagctggaccatatagagctgtaagcaccagaattcaggagagtccaatcttttagcttccctgggccacattggaagaattgtcttgggccacacataaaatacactaacactaatgatagctgatgaactaaaaaaagtaataataaaaataaaaaagaatcacaaaaaaatctcataatgtttttaaaacatttacaaatttgtgttggggcacattcaaagccgtcctgggctgtattacagcctatgggttgtggattggacaagcttaatctagatgacatttacagtcttagtctccttctcctgtgctcactcccaatcctacttccctcaaggtatttttaacaccccggtagcatggaaagatgcctctagagaaaagtgcaccaatgaaaagaagccctaaaggagagtttggctaatgtactagtttctgaccttctccatgcagaggcccctcccaagtaagatgcagctccagggccattgacctgtcccagctgctggggagtaagcaaacacaaggaggctgaaatctttttttttttttttttttttttttgagacggagtcttgctctgtcacccaggctggagtacagtggcacgatctcggctcactgcaagctccacctcccgggttcacaccattctcctgcctcagcctccccagcagctgggactacaggcatccaccaccacacccagctaattttttgtatttttagtagagacggggtttcaccatgttgaccaggatggtctccatctcatgacctcgtgatccgcccacctcagcctcccaaagtgcagggattacaggtgtgagccaccgtgcccagccgaggctgaaatcttaacagagctatggcttttgcctatatctcccctaaagctccactcccagtggtccaaagttgatgactggatttgaccgttcatattagcactttctctgatgaatggggtggaatgcagtggaaaaagagtgtaaagtagcagaaggcaccttaagcttctctatctaagttttatgatattttaagctgttctttgaaacttattctataaatgtagatctggtgcttcctgaagttaacatttatatacatacacagaaataaggcttcttaatatagactctactatttccatgactaatacagagtaactttaaacatttctgtcctaaagaggtaaatctgaatgttaacagaatcataatttgtttttattcatgtcaaaatatatgactcctatctaaactcagaataactacagcagttattttataatcacaagccaaatatgtgtctttcattaaataccaattctaaccgtaaatccttttatcaccctcctttcctcttcctgaaaaaggaaatggattaaacactcttaggagcaaaatgcgtttgctttcgataaaggagaaatacattattcatgttatttgggaacttgtcattttaatcatgtctcatatggcattaaatgtaagaataaaaggattttttagttttccataaggtttaatgaaaattttaatatggatgatagtaaaaaatgacatgagtgtccctatgacaccaaagtttaagtttgtattagagacttaatatttgattaaaaatattagggagatgtattttcaatttcatttctccccattagttttcaaaaataagataaattccaaggacaaaggtattcagaactaacagattctaccatatatcaatgtttattaaaaagaatctattgattctcctgtatttgacagattactggtgaaatgaagtttgaccacttgaagggtttgtccaagtcattagagaaaatctgtacagactttgagtttggcatattttgcaataatttgtggtcttgcccacttagagatgaggcatttaataatgtctgtctcatttgtgaagggaagacaggatactacacttgacctcaaagcctagagttagtatattacttatttgacttgcctcctctttctatataggacatctttttttgcttatgtcactcttgattaattgcccaaagaattctggacaattgacaaatgcaggaagatgtcaaatattcatatctattacatttctaaactttgatgcacccagggaaattttcttaaatctgtatccagaataatgccatgaatgtttgtgtgggatttcttttcccctcctagactgtaagaaatgcttatcaatttggtcttaagggagtacagtttacatcagtctttgttgttgctcacatttaggtatttggaagtgggtagtaaaaatatgaagctgagaatctaaaatgtccagtagcccaagatgtatacagtcaagctgattagaatgcatccaggaaattcaacatctgttgaacaatcaaagtctggaaaataatccccataataccatacccttgacaccagggaggagctggtaaccttaagttaagaggctacaacaggaatttgaaggttctgccctctctgttccaaatgtttccagtcttttttattcatataattagatgcttcatttgtgtaattttttattattacagaagatatatagtgtgacttttacactaggactttacagctataccactgttcaggtgtgtaaatgcctggttctgcttcatctggttagttctactattgagactctccaaaaaaatgagtgacgccagaaacagtggcttacacctataatcccagaactttgggaggccaaggcgggcagatctcttcagcttgggagttacagcctgggcaacatggtgaaaccctgtctctacaaaaaatgcaaaaatcagctggggatggtggcatgcacgtgtggtcccagctactcaggacattgaggtaggaggattgcctgagcccaggaaatcaaggctgcagtgaatcttgattgcaccactgttctccagcctgggtgacagagtgagagcccctctcaaaaagtaaaaaataaaaataaacaaaaaaaatgagtgcatctcagggatgagaaaccaaagtcagttgaatcaagcaagtatgaaatgtcatacaaagtacacggttgctgcccaaagaaactaaggcaaaatctgctattaatgaggacatgatcaacatggggaaaataccaagggataagtacctttgcttctcagttgggctgtccctgtatcctcacaagctcccagtgggccaaagtgaggacaatgagaactaagggccgggtgtactctgccaaagccattcagtgtcagccttaagaaagaacctaaaattatgtttacgagtgttaaaattactgaatatttaagaaagtagctaaattacattgcttctttacagataagtttctatgattataaagtcaagactgatagcattgcaaatatacctgagattctgtccctctcccatgtcttgttttgttttccatagtagttatcgctatatgaaattaactgataaatttattatttttttatttctcagtccctagctaaaatgtaagctacaggagggcaggtcctctatatcttgttcacctgttatctccagtgcatagaacagtgcttagtaaatgttaggtattggatcaatacttgtggaatgaatgaataagcaaaagtcagcaggtagattttctctgtgaggaatctgtggccctaagactggcatactttcctacaaaaaaaagtgcaacaagttctctgttgaccacatgttttctgtctcattgtatgctgcagcagattctcacatttggccttgaagctccacccaacatgacatttccaacaaaatgcctgctgcccaagactaatgaatggaatataggtcagccagaagctagagactttgaaaagccagaggttccccccagcctcatttgtttctgtttgcccagaaaatgtctgtgcagtcctaaaacaccctaggaaaaagttgagcaccatttaataataaaattgacaagataagagtgattcattcacatgttctgcttgtagaaaagtgctaaaaaatatgaggaaaaaccctagtctataaatagagcaatgcagagccgaacatattacttattatggcaggtacgcattaattatctcctccagagaactgatccagtttgctatgtggctgggagtacatactgagtgctcctcaaatagcacaaggcaaaaccagcaccttgatttgtgtgttcagagccatagctttcattagtgatttggaggaatgacagtctattatgtttgaacttctttcatgccttagtaaacattggctgaaatacaataaagtggtgcatatgcagcaagtgatttttaaacaataattcttccagcatgcaatttaggggaaatttttttgtggtgactgtgctttgatatttcccgaatccccgtttgggtacccctttgtcacaggagaggtggcacttggtcaatgttgtgctccaggtacatgtggtatcggagtgactctgatgacagctagcaacagcctccagtgtcagaaaaattttagaggccgactgaggatatgtccataagagctataaggaaaaagtctcttccctctattacttttgcagtgaaaaaaaaattaattctctcattcctgggtttggctagaccttcaacctagggttgtaggtgacttcagaaaattaaattgggtaaaagatgtatggcttgattggcactgaggaaagtgaagaagcatcttacatagattactgttgaatagagaagttgggcctattaatactcttttcttatctattgaccttatattgactcagaacagcttcccaaatgtcagttactcacatgtcatcctcatgatttttgttatatatttgtgttccacctatactataattaatattattttaagtaagtttaaattggtatacttctttacttaggtttatcgtaggctttactctctgtaattttatatgctaatcatatttttctaatataaataaatgttttctaactctgaaaattaaaaacaaaggtttctatgtcaccttaaatcatcttgcatccatcaatatttatacacacctactttgggaaacactgacttggaatgagatgcttctcagaagacatgactttgacaaccacaaaacttcactttgtcagtagtcagtaagtagttgttgatttgtagtgcagaaacatgtcatttgaatgacagtgaaaggctttgggggcttcttttaacaaatgaaaagaaacgagaaaagagaaagaggaagttgaacaatattacgccaaagcttagggaataacaagaatgaaatgatcataggagtaacctaacctagagcgagagtaagagagagagagagacagacagacagagagagagagagagagagagagagagagagaaggtgggggaggggaataattatacaagtactagttaccatgtatttcatgctaagtaccaagtattggactagccatttttatgaatatcatctcatttcttcctcagaaacatcaccgggggaaaataagttttattaattcccctgttacacatgagcaaactgaagttcttttatttatttatttatttatttatttatttaatttttttttttgtaggagggggacacggtcttgctgtgtcacccaggctggagtgcaatgttgcaatctcagctcactgcaacctccacctcccaggttcaagcgattctcctgcctcagcctcccgagtagctgggattacagacgtacaccaccatgcccagctaatttttgtatttttagtagagatggggtttcattatgttggccaggctggtcttgaactcctgacctcatgatctacctgcctcggcctcccaaagtgctgggattacaagcgtaagccactgcaccccaccagcaaactgaagttctgagagctaaagtcgcttgtctaaaattacagggctagaaaacggtagaccttggataaaccccagttaaatataaattttgaccataatcctgagtagtgagggaagggaaaaggtggtgaagagaatccttacttagaatgaaatgtgaagactgacttctcaaggccagttgagcctctgctcagaagtatcaagaaagtgtgaggtgagcagaagcctctgaatgtgggtgatctctgtccatccaagtcacagactccatccatctcagtcctcattgactagagccctcaattagaggggggttaatgagtaatggcttggggtcacagggctcatgccattatctctctaagtaactgagtaccaggagaaaccgaggaggcgaactaccagggcttcgggttgtgttacagttcgttccatacacttatgcctttcagagctttccagtcaaggaaaaaaattaaaattggccaagaaggcttttaactacttattctgaaactggtaacaccataactatgctttatgtttcccctttaaaaccacagaataatgcaaagctgtaaaataacaccgagaaaatgaaacgagtcactgtgttctgtggcatcatagtcagtcttgactcactgactctgataatatctatatataaatatataaaatatataagtgatacacaaattcttttaaaatcaaatattcttatacatttctaaaacctattactgggctacacattaaacagatgttataaagatttccccttcaaaatgtgggtggaaatactttacagcacctggcaaagctctttgctctctttagcagtttgattgcacccctggaacccctctgccttctgcacggaatgtaaaccactgacacattgatcccttgcccttcacccgtgcacactcgctgcattctcctttttgctctggcccatcctttacttgctcgctacatccattataactaaaatgatctctcactttttgattctgagtgttcctctaaactgaccctcatacattcattcaacatgtaattatccaacagttactcgttgagcagtcactgtgtgccaggtactgttcctggtgctaggaatatagatgtgaatccagcctattagcctctgtcctcctggagctggcaggctagcagttgaaacaggcattcagcaaacattgaatgcctggcctaaggtcaggctatgctatgtacaataaagggaaatgaactagtgtaaacagtagagagtgtgggagcagaaagttatggggtccatgctcagatagaaaacctgaggcctccattgcctccaaaggccaaggttggcctccatgagctggtgactttggagtaagcctgaaatgagtggtgagagtggtgaaccacgtaatgatctggaggaagaggattctaggccaaaagaagagcaaatgcaaagtccctgaaggcagaaaaaccttggcttttaaataaacagagaaagaaacttctgctaataagtgaaaagaaacaagaaaagagagaggaggttgaacaatattatgccaaattgaatggctgagcatggccagaaactgggaagcaaggctgagggtgtaagggatgagtctggagaagagacaaggctgtgtcctgtagagcttttaggccatggtaagagtttggatattattctgagcagtataggaagccattgtaggggttaatgtattgatgtaatttcttttttgtttattttaatttctctaactgctatatggaaaatagactttaaggagacaaaagtggaaacaagaagaccagttagcaggctgccacagtatttgaggcaagaaatgatgatggcttagactaggaggtagaggtggaagtagtaaaatatggtcaaattttgaagaaagaacctaaataacctactgacaaattggatgtgggctgagagaggaaaagagaagtctgggataattccagggtttttgctcttaacaattgggtaaatactgatgccatttactgaaacagaaaataacccaggaagaaatggatcagtggaacaggggagtggggaactcagaggagagcttaggtggagatagaaattttgaagctctcagtttgtcaatggtagttacacccttgagggtgggcgacaggtcttctaggtggcacagatagattgagatgaggtccaaggtttgaaactggggcatactaagcctcagaggttggcagtgaaggaagattcagccaaagatatgaagaaacaaaagcagtgattatgaggatcaggagaatgtagtaccctggaatccaagttatgagccacatgtcactaaagagggagagaaaaactaggtcaaatattgatgatgagatgaatgagaattggccataagattctataagaagagaggtttggtgaccctgacaaaaatagattcggtgaaaaggtgggagtaaaagcctcatttgaatgggtggaggtgagaataggacttgagtaacaggcagagaatgtggacaactctaaacagagtttctctatcaaagggagcagaaaaatgggagagtggccagagggagcatgtggtctatggagaactttaaaatatatacataagagaggatgcagcatgttcgtgtgctgatgcggatgatatagtggaatgagagaaaatcgtgcaggaggaagaggggataaaagcaaaagcagtctttgaagaggcaggggtcagacacttctcaaaagaagacatttatgcagccaaaaaacacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatttttattgcggcattattcacaatagcaaagacttgcaaccaacccaaatgtccaacaatgatagactggattaagaaaatgtagcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggtgggaattgaacaatgagatcatatggacacaggaaggggaatatcacactctggggacggtggtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaaaaagaaggaaaaaaaagaagtatatctgaatatcataattgataaaataataaaataatcaaatataaaaaaacaaaagaggcaggggtgcatccagtgtgcaccaacgggtcagcgggagggaaggcagtgtggaagggcatagaggcaggagggtgctacagtccctgctgagaagatgtgtgagtcatcttctgattgctctatttccttagtgaaataagaggtgaggtcatccacagagagtatggaggggaaggagatgttcaaggcgcagagagagaggaggtatcatttcaaagactgggagagtggattacctaggacactgtcagagtattaccctgcagtgcagtatagcgctaactaatagacccctcttccttcttacaaaccctgcctcctcaaattaaaaagggacaaattaaacttacccttctaatgctgaggcccgtgacattcccatatagcatattccattccactgggttctctcctctaacttctcccttccataatcatttttataacacccagaatattttattttatttatttccccagctggcatgcaatggcgtgacctcagctcattgcaacctccgcctcccgggttcaagtgattctcctgcctcagcctcccgagtagctgggattacagagatgtgccaccacgcctggctaattttgtatttttttttattatactttaagttttagggtacatgtgcacaatgtgcaggttagttacatatgtatacatgtgccatgctggtgcgctgcacccactaactcgtcatctagcattaggtatatctcccaatgctatccctcccacctcccccaccccacaacagtccccagagtgtgatgttccccttcctgtgtccatgtgatctcattgttcaattcccacctatgagtgagaatatgcggtgtttggttttttgttcttgcgatagtttactgagaatgatgatttccagtttcatccatgtccctacaaaggacatgaactcatccttttttatggctgcatagtattccatggtatatatgtgccacattttcttaatccagtctatcattgttggacatttgggttggttgcaagtctttgctattgtgaataatgccgcaataaacatacgtgtgcatgtgtctttatagcagcatgatttatagtcctttgggtatatacccagtaatgggatggctggatcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattccaactggtgtgagatggtatatcactgtggttttgatttgcatttctctgatggccagtgatgatgagcattttttcatgtgttttttggctgcgtaaatgtcttcttttgagaggtgtctgttcacgtccttcgcccactttttgatggggttgtttgtttttttcttgtaaattggtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaacgcctaggttttcttctagggtttttatggttttaggtctaacgtttaagtctttaatccatcttgaattaatttttgtgtaaggtgtaaggaagggatccagtttcagctttctacatatggctagccagttttcccagcaccatttattaaatagggaatcctttcgccattgcttgtttttctcaggtttgtcaaagatcagatggttgtagatatgcggcgttatttctgagggctctgttctgttccattgatctatatctctgttttggtaccagtaccatgctgttttggttactgtagccttgtagtgtagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcctaggtattttactctctttgaagcaattgtgaatgggagttcactcatgatttggctctctgtttgtctgttattggtgtataagaatgcttgtgatttttgtacgttgattttgtatcctgagactttgctgaagttgcttatcagcttaaggagattttgggctgagacaatggggttttctagatatacaatcatgtcatctgcaaacagagacaatttgacttcctcttttcttaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgttggtttgtcatagatagctcttattattttgagatacgtcccatcaatacctaatttattgagtgtttttagcatgaagggttgttgaattttgtcaaaggccttttctgcatctattgagataatcatgtggtttttgtctttggttctgtttatatgctggattacatttattgatttgcatatattgaatcagccttgcatcccagggttgaagcccacttgatcatggtggataagctttttgatgtgctgctggattcagtttgccagtattttattgaggatttttgcatcaatgttcatcaaggatacgggtctaaaattctcttttttcgttgtgtctctgcctggctttggtatcaggatgatgctggcctcataaaatgagttagggaggattccctctttttctattgattggaatactttcagaaggaatagtaccagttcctccttgtacctctggtagaattcggctgtgaatccatctggtcctggattctttttcgttggaaagctattgattattgccacaatttcagctcctgttattggtctattcagagattcaacttcttcctggtttagtcttgggagagtgtatgtatcaaggaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagtggtctatcaattttgttgatcctttcaaaaaaccagctcctggattcattaattttttgaagggttttttgtgtctctatttccttcaattctgctctgattttagttatttcttgccttctgctagcttttgaatgtgtttgctcttgcttttctagttcttttaattgtgatgttagggtgtcaattttggatctttcctgctttctcttgtgggcatttagtgctatcaatttccctctacacgctgctttgaatgtgtcccagagattctggtatgttgtatctttgttctctttggtttcaaagaacatctttatttctgccttcatttcgttatgtacccagtagtcattcaggagcaggttgttcagtttccatgtagttgagtggttttgagtgagttacttaatcctgagttctagtttgattgcactgtggtctgacagtttgttataatttctgttcttttacatttcctgaggagagctttacttccaactatgtggtcaattttggaatagctgtggtgtggtgctgaaaaaaatgtatattctgttgatttggggtggagagttctgtagatgtctattaggtccgcttgatgcagagctgagttcaattcctgggtatccttgttgactttctgtctcgttgatctgtctaatgttgacagtggggtgttaaagtctcccattattaatgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgagtacaacacactgatgggtcttgactctttagccaatttgccagtctgtgtcttttaattggagcatttagtccctttacatttaaagttaatattgttatgtgtgaatttgatcctgtcatgatgatgttagctggtgattttgctcgttagttgatgcagtttcttcctagtctcgatggtctttacattttggcatgattttgcagcagctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactgtcttctggcttgtagagtttctgccaagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatatgaatgttggcctgccttgctagattggggaagttctcctggataatatcctgcagagtgttttccaacttggttccattctccccgtcactttcacggacaccaatcagatgtagatttggtcttttcacatagtcccatatttcttggaggctttgtttgtttctttttattcttttttctctaaacttcccttcttgcttcatttcacgtgtttcatcttccattgctgataccctttcttccagttgatcgcatcggctcctgaggcttctgcattctttacgtagttctcgagccttggctttcagcttcatcagctcctttaagcacttctctgtattggttattctagttatacattcatctaagtttttttcaaagtttttaacttctttgcctttggtttgaatttcctcctgtagctcgtagtttgatcgtctgaagccttcttctctcaacttgtcaaagtcattctccgtccagctttgttccattgctggtgaggaactgcgatcctttggaggaggagaggtgctttgctttttagagtttccagtttttctgctctgttttttccccatctttgtggttttatctacttttggtctttgatgatggtgatgtacagatgggtttttggtgtggatgtcctttctctttgttagttttccttctaacagacaggaccctcagctgcaggtctgttggagtttgctagaggtccactccagaccctgtttgcctgggtatcagcagcggtgtctgcagaacagtggtttttcgtgaaccgtgaatgctgctgtctgatcgttcctctggaagttttgtctcagaggagtacccggctgtgttaggtgtcagtctgcccctactggggggtgcctcccagttaggctgctcaggggtcaggggtcagggacccacttgaggaggcagtctgcccgttctcagatctccagctgcgtgctgggagaaccactgctctcttcaaagctgtcagacagggagatttaagtctgcagaggttactgctgtctttttgtttgtctgtgccctgccccgagaggtggagcctacggaggcaggcaggcctccttgagctgtggtgggctccaccccgttggagcttcccggctgctttgtttacctaagcaagcctgggcaatcgtgggcgcccctcccccagcctcgctgccaccttgcagtttgatctcagactgctgtgctagcaatcagcgagactccgtgggcataggaccctctgagccaggtgcgggatataatctcctggtgcaccattttttaagccctttggaaaagcgcagtatttgggtgggagtgacccgattttccaggtgccctctgtcacccgtttctttgactaggaaagggaactccctgaccccttgcacttcccgagtgaggcaatgcctcgccctgctttggctcgcgcacggtgcgctgcacccactgacctgcacccactgtctggcactccctagtgagatgaacctggtacctcagatggaaatgcagaaatcacccgtcttctgcgtcgctcacactgggagctgtagaccagagctgttcctatttggccatctttgctcctcccctcaattttgtatttttacaaaaaaaaaaaaaaaaaccgcggttttgccatattagtcaggctggtattgaactcctgccctctgttgatccacctgccttggcttcccaaaatgctgggattacaggcctgagccaccatgcctgtcccagaatattttatatttttattgaagttttcagcagtttcactcatcctgtttcaagttgctctgcaattgttttcctggattgcagacttacatttaatttaaggttatagtcccttaaattcaagaaaatgtttatttgttttgttgattggttggttggttttaaagcaggatcttgctctgtcagccaggctggagtgcagtggcatgatcatggctcactaaaagctttacctcctgggctcaagtcatcctctcacttcagcatccgagtagcagagaccacaggcacatgccactatgcccagctaatttttttttaactttttttgtaggtacacaatcttgccatgttgcccaggatggttttgaattcctgggctcaagcaatcctcccatctcagcctcccaaagtactggaattacaggcgtgagccactgcacccagctgaaaatgtatctttattaaaagttccacccacaaagttttgcccagtagtgttcatagcagagtgcaacccatgtttgtcaaatcaaagagtctcctttcatcacctgccttaggatctcatcaatattataaatcaacccttacacaatgatgaaatagaatgatagagtggaactcggagtgctcttactgatctttctctaataaacacctaaaaaaatatgtgcgtgcatcacatacacatattttcccctttgtgttctactttcactattggaaactccacatctaatttcttctgcttcaatatttttagacacaggaaacttactgtcttacaaagtaacccctgcttttttacatctctgttgagcattccttaccctgatggactgaagtttcttatcttgaaccgctacccactggctcttctaatctttctgagcttccccaaagtcagtcattcagatacttgaatacatctatcatctcttgcttgagttgctgttgttgtttaaaccagataaaatatgttccttcctccggttctgccttatagaacatgttttccatatcctgctagtctttctttagtttgtcaatggtctttagcatggagcagccaaaactagacactttgccacgctgctggtctgaaaagaacagagttcaagaaaaccattagctcacctgatctggatgtaatactcaacgcagattatgactgtatttttaaatgaaataatgatgtttgtttatattgaacttgccatcaactaacacatacaggtcttattcttatgaatcactcttaagagctaggtttccacccttgaggggtagtactctgtgtaatgctgtgcaactctgtactctccattcaattgtctgcacatttatttctcttatattctgccagtaatgtttgagaagaggagaggaggaagagtactactagtgagcatctgttatgtaccaaaaatcatgtcagtcttatttatttaaaaaacagaggtgttatccctcttttgtggaggaagaaattaaggctcacagaggcttaggtaacttgtccaagtctacccaacaacgggactgatatttgagtttagaatcaccttaattcaaaggctgtcttctttcagctatgtacacagctctcgagtgagtcagcttctctttccaacttgatgaaatagtctctattcctgatcatcacatacatctactactcttcttagcaatgaattagcttcaaatttgataagcatcaaatagtgttaacaattttgagcatagcagtgccaaggacagagctttgcagcatccccggcagagatcttgccttttacccatgcatgctgatttgcaggctttgggtatcattttcactcagttcatggtagtccatcctctctacaggttattatgagagatctttctaaaagtcccactgaaatactaaaatatcataactagtgtatattatctttctatatggtggtggtttaccttccttattcttcagtggtataataatcctttctaaaatgttgccaggacatatcccagaggtctaagatttctggcatccttcaatatagaaattgagattcttgctcattccagcctttcagcatacctttgatttttatcttcatttcatagtcatgtttatacattattttaattctctggcttaactttatctgactctagaaacttgaatatattctaaacagctagggcattcttttaatatgattttgcctacctttggcataaggtttcttttaaccttaaagtcaatcctttctactttaagatttttctcctttgaagccactggaggtacaacattggaactgagtagctcagtatttcagctaaatgctaaaagtaactttataccagcttctacaagcagagacttcttgcctatgttcttcttatttgggactacagaacttggaaaaattttctagttgtcctgaacaccttttagctaccattcttgcaggataacattgcctataagctaataaagcctatccaggatctattctttctaggaggccagatgaaggtggttgtcattatggtggcaagaactcttcttctgctcttcagacacaaggaatgaaggaaagaaagttttaggagtttataataaatgaagtggtaaatatttaaaatgctgattatatcaagtgttatctaggataccgaaaaataaacacttctaattgttcataggaatataaactttttggaagacacattggtatcatcaataaaaatattttaaaatgtatgtttttcccaatatttctgggaatatatcctttaataatactcacacctgtgcatgaagatgtaactgtgcttgctactcataaaaggtggtgaatttttagaatcatcctaatctgataaaggaatgcttcaaaaaaatatataagtagacttgacaaccactgttatcatcagtcactgcctctgagggagaatgtcagttggtttggaagagggtgtcaccaggaataggaagggacctctcccaactctgattcactgttgaaaagtgggaatggaggccgggcacggtggctaatgcctgtaatcccaatactttcggaggctgaggcaggcagatcacctgaagtcagaagttcgggatgatcctggccaacatggtgaaaccccgtctctattaaaaatagaaaaaaaaaatagctgggcatggtggctgggtgcctgttataccaggaagatgaggcataagaatcgcttgaatccagaaggcggagctgagatcacaccactgcactccagccagggcggcgacagagcgagactccgtctaaaaaaaaaaaaaagaaaagtgggaacagagagttccttcagtcagctgcaagaggacaagtagagtggagttgaccatgaaagtgggcagaactgggtataaaatataatagcaagtcagtctgtacagagatgcatgttgaagatgttaatgaaatattgtaagcaacctaaaatatctatcaatagaggaatggtcaaacaaattaggatgtcattattctaggaaggtttataaaactgttaaacgtatgaggtagacctgtaggccatgtcatgaaaagatctccaagacatattggtatgttggaaaacagcaagtcattttgtggtgttcaatccaatttaggtgaaatgttagtgttttaaaagagagagtgaaaggttggcacaaattttgacagtggcttcctctgagatgggaggagtagaaggagagtgcagaggagtgcccttgggctttgccccaaatccttctgtctcattggaatcttacactaaaacgcatttgtttattacctggataatttttttaaaaccgctataatgacaggaaagaatatcagtgaattgacgctgcctatcagaaccatatcttgggtgggtggggggcatccctgacccagccctgcagatgaggaagaagacgaggcatctctgccagctgataccacacagagcctacaaccatttgtttctgcacgtgtcaagaagaccatttgcaaaagagaacagcaaaaacaactcaccatttatgtgagtaagagaaaatagaggatttgggggaaaaaaagatcaatagtttgaaatatttcagctcatatggaaaagggattatcatgttttccatgatcttagaggcagaactagaactcataggccagagggcaccaaccagcatgatccccctctcagcagtcaccgtctaaacacagaagcatctcgtttggctggtgaatactgggaggcagcacctgttgctcttcaccctgtttcacatccgtaccctgtacatgtgtgtccagcacagcttgtttctttcagtttctctgactagcacctgtgtttggatgtttgattcgtgctgtggggtcaagctttagggaatcagactaggaagcagcttaaggtagaactttctaagcataggaaggcagcacacctatctggttaggaacgcaggctctggagctagcctgccttacttgaatgccggccctgccacctactactgtgtggaattaagctggttgcttcagtttcatgcttcagttttcccattgtgtgaaatgagagtgtaatgaggattatacgagttaatacacataaagcatttacattagttatctatcaccatgtaacaatattactacaaatttagcagcttaaaacaatacacgtttattatcccacagtttctgtgggtcaggattctaggcacggctcatctggtcctttttagggtctcacagagctacaatcaaggtgtcaaatagaatagcagtctcgactgagtcttgactcagagaggatctactcccaggcgcacccaggttgttggccgaattcagttcagggctttggtttcttgctggctgtcagccccagaggctgccttcagccccagcctcaaagcccacaagggagacaaggctgtgagcatgataggtgctacagtcggcatatatataacatatatatgccgacatatatacaacatatatatgccgacatatatacatatgttatatgtgcatagtcggcatatatataacaacatgcatctggaagctttgccatatctactggttagaggtaagccataggtcatgcccacactcaaggaaagaggacatctaagggcagtgaacatcaggagttaaggatcatagagaactgtcatatagaaaacatatgagatcatagagaacaccgtcctccatggcataccaagtcaggcctactgcatataaagtttttaataaatgtgagttattatccatggaagctatctgaagaaggcatagatggctttctgggaggattagtttctcacactgggggtattcagaccattactgggtggagactgtagacacgtagcaaagaaaaccaaatggaaataggcgttgagccagatagctcctgaaggtcacctgagattaccctgtcaccagacaaggtgaaccaactgccccctcctccttcagcattgtcctgagttcattactactttcttttttccatgctgtcttttttcacttttgtctgatttcacctgtgtaaaaatggaaactagaacaccccatatgattttctctgagaattctgagagttgccctgatccctcatagaatagccatgcttgggggtggggtgggaggaaggaaacacactttacctttactataatttacaggtttgtttcttcctaaggaaaagggacccaggccctgtttactttttcagtgtctctcaaaattctaaccaggtaggtatgcctagactgtactcaataaacaccatctaacatctcctggaagagggagagataatgaattggactgctaggctctttctagatcttgccgctgatatacaagggtttttacctgtttgattcactccccagttcgttcatgtgcctccgctgtttctgaggaaggcctggtaaatataaactttctgttgagtaccccagccctggaagaggactgataaggcagttccatgggtgggcagcacagaatccagaagtgtggggtttttttaggcctgagaagttgatttaaaacatatgtatccttacgtattgatttcataagtgcatacaccagccctacttctgcattcatcctctgaaacatgtgactgaagaaccatgtgtgcctcatatgcaaacactcaaatacaccctctgccatgcccatacctaactccgagccctgttgtcctggggaaagtaaatggaaatgactgaggacagtcatgctagtaactaaactttagaaatacaataaccatgaagcatctctgttaattcaggcaatttcccagtagagtattaaggtgttaattgcttctgcacttttctatttgacagatatgtcctttttcacctaggaaagggaagcaattattgtaatgctctcctgggctttgtgagatattctttaatgacttttaaaggcatcaatagggcattgtgcttttaaagggaaactgtactcttttctgtttgtgcttgacaacaagagtgggtattatattcagactacatgatgaatctgtgaaaggaaaatatgcaatgaaaaaaaaacaaaggcagtagtaatacattttcaggaagtatgtatccagatttcagatatgagaaaaatatgttcttatatgtgcatatatcactgagcttaacaaagattaaacaaacacaacaaaaaagatactcagcaggcatatttttctggaattttaacacaaagttgttattctctggaactggtgtggcctcccaagtgagggtttggcaggtggtttactcaatacaaatcggtaaatattctcttacacatcgtgtgaaagtgactttcacaggctacttgagctacaattggttttacagtttcatgtttacattcagaataaaagaaaaatagtcttagaacttgcaattagaattcagaactcttttatgataagagtcactttggcaacctggtcaagccaagacaacccatgttaactaaagtgatagtgcagaaagaagactggatgtggaatgagaactgaagttagagttttaagtcctcacaaaaggatttgcctgatacctgtccttaggcaagttgtctaaccttcaaaagcttcagatttttcatctgtaggatcctgggtttctgtgagaatcaaatgtatgtgactcttctggccaacttaagtgctgtcttgatataaaattgtatgatcaaaggaagatctaggttttgtgccgcctcaagtttatacaatttgaggggagggagttctttaagaaaaaaaatacaaaaatatcatttttcgaatttgacaaaaccatatggtggtgtgaatacattgctaggatgcctcccaagactttggaagaagcctgtgccagttaaggtcccagaaattcgagactcagttacttagcctgtgcagcattattatagacttagagaatgctaaagctagaaatggccatacaagtgtgacaggggttcacacttgtttttttagcagtagaaacctcttttcaaaatcttatgtggaggaataagaggaaaaaactgactagcataactgaagatgggacctaggacttagagatatgcctatttggtctctatcttctctggaagaatttcagttgaggcccggtgtggtggctcatgcctctctaatcctagcactttcagaggctgggatcacttgaggccaggagtttgagactggcctgagcaaataacaagactctacctgtacaaaaattttaaaaattagccaggcatggtggcatgcacctgtattcccagctactcaggaggctgaggctggaggatcacttgagcccaggaattcaaggttgcagtgagctagatcataccagtgcactccagcctgggtgacggagtaagaccctgtctctaatatatacatacatacatacatacatacatgcaatgcctacaaactaccccccaacatacacattttaacaactgtgaactgggatgcattttatagttgttcttagacatgtgataatcataatattattattattgcctgtgcatgcacttacttggttgcagttcctggtgatatcattggataaatgtaacttcttgaagtttcaggaaataaacctgaaactgagtagaacctgaaataaacctgaggagggaatatgtactgttgtctaaactgttctgttgatactttcccataagctcaagaagcacaagtatcaaaacttgccaaatgaggatccaatcaagtggagaaggaaaaggggtgctcggaagcagcccccagccccctctctatcctggaggcacagagtgtgggggtcttgcaaattactttcttgctggacacttgtggagtgagtacaccctgagggtctgggagaggcctaacctccacccctgagtcccatggtccctggtgcctgcccagggccaggctatgggctcagatgtcacactttccttgcctccttccttgtcacctccagagatttggattcaggatttgttcctagtgtccaaaactttgacaggaaagttaacttcttttttttttcagacgaagtctcactctgtcacccaggctggagtgtagtggggcaatcttggctcacggcaacctctgtcccctgggttcaagcgattctcctgcctcagcttccccagtagctgggattgcaggcgcctgccaccgcacccagctaatttttgtatttttagcagagacgggatttcactgtcttggccaggctggtcttgaactcctgacctcgtgttccacccacctcagcctcccaaagtgctgggattacagacgtgagccaccgctccagagactgatgcccacctacaaatcttgatagaacaattaaagttttttgatcacaagcttcaaaactgcaaagataataagcagagaaagaaaactgaaactctcaaagagaagcaaatagcatggtggaatcaatgaaacactgcactgtgttgatgcagactgctgaagaccagaataatgctgagaagcacgcagatagaattataagtactattaatcttgtagatgcagtgtatcaacctagtccctgggaacctgtgatcagcacaatgccttcccagactgtctcacctccctctggaacctactcaactgcataagacagagcagagttcatcttcctgaccagttggacctgtactaattgccttgggacatcattagactccaacaccaaatagtagaggcagtgcccattcaccacctagtagcggtctaacttctccaagccatgtcaatggcttctctaaatacaatcccagaattctcttattccagcagtgaagatgaattctacaatgctgatgaatgtcatcaacatggctcatccccaaagcacttaatagattcttctgaatctgcgtcaatcttgacacatggcagtgcggaaaacagactaaagtgcccagatagcacagaatcacttaattctttcacatccaatggaacaagtgatgctgactcttgattcacatgatgagagacctgacaaggaggaggcagggtccatggaggagcataagagcgttaccacacacttcttgtcacaggttaggcttagtatggatcttactaaagtagatcttccaccattttttcttgaaagaggatctcttttagaagcatatgcagacattttttgcatatccaacctttttgcgaacattggtgaccagggattgaacggttcagaatgtgaaatggtacctctcagcctttcatgcaagaaggaaagaatcaattgtcaaaaagtcattttagcaagatctttcagtgtcaatggatattaccaaatgataccaaagagaacacagagctagttttagaaggaccagttccctgggtttccaaaaacaatgtaaaatttgtagctgaacagatttcccatcatccacctactttagccttttatgctgagtgtttatcagaaagattcaattcattggtgatatctggacctaatcaaaattcctcaggatgtcaattgggacacacaacatagggtggggccacaagccctgtgtcttttgttttaactatgagaaacattacatcctcacattccccagtgtttacggatgttctatcctcgcagtgctctgaatggaactaggaggagaatgcaatattaattattccaaaactggtgatagtgcaaacatcatcttccacactgaacctttctctggggacaggaagcacagaattaccactgtgatttttttctccaaaggatgagaagccttctgctcaactgaaggggaatggaatggtgtaatgtatgcaaaatatgcaacaggggaaaatgcagtctttgtagataccaagaagatgtctataatgaagaagataggaagttgaaagatcagaaaaaatatgaatctcactgcctttagaaggatgtactttcaacttaaaaatcagagacattcagtttccatgcagttgtgcaattttgagtgagtttcttaatcctgagttctaatttgattgcactgtggtctgagagacagtttgttataatttctgttcttttacatttgctgaggagtgctttacttccaactatgtggtcagttttggaagactactgggtaaataatgaaatgaaggcagaaataaagatgttctttgaaaccaatgagaacaaagacacaacataccagaatctccaggagacatttaaagcagtgttcagagggaaatttatagcgttaaatgcccacaagagaaagcagaaaagatctaaaatcgataccctaacatcacaattaaaagaactatagaagcaagagcaaacacattcaaaagctagctgaaggcaagaaataactaagatcagagcagaactgaaggagatagagacacaaaaaaaccttcaaaaaatcaatgaatccaggagctggttttttgaaaagatcaacaaaattgatagacagctagcaagactaataaagaagaaaagagagaatacatgcaataaaaaatgataaaggggatatcaccactgatcctacggaaatacaaactaccatcagagaatactataaacacctccatgaaaataaactagaaaatctagaagaaatgggtaaattcctcgacacatacaccctcccaagactaaactaggaagaagttgaatccctgaatagaccaataacaggctctgaaattgaagcaatgattaatagcttaccaaccaaaaaaagtcctggattttttttggaagacggattcacagccgaattttaccagggatacaaacaacagctggtaccattccttctgaaactatttcaatcaatagaaaaagagggaatcctccctaactcattttatgaggccagcatcatcctgataccaaagcctggcaaggacacaacaacaacaaaaaagaattttagaccaatatccctgatgaaaatcaatgcaaaaatcctcaataaaatactggcaaactgaatcaagcagcacatcaaaaagcttatccaccacggtcaagtgggcttcatcccttgagatgcaaggctggttcaacatactaaaatcaataaacattatccatcatataaacagaaccaaagacaaaaaccacacgattatctcaatagatgcagaaaaggcctttgacaaaattcaacaaccttcatgctaaaaactctcaataaattaggtattgatgggacatatctcaaaatataagagctatttatgataaacccacagccaatatcatactgaatgggcaaaaactgaagcattccctttgaaaactggcacaagacagggatgccctctctcaccactcctgttcaacatagtgttggaagttctggccagggcaattaggcaggagaaataaataaagggtattcagttaggaaaagaggaagtcaaattgtctctgtttgcagatgacatgattgtatatttagaaaaccccatcgtctcagcccaaaatctcattaagctgataagcaacttcagcaaagtctcaggatacaaaatcaatgtacaaaaatcacaagcattcctatacaccagtaacagacaaacagtgaaatcatgagtgaacccccattcacaattgtttcaaagagaataaaatacctaggaatcccacttacaagggacatgaaggacctcttcaaggagaactacaaaccactgctcaacgaaataaaagaggacacaaacaaatggaaaaacattccatgctcatggataggaagaatcaatatcgtgaaaatggccatactgcccaaggtaacttatagattcaatgccatccccatcaagctaccaatgactttcttcacagaattggaaaaaaactattttaaagttcatatggaaccaaaaaagagcctgcattgccaagacagtcctaagccaaaagaacaaagctggaggcatcacgctacctgacttcaaactatactacaaggctacagtaaccaaaacagcatggtactggtaccaaaacagagatatagaccaatggaacagaacagagccctcagaaatagtaccacacatctacaatcatctaatctttgacaaacctgacaaaaacaagaaatggggaaaggattccctatttaataaatggtgctgggagaactggctagccatatattgaaagctgaaactggatcccttccttacaccttatacaaaaattaattcaagatggattaaagacttaaatgttagacctaaaaccataaaaaccccagaagaaaacctaggcaataccattcaggccataggcatgggcaaggacttcatgtctaaaacaccaaaagcaatggcaacaaaagccaaaattgacaaatgggatctaattaaactaaagagcttctgcacagcaaaagaaactaccatcagagtgaaccagcaacctacagaatgggggaaaatttttgcaatctacccatctgacaaagggctaatatccagaatctacaaagaatctaaacaaatttacaagaaaaaatcaaccccatcaaaaagtgggtgaagggtgtgaacagacacttctcaaaagaagacatttctgtagccaacaggcacatgaaaaaatgctcatcatcactggccatcagagaagtgcaaatcaaaaccacaaggagataccatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgctgctataaagacacatgcacacatatgtttattgtggcactattcacgatagcaaagacttggaaccaacccaaatgtccaacaatagtagactggattaagaaaatgtggcacatatataccatggaatactatgcagccataaaaaacgatgagttaatgtcttttgtagggacatggatgaagctggaaaccatcattctgagcaaactatcacaaggacagaaaaccaaacactacatcttctcactcataggtgggaactaaacaatgagaacactgggacacagggtagggaacatcacacaccggagcctgttgtggggtggggggaggggggagggatagcattaggagaaatacctaatgtaaatgatgagttaatgggtgcagcacaccagcatggcacatgtatacatatgtaacaaacctgcacgttgtgcacatgtaccctagaacttaaaatattaagaaaaaaaatcagagatattgatgcggcaactgaagcaaaacacaaacttgaaaaagacagagaagaaacccaagaaaggaaggagaaggaaatccaatgggagacaagcttatttcatgaagttggaagatattgggtttatgatgaactattactgaattatcttggtgctgccaagccttgggctaggaaatgtaaagtttatacctgatggccagggcagtaagcataattaagcaacaaacattctccctttgggagaacctgttcattcccttcttattgcaatggtttctcagggatatgagactttcttgtttttttattttttacaattaaaaatcaattgtatttaattatatacaatgcataattggaaatttaaaaagcagtaccatttgcaacaacataaaaaatcaagtaaatagaaattcctagcccaatgcttggcagcaccaagataattcagtaatgattcatcataaacccaacatcttccatcttcatgaaataagcttgtctcccattggatttccttctccttcctttcttgggtttcttctgtttgtctttttcaagtttgtgttttgcttcagttgcagcatcaatgtctctctttgccataaatctagcaaaatatttataagatctacacaggatatgggactttctgacacagatgaacaattacagtgggaaaagcttccctttttcctctgtggcagttatggtcataagtcctgagaaaaacttcaggttttgaaaacaagatgattgctccttttccaaaccctacatgttgaaaagcatttctaaatccaagcctcaaactctacactctaatactgatgttaaggaatacaacttctgttttctagttcttatgatgttggattatgtgtgtgtttgtgtatatacagtccatatgttggattatatgtgtatatatacacacacacagtgtatatagtgtatatactgtatatatagtataactgtatacatacacacatacatatgcagttgacccttgaacaacacaggtttgaactgcacaggtctacataaacacagattttctaccacctctgccacccccgagatagcaagtccaaccctcctcttccttctcctcagcctacctaacgtgaagaagacaaggatgaagacctttatgatgatcctcttccacttaataaatagtaaatatattttcttccttatgattttcttaacaacattctcttttattataagaatatagtatatcatacatataacatacacaatatgtgtttatgttgtcagtaaagcttccagtcaacagtaggctattaatagttaagttttgggatagtcaaaagttacatgtggattttcaactgtgcggcagggggtcgggggtgatggtgcatctaacattgtattatacgtacatacatatataatcatgcaacaaagatacataatgccagatttttcataaaaactccttctactgtaaatatgggttcctcagagttgttttgagaaatcagcacagtgtcttaaaatcgtgttgggaaatgttacggtctcacctgcaatagcttttcttttggaactgaactattattaagctgtatataagcctagattatagtttaattatactcaatatttcttcaagcttcataaagtaatttttcaaaaaaattgaaacttgccaaatgagcctcagcagcttgaaagaaaatccaaggggcaataacagagcactgtaaaaaatgcagcatcacagtgctcttggtgcccaaagtactggtgatgaggacaatatcgtatagaaaatatggacatcagtgacactggttcagagggtgaatgtggaaaagttgtaggagcaccttgactgatttatttcactgacatttttcttttcatgcatgtgctttgagttatttaataagtataatacttaaacaaccttagtgataagcattatgttgtaatttgattgacagcgtattcttttgttttattttgttttgtttgagacaggatcttgctctgacccaggctggagtgctgtagtgcaatcatggctcactgcagcctcaacctcccaggctcaagcaatcctctcacctcaacacccccacatcccccaccaggtagctgggactacaggagcacaccaccatgcctgggtaatttttaaatctttttgtagagacagagtttcaccaagttgtccagggtggtctcaaactgcttagctcaagcaatcctcccacctcagcctcccaaattactaggattacaggcatgagccaccaaacccagacatattctttcttagcagcaaataaaataacagtgtgccttacgatcgctggcaccttaaagtcaataaaatatatatatttttttaagccatatacttcagttctctcattttacagttcagagattagggcacacaaggatttagtgacttgccagaggcgaggcaatagggctggttttttagggcataatgaaccatttgcaaatatttttcaagtgactgtcccaacttagccccagattaaccctttgtttttctaaataatcataactaaccatattgttataattttctatttctttaagtcagtatttctttttttttagtttttaatttttgtgggtatatagtaagtatatatatttatggggtacatgagatgttttgatacagccatgcaatgcataataatcacatcagggtaaatggggtatccatcacctcaagcacttatcctttgtgctacaaacaatccaattatactcttttagttattttaagatgtacaattattatcgactatagtcacctgctgtgttatcaaatactgcatcttattcattctttctaatgtttttgtacccattagccatcctcactttccttccactcccctgctaacttcccagcttctggtaacctttattctactctctagctccatgaattcaattgttttaattttcagctcccacaattaagtgacaacatgtgtttgtctttctgtgcctggcttatttcacttaacataatgacctttatttccattcatattgttgcaaatgacaggatctcattcttttttagggctgaatagtactccattgtgtgtatgtaccacattttctttatccattcatctgttgatgaacacaggttgcttccaaatcctggttgttgtacatagtgctgcaataaatatggaagtgcagatatttctttgatatatcaatttcctttctttagggcttatacctagcagtatatgggtatatgctgctagggattgctggatcatatggtagctctatttttagttttgtgaggaaccgccaaactgctctgcattgtgattgtactaatttatattcccaccaacagtgtacaagacttcccttttctccatgtcctcaccagcatttgttattccctttcttttaactggggtgagatgttattatatttaattgtagttttgatttggatttctctgctgatcaatgatgttgagcaccatttcatatacctgtttgccatttgtctctctttttttttgagaaatgtctaatcaaatattttgcccatttttcaattggattattacattaaaacttttactatagagttgtttgagctccttatatattctggttactaatcccttgtcagatgtatagtttacaaatattttctcccattctgtgggttgtctcttcactttattgattgtttcctttgctgtgcagaagctttttaacttgatgtgatcccatttatccatttttactttggttgcctgtgcttgtggagtattactcaagaaatttttgcccaaatcaatgtcctggagagtgcccttgatgtttccttattgtactttcataatttgaggtctgggatttaattctttaatccactttgatttgatttttgtatatggcaagagatgggggtctagtttcattcttctgcatatggatatctagttttcccagcatgatttattgaagaaactgccttttccccagtgtatattcttggcacctttgttgaaaatgagttctctgtaggtgtatggatttgtttctgggttctctgttctgttccattggtctgtgtatctgtttttatgccagtaccatgcagttttggctactatagaactgtagtatattttgaagtcaggtaatgtgatccatccagttttatttttcctcaggatacttttggctattctgggtcttttgtgggtccatataaattttaggattgttttttctatttctgtgaagaatgtcattgatatttcaatagagattgcattgaattagtagattgctttccgtagtatgacatcgtaacaatattgattcttccaatccatgaacatggagtatctttccattttttgtgtgtcctcttcaatttctttcatcaaggttttaaagttttcattgtaaagacctttcacttcttttaattcctagctatttaattttatttgtagctgttgtaaatggaattactttttaaatttctttttcagattgttcactgttggcatatagatatgccactgattttttatgttgattttgtattctgcaatttcactgaatttgtcagatctaataggtttttggtggagtcttaagggttttccaaatataagatcatgtcatttgtaaacaaggataatttgacttcttcctttccgatttggatgccttttgcttctttctcttatctgattgctctagctagggcttccagtactatgttgaataacagtagtgacactgagcatctttctaagttccagatcttagagaaaacactttcagtttttccccattcagcatgatgttagctgtgggtctgccttatatggtttttattatgttgaggtatgttcctgctataccctgttttttgagggtttttttttttttatcatgaagggatattgaattttatcaaatgctttttcagcatcaattgagatgatcatgtggtttttgtccttcattctgttgtgggtatatcacactgattgatttgtgtaggttaaaccatccttgcacccctgggataaatttcacttggtcatgatgaatgatgttttcaatgtgatcttgaatttggtttgctgctattttgttgaggatttttgcaacagggtttattgggaatattagcttgtagttttcttttttcatgtgtctttgtttggttttggtatcagggtaatactggccttgtagagtgagttctgaagtattctctcctttattttttggaatagtttgagcaggattggcattagttcttcttcaaatgtttggtaaaaatcagcagtgaagccatcaggtcctggacttttctttgctgggaggctttttattacagctttaatctcattacttgttatgagttatggtcagttcagattttggatttcagcatggctcaatcttggtacattttatttatataggaatttatacatttcttctaggctttccaatttattggcatatacttgcccatagtaatctctaatggtcctcatatgatttggctgttttcccacccaaatctcatcttgaattatagctcccataattcacacatgttgtgtgagggacccagtgggagataattgaatcacgggggtgttttccccatactgttcttgtggtagtgagtaagtcttacaggatctgatgattttataagaggttttcctttttgcttggctctctcattcgcccttgcctgccaccatgtaagagatgcctttcgccttcctccatgattgtgagtctctccagccatgtgtaactgtgagtccattaaacctcttttcctttataaattacccagtcttgttatgactttatcagcagcatgaaaacggactaatataggtcctttgagtttctgtagtatcagctgtaatgtcttcattttcatctttgattttatttatttaggtcttctctctgttttcatagtctggctaaaggtttatcaattttgtttattcaaaaaactaactttaaagaaaagaaacaacttttaattgatcattggtattgttttcttcatttcagtttcatttatttctgctcttttcttttatgctactaattttgggtttggtttgctcttgcttttctagttctttaagatgcattcttaggttgtttatttgaaggttttctattttttgatgtagtattaatagctataacttccctcttagtgctgcttttgctgtatcccataggttttggtatgttgtgtttgtgatgttatttgtttcaagagatttttaaattttcttcttaatttcctcattgacccattggtcattcaggagcatactgtttcatttccatgtgtttgttgaatttccaaaattcctcttgttactgatttctagttttattccactgtggtcagagaatatacttgacaccatttcaaattttttggaatttttagagatttgttttgtgctaacatatgatctattctcgaggatgatccacgtgctgaggagaatgtgtatgctgcaactgttgaataaaatgttccgtagataccaattaggttcatttggtctgtagtccagattaagtccattgtttctttgttgattttatgtctggatgatttgtccaatcctgaaagtagggtcaccagctattattgtattgagttctatctctctcttaaactctaataatatttgctttgtatatctgcgtactccagtgttgggtgtacatatatttacaatggttatatcctcttgctgaatttacccttttatcattatataatgagccctctttgtctcttctcacagtttttgtctcaaaatctattttgtctgatagaaatatagctacttctgcccttttgtggtttccattggcataggatgtctttttccatcccttgttttcagtctatgagtcattataggtgaagtgtgtttcttatagacaacagatagttgagtctttttttttatccattcagccactctgtgtctcttgattggagaatttagtccatttacattcaatgttattattgataagtaaggatttactcctgccattttgttattagttttgtggttgttttgtggtcttatttttttttctgtcattccttcctgtcttccttttagtggtaatgtttctctggtggtatgttttaatctcttcctttttatactttatgtatctgttgtatgttttcaatttgaggttaccataaggcttgcaaatactgtcttataacccattattttaaactgatgacaacttaacactgatttcataaacaaatatgcaaaaggaaaactaacaaaaactctacacttcaacttgtccccctgctttttaacattttgttgttgttttttttttaatgttttatcatactggctatttcttgaaaagttgtcatagttattatttttgattggttcatcatttagtctttcttcttaagtttgcataccaccattacagtgttatactgtgtttttcttggtgcttcctattaccagtgaattttgtaacttcagatgatttcttattgctcactaacatccttttctttcagattgaagaattccccttagcatttcttgtaggacaggtctggtgctcatggaatccctcagcttttgtttgtctaggaaggtctttatttctccttcatgcttaaagcaatttttgccagatatactattcgaggataaaagttttttttctttcagtactttaaatatgtaatgccacgctctcctggcctgtaagatttccattgaaaagtctgctgctagatttactggagctccattctatgttatttgtttattttctcttgctgcctttaggattctttctttttcctttgcctttgagagtttgattattaaatgtcttgaggcagtcttctttgggctcaatctgtttggtgttctataacctttttgtacttaaatattgatatatttctctaggtttgggaagttctctgttattatcactttgaataatatctgtctctacatccctatctgtctctacatcctcattaaggttaataactcttaggtttgcccttttgaggctattttctgggtctaataggcatgccttattcctttttcattcttttttcttttgtctcctctattttcaaatagactgtcttcaagttcattaattcttccttctgcttgatcacttctcctattaacagactgtggtgcattctttagtacgtcaattgcatgttttcaactccagcatttctgctcaattctttttaattatttgaatctctttgttaaatttatctgataggattctgaatttcttcactgtattatcttaaatttcatcaagtttcctccagtcacctattttgcattctctctctgaaaggttacatagctctatttctctgggtttggtccctggtgccttatgttattcagttgatgaggtcatgtttttagatggtcttgatgtttattgatgttcatcagtgtctgagcattgatgagttaagtatttattgtagtcgtcgcagtctgggcttgtttgtacccatccttcttgggagagctctgcaggtatttgaagggacgtgggtgttggaatctaattttttggtcactgcagccatatctgcattagggggcaccccaagcccagtaatgctatggctcttatagactcatagaggcatcatcttggtggttttggataagatccagaaaaattatctggattactaggtagagactcttactgtcttgccatactttctcccaaacagacagagtctgtctctgtgctgagccacctggagatggggaaggagtgacacatgcacccctgtggccactatcactgggactgcactgggtcagacctgaagccagcacagcagtgggtctcacctaaggcctgctgtaaccactacttggctaccacctatgttttctcaaggccctagaactctataatcagcaagtagcagaaccagccatccttcagggtgaagagttcccttcagggtagagagttcctctggatcctggatgggttcagagatggcattcaggagccaggtcctggagtcaggaaccttagaaagctacctggtgctctattctactgcagctgaactggtacccaaagcacaataaaaagtccttcccactctacctctgctttccacaggcagaggagcctctccccatggccaccacctccagtgtgccatggggaatactgccaaagtaccaccgatgttcacttaaggtccatggactcttcagtcagcttgtaatgaatgcttccagccccaggattctcccttcagggcagtgggcccccctctagcccaaagcaggtccataaatgccattcatgagccaaggcctggaatgggaaccccaatggcccacttcgtgctctactcccctgtggccaaactggtacctaagttgcaagacaaagtccccttcactcttcctctgtttttctcaagcagagtctttcctcatggccaccacagttgggaatatgctaggtcacacttgaagccagcatgtctcagattctcacccaaggcccatggcatgtactacacctggctaccactgctgactattcagggccaagagctcttaagtcagaagctgatgaaacctgccagaattggattcttcccttcaaggcagtgagttttggcccaggttttgtctagaaatcttgttcagaagctacacctcccaactttgtgtggtgccctctctgactgtagctgagttggtatccaagttgcaagacaaagtcctctttactcttccctcttctctcctcaagaagatggaaggggtcacttttggaactgcaaactgtgctgcctgggcttgggggaggagtggtgcaagcactcccttagccaccccagctggtatcttactaggtcacatgcccaccaagtcaatgggctcttagcccagcacagcactaggacttgcctaggagttgcagtccttgtggcttagactgcctttcaagtagatttagggccccaaaccactttagtccactgtggtggggcttgtcggagctcacatggcaactgctgggatggaggattcccttccagctagggctggtccaaatgcttcctccatgggtgttggctgacttctgcttggtattgctttccattgtgataggaaagcaccaagttccaatgcaaagtcccaaaatcacagcacttttcctcccccaagctcataaattcttcgtgccatgagacatgcgggatggggaaggggtggcatcggcaattcaagactgtttttcctactcttgtcagtggctctttcagtgatatgaagttaaaaccaggtactgtgatcgctcacctgatttttggttcctacgaaggtgcttttcctgtgtagatagttgttaaatttggtgttcctgcagggaggatgatcagtggaggcttctattcagccatcttgctctgcctcccaaggtctgtattttttaatagaatataaattccttgaggtcagggactaagtctacatcatttactgctagatagcaaagtgcctagaatttaggaaattatcaatagatattcaatggaagatagggagggaaacaagggagggagagggaaggagggaggaaatgaggaagagagggagggactaaagcatttcaaactcagagtgaggctagaagatagttatacttgggtaagatagtgttacataaggtgattgaggtactaataaaaaggatggatggcatcaaagaggaaacagtagtgactgctttatctgctcattctctttctgcttactgcaatggggaacatttctctgtgacaagaaaatggtttcccatgtagagcagaagaaatgaaagggaccaggagaggggccaggagagaatggtaccctccctgttaggatagagaaagccaaatacagggtgtgagagctgtccttgatataggcagcacagccttctccagttctgaattccagtgggtctgagtagggctctcatgaagctctgactcactgcagcaggcccatggcttctccatggaaagtccatagggctccccagatgctttgcttcttggtgatctgcagtgactacactattagttttccatctgttcctctatttgaaatgaatcaagtctcatcaaacaagggacaatcaaataaatgcccctgatgcacaggcatctgtgacaaaatgaggactgatttactagtgcccttgtggcttggagtctgcttgaggctagctttacttttcttcccttttctcaaaagtatttcatctatacattcttttggtccattgtttgacaattactgtatgatgagtctgaaactttgtagcatttagttacatgaggcggaaatttcatgtacgtaaaatagacatgaagttcggcctaatgaaaggaccctaattttcaagtctcagtgtccctaatctataaaatggtagtatgcccttctttacagagtttttctgaaggctaagttagtgaatggatgtaagaatacttggaaaagtataaactgctttaaaagaatggatagtctttaaaagtatcacaaatttcttcattttaatctctctattcagtcaggttcctagctcatgttagattcgtgggtacttagatattcatggaagaaaaaggccaagtgagtgtagctctaagttctactttgccctgattatttaagaagtctgatttcttgttgaagtttatcctttctccatttccctttcaggcacaatggaacctcaagccttgtcctcttagttgtctttgaagatgcaacatttggccccttatgttaaacactaagcgacctaactcagcaatgactagctctcactagctgtagtgcagccttacctgatatctttctcaggatcttctttcacttccagagtgttctttctttttatccacccagctgctcccatcccttgttgttcagctggactcccagatcagaacatctgatcattctaatccccgcacagtagttctggattttcatatttaaatagttattcaacataagatactgccctgcctggcactgtggctcatgcctgtagtcccagcactttggtaggctgaggcaggaccatcgcttgagcccaggagttcaaaaccagccgaagcaacatagtgagaccccatctgtacaacaacaacaacaacaacaaaattgttttaaaaaattagctgggcctagtgacacacactactcagggggctgaggcaggaggatcccttgagcccaataagttaagactgtagtaagcaaaaattgcaccactacagtacagtctgggcaatagagtgagaccttgtctcaaaaaaaaaaaaaaaaaaaaggattctagccaaaaggacacccaaaaatacatgcaaaaataaatgatttcctcccaaaaatagctcattaatttgctaagcaatacttggtatcttcacttctctattaagtggaaacaacagtaatactgcaagtaaatattctactttcatctaaagaagaacttaaacctctaaatagccatctgtagcctatagaggactttctcagcagcatacgttgagctgttattccctttcaggctcccaggccatgctatggactgacgacatttcattgcaattattagatgtttgtctcttagacatttagaatgtgaattgcagaaaggtagaggcagtgattattggtcttcaaaatactagcctctaccacagagtctggcaattataaatgcttaaaaacgtttttaggacaaaacagtccataagtagttgtaagaatgtagttaacttatctaagggaacattgaaaatcagagtaattaaattcaaagatagccatgccaattgcttcagttttacttgtaaactccgattttcaatcatgtcaacaatgtgattttataatagcttacaagtgaaaattacagatggaaagtttttccaaaggaaaactgcctgaggctcttgaagcaagtgtgattccgagatatcctgcccagtgctttctcctggcccttatcaactcttacatttaaatgtccaccactcaggccatcatgcttaggaagagaggcggtttcactgaggtgagccatttcctgtttctgatatcttgcatcatggttttatttagactatcagatgattgtgtaggaatacgtgactgatagatgtgggtgctgtttgctattctacatccccctacccaacatacacacgaattataaaatgtcactccagcgtaaattgttctttgattgtcacattgctcaaacctgatcttctaggtcagagtttctaaagtagggtatatggataaaccccagggggaattcatgaattcccctgaaataatgcacacaatttttctgggacaagcgttcactgctttcattaaattctcaaagtagtctgtgacttcaccaacagttaaataccactgttaattcttttgtcttatattcataacaatcaaaatatagtagaaaattggcagtttgcatatctggaaatttccaatatccaaataacaataataatgacaataagacaacaataataccttggctaacatatattgaacacttactgtgtgggttattaccataagttccttataagaattgtattacttaatttcaccacattctgtaagtagataccattattatccctaaattagatgtgaggaaactaagacccgtgaaaactaaataacttgttaataagtttgacattggaaagcttaatagcaaattttgacaattaaataactgattttgggagcagtagaaattggaacaattctcgtattgccatattttaaaagcagggatttttttttaacttaatgctttagaaggcatttgatacctgaatcagttatgccagaaaaacagtcaacatctctgttcaatctatttttaaaagaatcctgacccatatatcacatatcttcaggggtcacatatttttgtatttgacactgcatatttgtatatcccctttctttggaggtgcaataggaaacatacagatattaatccagccctcccatcactgcatgagataaatcccaatcataattttgtttcacatgaatatttgtgccaggtaatatttatgtgctgtacatccctgccactgatcaaatttatgttcagactcccaagggatgagaaaaattctagtatatccctcatgtcactacacagaggtggaaaatgcccaaaaacctttctctgctagtctgggtggcaaaaactgagactgaaaatgcagcagttcatcacagaaacccagctttgatccccacagctttgctgaaccaggggatattaggaagagcttgaaatgagtattggaaaaagcatctgtttatttcctgaggggaataaacttcctagtggcaccaccaaaagtaatatacagataaaactgtagtatgagcaataatatttttttcaatagtagtacacagatatagctatagtattctggtgcgtgccctaattccccttactaaggcattggtacaattaatcaaccaagtaagcttagggaaataactctgtctgctcctgttcagattctgctcctttatcattttgcttctgcaccgtccagcaataattctgtttgccacaagctgatgctcaccaccccattataattccctgttttgggactgatgtgctcgttcatccagcagttaccagggaggacctgtgaatgttccaggcactattctagatgctggagatacagcagggaaaaaacactcttgttgacaccagcatttcaaaatttgtgacttactttacagagttttcaccaatagtatttctatttaactgttaatagtatttttaaaaatctctgcagttaatagtacttcaagaagtaaagagcttcgcctgttttgctgaatatgcctctagtggttgctttgaaattgtactttctctttttacgctacagccatgtggtgaagatcttatagagcattttgaggtgtgatgaaaagtattttaagaccaagtttttctgtggtatttcaatgttaaatttatcttatatgacattatatagtgtgcctgccccactccaatcacccgcagcaacacaaacttcctgttttctagattccctttctcagtgacagatgtcaacatccaccaatcaaacaagttggaaaccttggggcctttttgatcctcactcacttccatgcttcccacatcctaattggtctctaactccggaaaattcctcctcattaatatgtctggtgtccatgtcatccacatagcctctgatgtattttagtccatcatgtgttgcctctgggtggcatagtcagtacctgtccctccatatccaccctacccccattgcatgggtctctatttagactctagttctcagcctcctttgaatttatgtgtgtacatggatggaataagttcttgcccttgggatgtgaacataagcaggccagtaatggctttcaagagagctgtctttccccttccaccagctgaatgaaaacaagataaagtcctagggcagaagtttctaaactttctcagtccacagagcctttagtgtctcagaattttttacagcacctccaggccaaatgaaataccactagttcaatttactaagtagttaggtccaaacaacacagttcatattttatcctaacaacttattagccatttgaaaaaagatatatataaactaaaagaacaacacatgttcatttcactcttaagtaaccacaagtagttcctcaattctagctgcatgttagaatccactggaggaacttttcaaatactgatgcctaggcgtactccagaccaattgaatcatatacccactgatgggacattttttaaaaaattaaactcctaattttgagataattgtagattcatatgcagttgtagaaaataatatagaaattccttatatcctttaccttgttttccccaatagaaatatctacagaactatatgtaatatcacaaccaggatattgacatggatggagtcaagatacagaacatatccatcaccacaaggatcaatcctttactcttttatacctgcatccacttccctcctgcccttacccctggcaacttctaacccatactctagtgctataattttgtcatttcaagaatgttaaataaatggaatcacacaatgtgaaatctttggggttgactttttgcccttagcatagttctctggtaattgatctgggtcgttacttgtagcactagtttgacccttttgattgctgagaagtattccgtggtatagacaaaccacacttgtttagccatttacctgttgcaggatatcttggttgtttctgtttcctgctattgtgaataaggctgtgataattattcacttacaggttttggtgtgaatgaaagcattcatttctctaggattaatgcccaggagtataatttctggctcatagggtggttgcatatttagttttctaataaactgctaaactgttttccagagtagttgtcctattttacattcccatcagtagcgtcagagtgatctaattttctgcatcctcaccagcatttggtgttgtcactaatttttattttagcctttctgataagtgtgtaatgatatcaattgtagttttaatttttaagtaatttgagccatttccccaatggaaaatgttgagcattttttcgtgtgtacttacctgccatctgtatatcctctttaataaaatatttcatgtctttttcccattttctaattagattgtttgcttttttactgttgagttttgaaagttgcttgtatatttgaaatactagtcttttgtcttttgttggatatgtagtttgcagatattttttcctggtctgtagatgttcttttcatcttaagcaggtcttgcagagagcattcatttttaattttgatgaagtccaatttgctgatttttttttccttttatggatcatgcttatgtcaagtctagaaacccttcgctaaacctagatcttaaaatttttatcctgttttcctacagtttctaaatatttcatacagtttctataatattatggtttacatttttgactgtgatttattttgagttaaattttatacaaggtgtgaaactctggtcaagttgtgggatttatttatttattttgcctgtggatgtcaaattgctccagcatcatttgttgaataggctacctttcctctattgaattgcatttgcatcttgtcaaaaaacagtatgtcatatttgtgcgagtctattcctgggtcctctgttttgttccagtgatctatatgtctatccctccatcaataccacagtggttttacttatgatttttgatacagggtatcactctatcgcccagactggagtgcaatggcatgatcatagcttactgcagccttgacctcccaggctcaagtgatcctactgcctcagcctcctgagtagctgggactacaggtgcacactaccatgcccagctatttaaaaaaaaaaaaaattatgcagagatgagatctcactgtgttgctgctcttgaacacctggtctcaaatgattctcccctctcagcctctcaaagtgctggaattataggcatgagccactgcacctggcctaccacacagtctttattactcttaactatgtaagttttgaaattgagtagactaaatactcccactttcttctttttaaaaattgttcctttccctttcatataaattttagaataatcttgtctatagttacaaaatattttgctgggattttgataaggtttgcattaaacctatatatcaatttggaaagaattaatgtctttgttatgctgagtctcccagtccatgcacatgtttgtctctccaattatttaggccttctttaatttctttcaacagcattttttagttttcacaatgtaagtactgtatgttttgttacttgtacacctaagaatttcattttttgaacaattatatatgatatttcattattaattttaaggtacatatgttcattgctactatatagatatacaactgattaaagaaaatcaatgcttttttctgttgacttatgctatccactggaatattagttcttagatggcaggaatagtatccattttgttcagtgttgtatctccaatgcctcaaacactgtctggcacatagtaagtgctcagttcttattgaatgaatgaatgggatgccttttcatttattctaatcttatatccttcagaagcactttaaagttgtcttcatatagatgttgcacagttttgttaagttttttccagggattttaccttttggctattgtaaatggggccttctcttctataataaccttttactggctgttgtttgtctatataaaggatatagttttctgcatattaattgtataaccatctgtgtttttaaatattcttatttgttcgtaagaacttttcataattctcttgtgtttgccaaccatcactgttacttttcttaaaaatttctggagttcagtaattaaaaagattgaattacaaacacaaagaaaaacagcaaacaactaaatttcatttcatcagtgggattctgttcagttatgttgagtaagtaatggtatagctgtaaacctataccatttattttctaagataaataaatatggtgattaaggaaaaagtcaaattcagaaccatttccttcctcactagttagacatcatctgttgcctgtgctgcttgctaattgaaagagtgtacagtgctccctacaaggtcctcttaattgagggagtgatatttgcaatttaaatcacaaaagaaagaaatcatcagtacatattgacttgcccaagttccactgttttaccacagtgtttgttcagtaagccttgatatataagtgaactcatgcaaatgaatgcatctgtcttcatttcttctgtcttcgttagatcactatgcaaacattaaacaccaaaaagggtattaaatgattaattagccaagtggagacttcaggtgagccaaaagcaaactccaaaagcaggttcctttctctcctgaccacttctctcccaccccctacagaaacatccataaaagatttagtcaattcttctgggaccagagatacttattggcagttaccattcttgcgattcagcaaattttcttgcaagtatgttctatctttactcctgagttttgcctaatttatattccttctttggtctgctctgctcagctaaccctggtcgataagtacagcagattggctagaagacaaaattgtaaaatagatggtgcatttggaatctcaggccttcgctctacgttgttgcctggaccatcttctctgtggctgcttccctacaactcatgctgtatggtacagtggtctgtgacgttgcctctttgactaggctgtggcccatcttgaggataatggcctttgctttttccatctttgagttttattgtctggctcagagtaggcattcaatacgtgcttgaatcaatgaatgcacaaattactcaattaactggtgcaggaatattttctcaatttcacattattaaaattagctcttaggaaaacatttgaaatgtttttaaatgatagggtaattgacaagtatcagttgaaaaagtagccagatcgatgaatttatattttaataatgatgaaattaaactaaaataattgagcttttctagattttcaggattcagccggaagcccaggaagcacctgggttccttctggagaaaatgacattgtctgcctcccataaggctgtacccgtgcatcctattttatgcaggaagcatgtccttgaaaacttggagtagaaggaaaatttttatgaatagaaacttacttctcacatgcctggtgttagtattttagagttgcttcttcatgaaaattggatagacctttaagataagcacttaaaaaaaactatgcttccaactctacatgtaaagttctataatcagatgtctaaatatataggatactctgcatatttaaagaagatgcagagaatctttttgttggcaaaattgttgggcacattatatctctttaatatgaacggtcatcatctatgtcattttggttactttaattattaactttattttaaaaaaatttatacctagccttctgccagcaagggtttagagggattgtttattaaggtgatgtcttcaatatcagttgaatctacgtatgttttcatgagatttctggggtttgctttgttttgttttaagtagcacaagggaagtgcacacagtgatagaattttgttacagatgtttctggtaaatgatgtaaaaggtcctgtactttcatgcacttgacaagaattttcattcttgaatttcaatttttatttggtctgtcatacaaaatgtagtagatgaagctgacatcatacacgctcagactcctccttggcttctactttaaaagacgataatgacttatgtatacagtgtcatgagactgccatgaaaaggcaggattccagtgatggtatgctgggatgttaaagtcacaggagctggcaaactcaaaagccctgccttgaaggacattctctaggctgctgaggaaataagtagcctgccgtccccagccttcttcccccaagtactctgttctcctcactagatcagttgagatactgtttccttacctaatgtaatttcattttttcattggctagtaggataatgtactagcagcagcaatttaaaaacctttatgatacacatttataaatattttcaacattataaataactgtaattagggaaagggttaaggtgtgcaaataatctttttttaaatttcactttgaaagagcgagtttgtttttgcattttaatatgcgtctttgatgttctagaagttcattacccctgaaatgtgtaacttaatttaggagaagttggaaaattggacaatttccccatccctaccaagaaaatatatttgcagataggggaataacatcacagataattttaaaacagcatttatcctaattagcctctggaaggtaaatattgactctactcatttttatttttgaagggaaggatattcttacagttttcttaccttctgctctgactaaaatcaaaagagttgagttctatcttgctatatagatattatccccacaagatctgtgaaattttaaaatttcgtaagcagagaatgaaagatttatgtcagttacctggaaattctgaggatcaatcctgccttgccatactgtgacatattctgcaagaatgacatgaattgttacataagccatcatactttgtttttgaaagacaaagaaagtaaagtcaataatatttttctagaacctgtagaaagcactcttctcctttcagttggcttcctaacctgagacataccatgaacttggagtgtgccactgtgctatatatgttcgtattatcatctaaaattctgttctaattctgtactttacaatttttaattgttcccattggagttacaaggagagaaaccagagaatgtcacctgagaatggcagaaaataaagggtgaatattatttgtacataagacaatttggactattgtcaacctggagtgaataccccaccagtgcccattttcataacctctaatagaatatctgcctcagcattacctgcatgcacatctttatgaaatattcttcaaattacaatggaaggaggccataaatatcttttctcataaaagaaaaagtggaaagaacttctggggaggagaaatgacattggtgattctactctcattttaataaggcaaatgcttttcttttaacagaggaattcaagggctccacagtcgtcgagctgatgaagaaggaaggcactaccctgggtctgacggtatcgggaggaattgataaggatggcaagccaagagtatctaatctgcggcaaggaggaattgctgctaggtaactgcctcttggggaaatctactgaaaggaacacagggtgtaattaattcaaaaattaaagctccatcaaaagtggtcactaataaataaatgacagctgccatctgccaggcagcacaggccagcagaagcacagtggggcacgtttcagaagctgttccccaggtctgcccatgtggctgttctagcctaggctgcagtcccagggaggttcttgtgtcatctcaggagctgccaggccctcacaagattttaatttcaaaaagcctatgtgaatcttgtctgcaaatgtgccactgaacagcagacaagctgcagtgggaaggagacactccaatcatctaaatgtgaaacagatgacccatataatgtgaatggggaaaagtgccagagaggggacatggctaccctagaaagaatgggagacctaactctgagttttcagtgaaaattttgtttatctcacatcctctctccttttctacctgtgagattttaaagagttggtttccgaaaggacagaaggcttagaggaggaggtctcacctgtctttctttccatgaactgcaaattccactagttattgccaaaggcagaatgtcctggatactgggcaggggtgggcttccttgagatacattctaaatctgcctcagaaaaaggggacagaagatcaggtttcattaaaaatgaggccaggccgggcagtgactcatgcctgtaatcccagcacattgggaggccaaggcaggtgaatcacctgaggtcaggagttcgagaccagcttgaccaacatggtgaaacccatctctactaaaaaaatttaaaaaaaaaattaaaaaaaaaaagccaggtgtgatggcacatgcctgtaatcccagctacttgggaggctgaggcaggagaatcacttgaatccgcccaggaggcggaggttgcagtgaactaagactgtgccattgcactccagcctggacaacagcagcgaaactccatctcaaataaataaataaataaataagtaaaaataaaaaataaaagtgaggccaaagtaccttaaattctggccaccaatattcatatccacataattccaggttaaatctgagttcttgccccataaaatgtcatctgaagtggtgatttctgtgattaattttaatgatcaacctgtttgtacaatttataaacttaatccagtggattgcctccatgatcagaagttattgtttgtaagggaggctggtgtggacacaagcacctcaatctgctttctttaggcttttaagaagcatctttccacacccacaacctcctttattttataacaatcatggccagttcatgatgctaggggttcataagtctccagagcttctttatagctctcccttaaggcaagtgtgaatggaggaaagggtagcattttcagttgtattaattctgtaattaaaagtattactgtgccagttatattgagaattaaaaatcaccaaatagtcactgttaaaggcactaccattttgaaggtagtaaatcagaataattaaagatgagatccttgccctaaaggggctcacaatctattagtggagataaggcataaaaaacatgaaacatttgggagtaaaaatggcattgcatgatagcaaaaagcaacagcacagaagttattacagagcattaggcggttaagttgacataagtgtcaggaaagtgaggtaagggccatgcatgtactgcagactggagcagattaggaggctctttgaaggaggaatgattggagctggatttatatataaaataaatgcattagctatttctgttttgggagaaaatgttattgaaggtccttatcagtgacatgaattttaactcttattattggtcttgctacctgctcttggtttagaaacggagtttgactaaagtccaagagcagccaatattctgttatggtggtatagagagataagaatgttactgaaacccaatatttgcattgtgatttctccttcaccaatactcttcttatcaatcctgctgtaagcaataaatagcaaaataagctgaccctttccttagtcctggacaaactcccagtgaagttattgaaagaggtgaaatgtacaaaagggaggcagcaaaaacaagagggattgagaataaaaagacatgtgttgtgtctaggatctggatcccatcccagagaaccaactggtttagggcaaagaactgaaaaaaaaaaaaaaaaaaaaaaaagcttctcttgattttgttttatggtgcttttaaaaataaaacaggcaaaaaggaaaaaaatcagagatagtggcagaatcagagcaggacttccaaagtatcacaggctgcatgagtaaaagggatccctggctctcatctgacttcagctgtactcttacccttaagggcccaccgtctcctaggaggcagggacttctgctgtcagccttctaggcttgcttctacacttgcatgcttaccatgaagggaaagtggaaatatagtcagactggcctatggagagggtgggtctgttgaaacaacattgtctattttgcagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctgtaagtacagtagccccccttatccataggggatacattccaagacccccagtggatgcctaaaactgctcataataccaaaccctatatatatcaggtttttttctatacatacatacttatgataaagtttaattgataaatttggcacagtaagacattgacaacaataactggctgggcgcggtggctcacgtctataatcctagcactttgggaggctgaggcaggaggattgcttgagcccagtggttcgagaccagcctgggcaacatggcaaagccccacctctacaaaaaatagaaaaattagtcgggcatggtggtgcacacctgtagtcccagttactcaggaggttaaagtgggaggattgcttgagcccaagatgttgaggctgcagtgagacatgatcacgccactgccatccagcctgggggacatagcaaggccctgtctcaaaaaaacaaacacacacaacattaataaaatggaataattatatcaatatgccaatctcactactcttctgctttcagccattattaagtaaaataagggttccttgaacacaagtactgcaagggctaggcatggtggcatatgcctgtaatcccagaactttggaaggctgaggcgggaggatcacttgaagccaggagttgaagaccagcctgggcaacaaaatgagaccatgtttctaccaaaaaaagattagtcgggcatggtggcatatgcctgtagtcccagctacttgggaggctgaggcagaaggattccttgagcccagaaggtcgaggctgcagtgagctatgattgtgtcattgcactccagcctaggtgacagagcaaaaccctgtttaaaaaaaaaaaaaaaaaagtacagcaagaacacaacagccaatctgataccaaagatggctgcaaagtgactaaggcaggtagtgtaaacagcgtgaatgtgccagacatccagatggatagagcagacaatgtgagattatcatcacactactcctaacagcacacaatttaaaacagggatggtttatttctggaattgtctacttaatattttcagactgcagttaattggaggtaactgaaaccacagaaaataaaactgcagataaggaggaattgctataatcataacgcagaggaagaacagcggcaccagtttttccaaagcaaaatcagcttctgaattttttccctttgccatcaatatctcattacaggaatggcaaagccaactttcttagtatttaaaaattatttgaattggaaaacttacaacctactcaggaagaatttaaaaaggcatcactaacaatgaaattatgaagggcccatgttctgtttgccacctaagccattttaattcaacatgtttgtaagttctgtgcaataagtaccatccaggttttgtacttagtgactaggtttaggaaaagcatatttagtatgttttatattagttctttatggatacattaatttcttttttaatttttaatttctgtgggtacatagtaggtatacatatatatatatatatgatatatccatttctgaagcatgaaaatagcttcagaacacatattgtcaagtagtaataatagtaattataacagcagtagccaacagattttgattgtaccaaatgtctggcattacaaagaacttgacttgcattgaattatttaatcctttccacaaggagtgtcagcatagcagagatgaactttagtatcaaatagacaggttcaaatcccagctccacattttactagctacatgcctttgagaaagttacttacactttctatgtcttagtttccacatctgtaaaatgcgaatattattagttcctactcatagatttgttatgaggattaattaagttagtatttggaaaacatttagaatagtgcctggcactatcaaagttttcaataaaaaggcaatcaacactacaagataggcatttttttttctcattttacaaagcctggattcaatatctgaatccaggctgccagactccaaagtccatatgcatattcattgtgaggtatactgatatatgactgctgcccagtgtttatgctgttctagcaccacctctcctattattagctatgaacatggatgctaccctgagatagctttttgctcttccatactaatgagaactcaggttgattatgaagagttggtagaattcatttgttcagcaatgacttattgagcatttactatgttccagccaccactatgtactaggagcttggggaacatgagtagagtttatattgtagcagaagacagataataaaataaaaccataataaataattatacagtatgaatactatgaatgctatgcgaaaaagcagtgcaaggagagggattgagagtgctgggatcagggtgggaatacaattgcaaatagggtggttaggacagcatcattgagaatgtgagattagtcaatgacttgtgaaggaggtgagggagttggttgtatggatttctgggggaaaagagttcccggaagaatgaacagtcattgctaagaccaaaagccaggaatatacttacggttgttatagaaacattaaggaggacagtgtggctatagcagaatgagcagtaagagaattaggaaatggggtcagaaatgtaagggggtggggtatcactataggccactgggaggaccttaagtttttctctgaatgatacaggaagtcactatatggtttggggcagaggagtgacatgatgtgatttgttttcagaggctctctggctgctgtgttgacaacagactgtaagagaccagggtagaagctgggagatgagctggagggcagttacagtgatccatgtgagagatggcagtggagacagtgaaaagcagtcagattccagatctgttctgaagggagagcctacaggattacctaatggatttgtgagttgtgcagaaaaagaggagtcaaagttaaccccaaggttttgagcatgagcagctggaaggacagagtatccgttaacaggaatggataagaatgtgggcagagctgatttgtgagggaaagatcagcagttcatggcttgaaatactacatttgaggtgcctatttgacatgcaagaggaaatgtcaagacctgaagatatgatttggagtttgagagaaagatctgtactgtaaatatacatttgagagtaatgggaatatagatggtgttcgaagcttggggatcagattccagtactcaggaaacatgtgcataatcagtcacaagttcgtattcttcacataaagtctaacaccaaagatttagtagtcattttgtaacaaaatcaatttaagactatgttcacaaaccttgctacaacattttttcgttttcagcaagactaggcaataaaatagagtgtaaaggcttagactgtgtcagcagttacatggcagctttgctcatttctgtctttgtgaccttgggcatgttatttaaattctctgagccttcagtttctaatctataaaatagctatagtagttgcaggatttttgtaatgattaaatgttataatcacatgatcattattgagaccattatcaaacactttgtaagtaactaataacattagccttattaccattattacattattatactgaaagtactgtgtttttttttttaactttaaatgagtcagtttgctttgaaattactctctcaaaccattgccaaagacataagagaaaccagttatctagagctaatgctctttgattatacatctgtattcctctggggatatgaatatcaataaaacacaaccccttcctaaaagaaactctaagtatagcttttaggcaaaggctaatagtgaagatttgtccagtgttgtgggtgattcagagctaggcgtttccaggaagacttaaaggaggtcatgctagccaggtgggaagaggaatatttcagacaaagggtgcagcgcgaagggaagatgacagcccagcccacagttaaactacaaacagatagggaaagacagagagggggctaggtgtggtggctgatgcctgtaatcccagcactttgggaggccaaggcagatggatcacttgagttcaggagctcgagaccagcctggccaacatggtgaaaccctgtatctactaaaaacacaaaaattagccaggcatggtggtgggcgccagtaatcccagctatttgggaggctgaggcaggagaatcacttgaacctgggaggcagaggttgtggtgagccgagattatgccactgcactccagcctgggcaacagagcaagactccatctcaaaaagagagagagagagaaggaagaatggacagaaggaaggaagggaggaagggaagagagaaagagggagaaagacggagaaggagggacaaagaaagagggggcttggagatagatgaggccaatgaggtacacgaggaccaaatgagaatttaaatagtgtataatatggccttataagccatattgttggagcttggcatccagtgggccgtgaggagcccttaaaggagaacagcatcataagatctgagtatttagatttatcattgtaggaggcaaaatagagaaaagaccagaggctacaagcccaaagactgttaggattttccaaaagagaagtgatatcctaaataaaaatagcattagtagagttaaaggagatgagtatcagaaatgtttaggagttaaaacctatcgtgacttggtcattatgcagtaccatctttttccctgtcatacaataaagctgatggaaaaggggcaaaatatttttaaacacaaaagtgtgaattgttgtgacggaaatcaaaaggggtctattctccaagaataatctgtctctttctactatatttgaagaaagtaatcggatacttgagttgagagtggttgaaggaattaataagttcccctttcacttagctcagacagctagagcagaaacaggccatccacacctgaaggtccataaggagaactgactgctaaaagacaagcgacccaaggccaagactggtagctatctcaggatcacagcagtttgagtctcagctaaccacagagttcagaaagaatcagaaaagagagagagagagagagtgtgtgtatgtgtgtgtgtgtgtgagtgtgtgtgtgtgtgtgtgtgtaatctgatagaagaaaactggtttgaccttggccctttctaagattcagtttctttatgaaaataaaatgattggtctatataagctctaaagctctttctgactttaaaattatgtgattctttgagactgtgtttagagagaatattaccaacctgtatcttagatatttatgtatttttgtttgtttgttttgagatggagtttcgctcttgtcacccaggccggagtgcagtggcacaatctcggctcactgcaacctccacctctcagattcaagcaattctcctgcctcagcctcctgagtagctgggattacaggtgcccaccattatgtccggctaatttttatatttgtagtagagatggggttttaccacattgaccaggctggtctcaaactcctgacctcaggtgatcacctgcctcagcctcctaaagtgctgggattacaggcatgagccaccacgcccggcctgatatttatgtattaaaagctggtctaggccagctgtggtggcttacacctgtaatcctagcactttgggaggctgaggcaggaggatcccttgagcccaggagtttaagaccaccctgggcaacatagaaagaccctgtctcaattaaaaataaataaataataaaaataaaaatttggtctagagcagtgccttcaaattttttggtcacttaactcttaaagaattttgaaatgttacataattctcatccatttttagttaacacctaaaattatcataagcatgaatagttagaaaggatgcaattcctagcatattgtttgttttatctgtctttagattctgttttcatgcaaaccttggagctacaggtttacttcatttaatgaaaaacagtctgccctataatctgattggcaaaggcactcttcactgttactccattagctaactcacatgacctttctatcctaaggagtcatttttaactcaaataaatgtgttaaagcatgtccctttgacagccttctgacttctcagttctaaaatagacagatgatggtggtggtggtggtggtggtggtgaagtggaggaggagagagggagaaagagtctcaggtctcctccatgtgatttactctgggattcagtttgagggagcagcagctacctggaggacgctcttcttgtggcaatggcagagggaaaacagggcaagcacaaccatgtaagtgcaattccagcctctgcttgtgtctgttaacatcctagtggcaaaagtaagtcacatgggcaagtgcagcataatgaggtaggaaagttcacaactcctattgagacagggaatagggaggcagggaaggagtttgtaatttcaaaaacctcatctaccataggaaaataactgtgtagaagtacatgaatatccacatgtagaaagaagggacaacagcacaattgaaagaccgaggagaatttttgcattgtgaatttggtttctacctactttttgatcttttgggtaagcaccttaattggaactttgtgtatacatacatatgtatgagtcattagtaaaatttacatggcaatgcaggatgtctggtactgcacgtgaaaacccaatcatgaagagccagccatgcaaataaaaacaagaaagaccaaatctatttcattaattgtattaaaacgcagtcaacattcaaatttatctttgtaaatgatggagaacaatagcgtagataatctaaagctgtagaaaatacagagcctttatattgactttaaatttgattgtaagattttatagtcagcaagatttagctacagcaaaatcaaaattgcagtactttgcattcccataacagatacccagccaaaaaggacaggtggcccagaattagaattcaattatatgtcattgaaagctgatttattgagtaaatgaaataatatgtgtaaaccatttttgcagagttctgagcacacagtaaattcttattaattatttctttccatatcctttcctttcctcacttaccaagagaacaaaaaaaaaatcattttcttaaccaatttcttcaagtggcttgttgggccatggaaataagaaaatatttggaatgaactcaattttttttgtttaattaaaactgtacctcaacactttcatctgtttgtgagtactgttcctagttgattagtctaagctgaaattcccctgatagcaagaatatgacatttaattaaatcagcagtataccaaaacatttttgaactgtaggtttatgttgtttttcagccgatccaaatttttattgtactttatgtcccagccagatagtggacagttttatgaatttaaatgtgtacttttcttaatcatgtttcttcccttgagggttcagaatttctgataattaaaaataattgtaattaaagcctaaaactacttgctatttctgtaagaaaagtttttttaaacaatgcctttggattctgcctgtgtgtgtatatatatgtatatatgtatatgtatgtgtgtgtgtgtgtatatatatatatatatatatatatatatatatatatatatatatatatattttttttttttttttttgagacagagtctcactctgtcacccaggctggagtgcagtggcacgatctcagctcactgcaacctccgcccccgcgggttcaagtgattctcctgcctcagcctccaaagtagctgggattacaggcatcttccaccacgcccagctgatttttgcatttttagtagagatgaggtttcacgatcttagccaggctggccttgaattcctgaccttgtgatccacccgccttggcatcccaaagtgctgggattacaggcgtgagccaccgcgcctggcctgactgtatactttttgctgatagttttatctaataaacccttcaggatctagtagcaatgtaaaaaaatgtgttacttggtaatgaacatggtattaactaggtacaaattcaaaataaagatctaaaattctcctacacattacaagtctctatgaataaaaacatttctctgtgcataatgataaaataccagtttgtggaagttttatgggtttttttatgcagaaatggtgtatatagtacaactagaatgactcaacaggttcttgtaagcaatcttacagaatattttagtaaatgtaccttcatataccttataccatcatacatgtatgtaatgtgactagagattgcagcttgacaatacaattccattttgttaaatgaaagtgataatcatgcaaacacaacataagcataatatatcaagtaaaattaagtcaatctgtagtttcttagatagtagtagtattttaaatgcacttagaatttcttttgccctctaagtttcatctgggttgctgtgtcttagtttaatagctatttatatgtcagaacatctattagcatcagcctaattgttgatagcaatctgagaatgataatttttcttcctgtgccagctgcaaaataaaaataaatacagaagttattgtacaagtgttacaaaaatattgtttttgcattttacaaaaggaaaacaattctacttatataaatattgtctctcttgttaggtagagtttaaacaatgtaaatatccccctcttatctagaaacgaactatatagaaggaaatgagctagctatgattttgtttccacttgtatctatatgagtcacttatacagatgactgttttatggtatttttatgtcattacagttttttaaacattttctttgaaaaggaattgttgcttattactcaaaacttatttgcaacagggatctgtaatattttatgccacattgaatgatttagaaatgttatgatgacttacaagttatatttccttctctctttcctttattcagctgtgcaaggatcaagtgttattttccgaacagtggaggtcacattacataaagaaggcaatacctttggttttgtaattcgaggtaggtgttggttagaaaaatctactttaaaaaaaatatttccataggttttcagagaacaggtggtatttgggtatttggttacatgaataagttatttagtggtgatttgtgagattttggtgcacccacgacccgagcagtatacactgaacccaatttgtagccttttattcctcagccccctccccctttccccgagtcctgaaagtcccttgtatctttcttatgcctttgcattctcatagcttagctcctacttacgagtgagaacatacgatatttgattttcctttcctgagttacttcacttaaaataatggtctccaattccatccagattgctgcaaattccattaattcattcctttttatggctgagtagtattctattgtatatgtataccagtttctttatccactagttgattgatgggtatttgggctggttccatatttttgcaattgcaaatcgtgctgctgtaaatatgcatgtgcaagtatcttttttgtattatgacttcttttcctctggtagatatccagttgtggaattgctggatcaaatgatagttctactttttgttctttaaggatccccacactgttttctatagtggttgtactagtttacattccctccagcagtgtagaagtgttcccttttcactgcatccacgtcaacatttttttttttattttttgattatggccactcttgcaggaataaggtggtaccacattgtggttttgatttgcatttccctgatcattagtgatgttgagcattttttcatatgtttgttggccatttttatatcttcttttgagaattgtctattcatgtccttagcccactttttgatgggattgtttggttttttcttgctaatttctttgagttccctacagattctggatattagtcctttgttggatgtattggttgtaaagattttctctcactctctgggttagaaaaatcttctcttctttaaataaacgcaacattgaatgataataaaactggaaaccatatgtagctctatttttggttcattaatacagagcaaaaagccaatgtttataaaccttgtcaattcagtcatcctatacttttcaacatgtcttttgtctttccttttatatttttcgatatcactgaaaaatgttgattagtatgcttgatttgatttaatacactaggattaagggactttatttaaataaatttctccagaaacacatttggttattgtagctttctaaaaatggatcgaagattctaatctcttgggtatctatgtgcttcagctcaagtcatcatattatagtatggcattgataataacaatttcaggtgactccaacttatcataaaactactaattctaggccgggcacagtgactcacgcctgtaatcccagcactttgggaggccgaggcaggcagataatgaggtcaggagatcgagaccatcctggctaacacggtgaaaccccatctctactgaaaaaatacaaaaacattagccgggcgtggtggcaggcgcctgtagtcccagctactcaggaggctgaggcaggagaatggtgtgaacccgggaggtggagcttgcagtgagcccagatcgtgccactgcactccagcctgggtgatagagccagactccatctcaaaaaaaaaaaaaaaaaacctactaattctaaagtataattctatcttgcattatattttctcattagtaattttattccttaaagactgtgcctacattaacaactctcaactcataggatgacaatgagcttcaatagggagctatataaacatcagggattttttttctttccaacttctatcttaggttcaaggggtacatgttcaggtttgttacatgggggaattgcatgtcatgggggcttggggtacagataattttgtcatccaagtaatcatcatcatactcaatcagtttttcaatcctcatcctcctcctcctcccaccctccaacctccaccctcaaataggcctcagtgtctgttgttcccttctttgtgtccatgtgtactcaatgcttagcacccacttataagtgagaacatgcagtatttggttttccacagtcagaaatttttttttaattttgttattattatactttaagttttagggtacatgtgcacaatgtacaggtttgttacatatgtatacatgtgccatgttggtgtgctgcatccattaacttgtcatttagcattaggtatatctcctaatgctatccctcccccatccccacaccccacaacactccccggagtgtgatgttccccttcctgtgtccatgttctcattgttcaattcccacctatgagtgagaacatgcagtgtttggttttttgtccttgcgatagtttgctgagaatgatggtttccagtttcatccatgtccctataaaggacatgaactcatcattttttatggctgcatagtattccatggtgtatatgtgccacattttcttaatccagtctatcattgttggacatttgggttggttccaagtctttgctatcgtgaatagtgccgcaataaacatacgtgtgcatgtgtctttatagcagcatgatttataatcctttgggtatatacccagtaatgggatggctaggtcaaatggtatttctagttctagatccctgaggaatcgccacactgacttccacaatggttgaactagtttacagtcccaccaacagtgtaaaaatgttcctatttctccacatcctctccagcacctgttgttacctgactttttaatgatcgccattctaactggtatgagatggtatctccttctggttttgatttgcatttctctgatggccagtgatgatgagcatttcttcatgtgttttttggctgcgtaaatgtcttcttttgagaagtgtctgttcatatccttcacccactttttgatggggttgtttttttcttgtaaatttgtttgagttcattgtagattctggatattagctctttgtcagatgagtagattgcaaaaattctctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatgatattgcctaggttttcttctagggtttttattgttttaggtctaacatttaagtctttaatccatcttgaattaatttttgtataaggtgtaaggaagggatccagtttcagctttctacatatggctagccagttttcccagcaccatttattaaatagggaatcctttccccatttcttgttttagtcaggtttgtcaaagatcagatggttgtagacatgcagcattatttctgagggctctgttctgttccattgatctatatctgtgtttttgtaccagtaccatgctgttttggttactgtagccttgtagtatagtttgaagtcaggtagcttgatgcctccagctttgtttttttggcttaggattgacttggcaatgcaggctcttttttggttccatatgaactttaaagtagttttttccaattctgtgaagaaagtcattggtagcttgttggggatggcattgaatctataaattaccttgggcagtatggccattttcacgttgattcttcctatcgatgagtatggaatgttcttccatttgtttgtatcctcttttatttcattgagcagtggtttgtagttctccttgaagaggtccttcacaacccttgtaagttggattcctaggtattttattctctttgaagcaattgtgaatgggagttaactcatgatttggctctctgtttgtctgttattggtgtataagaatgcttgtgatttttgtacattgattttgtatcctgagactttgctgaagttgcttatcagcttaaggagattttgggctgagacgatggggttttctagatatacaatcacatcatctgcaaacagggacaatttgacttcctcttttcctaattgaataccctttatttccttctcctgcctaattgccctggccagaacttccaacactacgtttaataggagtggtgagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagtgttgttgaattttgtcaaaggccttttctgcatctattgagataatcatgtggtttttgtctttggttctgtttatatgctggattacatttattgatttgtgtagattcaaccagccttgcatcccagggatgaagcccacttgatcatggtggataagctttttgatgtgctgctggatttggtttgccagtattttattgaggatttttgcatcaatgttcatcaagcatattggtctaaaattctcttttttggttgtgtctctgccaggctttggtatcaggataatgcaaacctcataaattgagttagggaggattccctctttttctattgattggaataatttcagaaggaatggcaccagctcctccttgtagctttggtagaattcggctgtgaattcatctgttcctggactttttttggttggtaagctactgattattgccacaatttcagagcctgttattggtctattcagagattcaacttcttcctggtttagtcttgggagggtgtatgtgtcgaggaatgtatccatttcttctagattttctagtttatttgcgtagaggtatttgtagtattctctgatggtagtttgtatttctttgggatcagtggtgatatcccctttatcattttttattgcatctatttgattcttctctctattcttctttattagtcttgctagtggtctatcaattttgttgatcttttcaaaaaaccagctcctggattcattaatttttttgaagagttttttgtgtctctatttccgtcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttgtttctgccttcatttcgttatgtacccagtagtcattcaggagcaggttgttcagtttccatgtagttgagtggttttgagtgagtttcttaatcctgagttctagtttgattgcactgtagtctgagggacagtttgttataatttgtgttcttttacatttgctgaggggtgctttacttccaactatgtggtcaattttggaataggtgcagtgtggtgctgaaaaaaatgtatattctgttgatttggggtggagagttctgtagatgtctattaggtccacttggtgcagagctgagttcaattcctgggtatccttgttaactttctgtctcgttgatctgtctaatgttgacagtggggtgttaagtctcccattattattgtgtgggagtctaagtctctttgtaggtcactaaggacttgctttatgaatctgggtgctcctgtattgggtgtatatatatttaggatagttagctcttcttgttgaattgatccctttaccattatgtaatggccttctttgtctcttttgatctttgttggtttaaagtctgtttaatcagagactaggattgcaacccctgcctttttttgttttctgtttgcttggtagatcttcctccatccctttattttgagcctatgtgtgtctctgcatgtgagatgggtttcctgaatacagcacactgatgggtcttgactctttatccaatttgccagtctgtgtcttctaattggagcttttagcccatttacatttaaagttaaattgttatgtgtgaatttggtcctgtcattatgatgttagctggtgattttgctcgttagttgatgcagtttcttcctagtctcgatggtctttacattttggcatgtttttgcagcggctggtaccagttgttcctttccatgtttagtgcttccttcaggagttcttttagggcaggcctggtggtgacaaaatctctcagcatttgcttgtctgtaaagtattttatttctccttcacttatgaagcttagtttggctggatatgaaattctgggttgaaaattattttctttaagaatgttgaatattggcccccactctcttctggcttgtagagcttctgccaagagatcagctgttaatctgatgggcttccctttgtgggtaacccgacctttctctctggctgcctttaacattttttccttcatttcaactttggtgaatctgacaattatgtgtcttggagttgctcttctcgaggagtatctttgtggtgttctctgtatttcctgaatctgaatgttggcctgccttgctagattggggaagttctcctggataatatcctgcagagtgttttcccacttgattccattctccccatcactttcaggtacaccagtcagacgtagatttggtcttttcacatagtcccatatttcttggaggctttgtttgtttctttttattcttttttctctgaatttcccttcttgcttcatttcattcatttcatcttccatcactgatactctttcttccagttgagcgcatcggctcctgaggcttctgcattcttcacatagttctcaagccttggctttcagctccatcagctcctttaaggacttctctgcattggttattctaggtatccattcgtctaattttttttcaaagtttttaacttctttgccattggtttgaatttcctcctgtagttcagagtagtttgatcgtctgaagtcttcttctctcaacttgtcattctccatccagctctgttccattgctggtgaggagctgcgttcctttggaagaggagaggcactctgctttttagagtttccagtttttctgctctgttttttccccatctttgtggttttatctacttttggtctttgatgatggtgacgtacagatgtgtttttggtgtggatgtcctttctctttgttagttttccttctaacagacaggaccctcagctgcaggtctgttggagtttgctagaggtccgctccaaaccctgtttgcctgggtatcagcagcggtggccgcagaacagcggtggctgtagaacagcagtggctgtagaacagcggatattggtgatccgcaaatgctgctgcctgatcgttcctctggaagttttgtctaagaggagtacccggccgtgtgaggtgtcagtctgcccctatttgggggtgcctcccagttagtctgctcgggggtcagggacccacttgaggaggcagtttgcctgttctcagatctacagctgcatgctgggagaaccactactctcttcaaagctgtcagacagggacatttaagtctgcagaggttactgctgtctttttgtttgtctgtgccctgccccgagaggtggatcctacagaggcaggcaggcctccttgagctgtggtgggctccgcccagtttgagcttcccagctgctttgtttacctaatcaatcctgggcaatggcaggcaccctcccccagcctcactgccgccttgcagtttgatctcagactgctgtgctagcaatcagcgagactccatgggcgtaggaccctccaagccaggtacgggatataatctcctggtgtgctgttttttaagcccgttggaaaagctcagtattagggtgggagtgacccgattttccaggtgccgtctgtcacccctttctttgactaggaaagggaactccctgaccccttgcacttcccgagtgaggcattgcctcaccctgctttggctcgcgcccggtgcgctgcacccactgtcctgcacccactgtctggcactccctagtgagatgaacctggtacctcagatggaaatgcagaaatcacccgtcttctgcgtcactcacgctgggagctgtagactggagctgttcctatttggccacttggctccaccaggaatgttttaacagttcacatttcttgattgtttttgtcttcacctataagattttatacttcaccagagtaaaaattctatcaaaattattaaaacattaattaaaattaaacatcttaataaatatgtatgcatcaaagaataaaagagatgtggataaacttgtacagatttggatttgtcttaagtgattgagttttaaatagtagctttcattttgtgccagtcacttaacaaatcaatcaatcaaatgtttattaagcacatgtcaacatgtcagcatggaaagaagtactatggagtcataagacaataccttgatctacaaggaattacagtccagtgaatttaagacaaaagttgatagagtgctcaagtgagtagtagagaggatgtggaactaggaactcattgagaggtttagacttgtagttattacatttttctgaccaaggcctatttttaggtggagcaacagagcccaagatcatttaccctaaccattcctaaatttctgtttaaaataactagatgaatatagtgaaaagtcactgtacaagtaatttttggctgaagggtgatatatacaaatctgttttgcaatacagatctgaacgagaaggttcttgaatcacatgcatacatagcctaattattgaaacactgtaccaaaatatactgctgttgcagatattcattgatagtgactgtatggttagtcaatagcgaatcaaattactaatgaaagagctaaaccaagagtaatttattatcaagaaataaacagaatagaagcaactgaaatgcacaaccacctcaagacaactgatgatgtaatgttagtaaaacacccttcccacagtttgcaggaatttccactatctgtgtgtatatccaggagttttataatgtgagcttagaatactgcctggtatgtggaggcacttaataagtgaatgattgaatgttgcctagatttgtgtggacatcagacttcatagtattatactgattttaaaaaacttaagttacaataagccagtattagtttatgaggaccgcatttttataggccttaataactcccttaatatgttggttgaacataaaagtttttggagttttgaataatttctcaatgagaatcaaatataggatttctgtttttagattagttagaggtccatctggaggattttccctgttcaaaaggtggtcactacccatcacttaagaatcactggttaatcagaatgagaaagtgctgtgagtaaatattagtatggcagataagatattttggcatagatgggagttgagctaaacttagatcaatagaaaatactaggacagtcaggaaagagaagatattgcagatggagcatatctgtttagtatgggagaagttctaacctaatagaatggaacttgcaacattaagcttttagctgatgaatggaattatatttctaatgctataagtcacaggttctaaaacctttattccctaaacaatagaagcttgcatccatagaataaaaatgatgttctggcctaaaccttggagggttaaatttcagttaatgcaagcaagccagaagagatgagttggactgataggaaaggcactctgccatgaagttgctttacactttagacaaggaaaccttctctagtaattctcaaatgtaaaattgtaggtgggcctagtcatttaacatatgctgcttgatgttcagatttggtctgcactgtggccctggcattgatattttcaaaaagcatcccagttgatactaatgtacaccaggattgagaatatcactggtctctgagtggttcctgtttggccttgctgctgcaaacttccagaacctaagtaagtcacacagggaacttggttcattacaaataacagtaaaatgccacatatcaagaaatataaaactacctcacactttaacaagcattcgatattacatattgaaatttgtaaatacaaaccaaaattatggaacgatttcttgctatctttgacccccatccttttctcaatcagttttcctttagggaaaagcaaacctatcctttatgatcaccttgcaaaagagaaattatgtaacagtatttacataaatatgggcaagcatttgtggtaacatttaaaatttttattttaaaatttttttctgagaaagtggtgaatttcttattttaaagaggaatttctaaagaagctaaacacaatgcaagaataaaatactgaatgagagcttttaccaatcaatcacactaaacaaatcacttgtcgtagaagtgagcacaaaagaagcatttgccttcctgaggaactgtgaatgccttttaatttttctcttaggctattttctataagttgacctttcggcctatgccaggtttgggaaatgtccatctgttctagcaggcaaacattaagggagcaataattgacaataggtttatatttatcagatattggcaaactagaaaactcccagatggacagtcaggatggtgatgtgcaaagaaatcaggtcacataaagaatagataaggaaactggcattgttcaacattaagaaggtgagatttagccagcgtataatctctgttttcaactttcggaaaagcatttttgtaaaagagagcatacatttttattttactgctctggatcatagaacaaagacgagtggatgaaagttaaaggaaaagagatatcagttaaatattaggaagaactttctaacactccttggtgtccaaatgtggagtgagcagcctcacatctagtaagtaggccagcacgcgtgcatttcatgcagacgctgggggagcacagattaaggaaattgtacaaaagggtcatggattaaaaagaaaatttacaataaattaccttccatcttgaaacatctatgtttctatgaattcttgtggagaagttttctaacagaaagttaaaattcccattcaaggattgcagctggcttgacacagtctgaaaattttgccccaaatttttgaacatctcacttttaatgaaagccacttggtcacttgaatttttttttttggctttcttttttagtactaggatttttcttttactttggtttttgtttcctttatgttaggttgtagacctactgaccagtattttagatcagtttgattggcacagatatacacatctgtactgtataactgacagctgttcaaatcgggccagtacttgatataatcggttgattctcttgccattccagttgttaaatactttatatattacctggttacagccatatatttattgaaagatggagaaatggtgacttcaaaaatatattctatataaaatgagcaagacctttaaggcttttgtatgcctcaaggaaaattttacatattttcctccgtacatcaagtaggacatttctcagctgatatcttgtaggtgattttttttaaatgccaacaatgaaagcagttttaagctctgttccttttctttgctagggggagcacatgatgatagaaataaatctcgtccagttgtgataacatgtgttcgtcctggagggcctgctgacaggtaaactttatctttctgtgtcactatccaaaatagaataaataaagctggggactttaacatagaagttgataaattagaaattttacagtaaaatgtagctattaagcaaacatgttacaatgtgaaaattgagagtctgaactatggaatcagaaaaaaaaaaggtttgcctctagattctatacttactatatctttgtcaagtgacttaatactgaggtcaatttccaccaccattggaaatgtaggtaataataccacctttcagagctgatcagttttatcaaagattggagatatataatgccttgcagggggcatggcacaggggaggtacttacagaactcagcatttaggcagatgctggaaatgcatcttcgcctgttgctaatctcccagcctggacagataggtggtggtggtgagattcttaccattctcaacattcttattattagtgttattctttgatagtgactgtgtaggtcagaatggaagtgactttccgtaaaatggaagacatttcattagtctgtagagttttctttgcatttctcttccttgttaatttgaatatgtgaagggcaaatgccttcaactttcctgttataattagggccccgagtaaactcacaacttaggtgtctctggagatactcatctctgtattagtttcccacagcaaaagttgactctataatgatgggggaacacaactgctgccattagagattgttgaaggggaggaggaaaatgcactgattcctcctgtctctctgtttcagaccaggataaacttaaaaacctttgttaagagatagagataataataataataaccattatttattaagcatttactacgtgctagggactgttctgagggcttggtggacattatcttattttatccttacaaccaccctctacatgaggtctttgtatccacatttacagatgacagaactgccagtatggcagtgagtaagtcaaagaactgcgggaggaattcaggcttcttttcctttgaaactcatatgattagctcacttttaagaaagtgatatttcatataaaattagaaaataggaaaacactggtttcttacttttgctgacgtatatttgcttttgcagcgggtaacaaaatgtccaagagtttccccttttcccttctcatgtgtctagtgaatcactcttcctgaagcaaattagaatgttttcatttcttattaacatttagagttggagttgacagaaatgtcaaaacataggctacgagcttgtgagtggcatacttgtattaccaaattaatttagaactcaaagaaatctgagaatttaagaaaaaaattggagccaaaagacttagagagtgaactaggtgaaacatttttatttcaaaggtcattattattctttccaaatcctaaacatataatcccaccatttgattttcttatttttgtgcccctccctgaggcagggagtgttatctgggggccaccctggctgtacttttgtggtgtcactgaagtcctgagtcatctctcaatgccttgagtgtctgtggtcacagcagggaggatagcatttgccttcctcttccagggaatgtgagatcgaatcaattgaattattgccaaatggccttataaatcagtagggaaatttatagacaagggagatttcttaccagcagttcctatcctgcttggattcactagtaatgatttgaatgaaattcgcaggcttttctgcttacctgactttgggaaaataggtgaatagtattttctggcctccaataaatccattttagacattcaggcaaaaacctagaaaaagggaaaatgtgcccttcttacttttgtactccaagaattacctgtgggtaattaggtttttttgctaatgtgtagttattttctcattactgattttcatattacagcaattttctgttcagggttacttctttatactcttactgtcacatttgatgcttaaaaagaatgcaaatgagatggatggcagaatatgtgtgacaaaacgaatttggctaaagtgactattaatactaagccccattatgctaaattaatcaagactattcctttattctcccttcagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatgggtatgttggggtcctgagggtgtgatctctaagcaccagaacgtcactgtctgtccctgataaaccatgttggattaagtatgtattgtcatgccctcctggagcagacagaattcataaatactatatcattttactctgtttgagttcaggaatatgtgagtggctgtactttacagtgatgtagagttctcatgtcaataggttccataatagagtctcattctgtcagtgtttcacctagcaatcagctcttctatgtggattaccctttggcagcaaagtgttttttcccctccaaatcacaaaaatagtattattaacttaaggactggtactttttttttttattattacatagagactgacagcagtaggtgattcctttccttcttgtaacttcacagtacaaagccagctaatcaaaataatagaaacgaccatttatttcacaatcagatttagggataagaaaaataaaggagatgtagtatcattgattaaaataaaaacttgagtgcagttttctttttttaaattatgattctactagaaagaaactatttctacactcatacctatagtaaaaccgacaagatattctcatgtggatcttaaatgttaagagagccaacgtcttgtgtaatgttgactaaggcagaaaaattataagagaatgaattggaacttgaaattgaaacttaaatcatgctgtgagtaaaccttacaattatcagactcgattaggtgacctgactttaccagctagttttatgttgtgaaatgtagctgagaaaaagaggcttactctataactgcatactcctttatttctcacactgtatgactcatatataacaatgtcatacaagactattcttaatctgtctgctggcctgaaatgtctggagactatgaggtttcctaatgggaaagtatgaaacttaaggagtttttagaaggataaatgatgtggtatgcccttgacatggaaagttcacaaatgaatatcgcctcccttactttccaccttgcttttttcctctctcctttcttctctccatccttccttccttcctttctttctctcttctttttgttatatgttttattttaattagatgttgagttagatgatttgggttctgttttcaactctactaatttctagatattaatttggagcacatgatttgatttccctgtgccttatttgtcaaatggggactagcatccctattttaaagacaattatgaagataaaatcagattacataagtagggtatattttaaatgatgagacaagtggattgttaacattaaaaattgaagcaggtatttgacatctaactcatgtattcagtctacaaacatttattgaactaaatggcagggaccaggaagaaggtgaacaaaatagacctggtccctgctcttatgaagcttgcaatggataggaaaaacagacagtaaacaagaatattaccaaacaaataaactcataaagtgtgatcgttgccataaaggacaagaacagtattctgtaatagggaataagggcaggcacaggtgagggttggcaggtgatttaaatagagcagtcagtgaagaggtaacaggttaaaacccaaaggcttagaaggaaccagctcccagactgaagacaatagtctctgtaaggctgcagcattccacatcagagagacaaggtctcatccactgggatagataccattttagggaagagccctccaagtttcactattgccagggtcaggagggaatggggtgtccctacctgtttgccttctttgcaactcactctcacattctgaatgaaacctgacagttttcacaccctagagttcctagtcagctccttataggagaaagtgggccatcaggaaggaaactcattttaagagttcctcaaggttgctgaatataagatcattatacaaaaaatcagtttcctttctgtatatcagccaaaacagaaagttaaaattttaaggtatcctttataatagcaataaaattataaggttccaaaaggaataaaccttatagaagttacatgaacccattatagatatagatatgcatatgcatatacagatgcataaaagaatacttaaatacataaagacctatattatgatcttggaggggaagctttaatagctaaaatatgtcatttctcccaaatgtatcaacaaatttaattctatttaaaatcgcaaaaaaagcatctttgaggttacccgaataagctgtttctaaaatgtacatgaagttagaaaaggaagcagggaaaaatagtcaaaatatttttgaaacaatctgaagacagagaatattgttctacccaatatcaagactcattctaaaattgtggccttaagtctatctgatattaacatgggataataaagagaccagtagaagaggataaaatgcctgaaacagaccactgtccatatggaaccagaggtatagtcaaacatcagtgaagaaatgttcaactaataagtaaatgatgctgggacaattagccacttggggaaaattaaattcctacttcatattacacccaaaaataaattctatatttacttaaccatttcccagtagattgctattataaataactaaaaagaatatctttctacctaaatgtttgtctgtatttctcatttcatttagacaatgtgttaaatatatttcatacataattccaattgtcttccagaaaagttgcactattttatattactaccagcaatgctttaagtgtacatctcatcagggtttgtcaatattgaatattatcatttttaatatatctgatttgttaggtaaacattgcattatattttaatttaactcaaaaaatttatagtgcaggtaagtattttttcatatggtcattttcattttctgttgtcatttatgtcctttattcatttttcagttggaggtgcttttagttttttgtttattggcttgtattaactatttatatattaaaggcattagtcatctgtttttcataaaaacttttctcagttgtttatttcccttcaaagttatttatggacttccattgtaatagctttctatcactcttagataaagctaaatagatacaacaatttcagttaaaaacttaagatcttaaattagataaggaacaatagttcagtggtatatgtacatgtcactatcagcattttggtcaaaaccattcaacaagtctctaggaatttccaaactttcccacatcttctatcttcttctgagccctccaaactgttccaacctctgcctgttatcgagttccaaagtcacttccacattttcgagtatctttatagcagtgccccatttctctcaataccaattttctgtgttagtccgttttcacactgctctaaagaactacctaagactgggtaatttataaagaaaagaggtttaattgacccacaagtctgcatggctggggaggcctcaggaaacttaacaatcatggagaagcaaggcacatcttacattgtgacaagagagagaaagaggaagcaccacgcacttttaaaccatcagatcttgtgagaactcactcactatcatgagaacagcatgggagaaaactgctcccatgatccaatcacctcccaccaggtccctccagcaacatgtgggattacaattcaagaggagatttgggtaggaacacaaagccaaactatatcaactagcctaaggagggaatttattagccttaaaagcccaagatatatcctggctttagaaacaagtttaataatgtcataggagttttgtctctcagttctccttgcctgagaaaggctctcctatgtcatggcaagatggtcctaccacccaaaagtctacattattttgagagtttgtgatgccagaaaaagaaacaagactgatctcctctaaaagactcttaatgatttagcttggggcaaatgctgatcactatactgagcactgtgtccagggatatagtgcactctacaactgtggtatggaaggcaagaacatatgttgaatggcccaaacagaataagccagagaaatagcaatttcccaaagtagatgatgtgggattgacaaagaaaataataggtgccattttaagacacaattaagtgttaaatattatattcccactaatagtatatgagagtttcctttgcttcacatcctcactagtgcttggtatttgtattagtccattttcatgctgctgataaagacatactcaagactaggcaatttacaaaagaaagaggtttaacggactcacagttccacatggctggggaggcttcacaatcatggcagaaggtgaaaggaacatttcccatggcagcagacaggagaagagaacttgtgcagggaaactctcctttataaaaccatcagatctcatgagacttattcactatcacgagaatagcatgggaaagacccaccaccatgattcaattacctcccaccatgcccttcccacaacacgtgggaattgtgagagctacaattcaagatgagatttggatggggacacagccaaaccatatcagtattctctgcctgtttcattctaaccattctgatcagcatgtggtagtatctcattttaagtttgatatacatttcctggatgaataacaatgtggagcaccttttcattgccagtgagacatgcttatggctttggttttactttcattaataatactttgatttatttacatactattacaagtacacaaattatttcttagaaagtgtgtgtgtgtggtgtatgtgtgtacaatatagatatcaatacctcaaccctggagtcagatatatttattcagtaaatctcaaatgataaactttagcaaattcagtggtctgtttaggaaagctattgaaactatcagttttattaaataaagtttaatttagtctgtgttgacattttaaggacaatttttttgaaataaggaagactgagaaaaataagtttgaagaaaaattaagagttcaattttggatatgctaagtctgagatgcctgtcaatcatgtaagtggaggtatgagttgaaagttgagtattttggggggagttcagtacacaggtcagagcagaagatataaatttttaagtcatcatcacttatattgcaaggctagatgagatacgtaggggagaaagcttagacagagaagagagaggcccaaggactgagctctgagaccatccagtagttaaccaggaatgcgtagagggccctatagaataaattgaggaggccaatgcactgatggagacagtgaacgaaggccaagcgtggagtcatggaggccagatttttcctgtgtaaaatggtagtaattacactaccaccctcagaagttgctatgaggagcagaagggttaatgcatatgtggtgcttggcacatcatatgtgctcaataaattgtgaacaaattatttaaaatgcatatgggaaaaacttccacttcaatatggttgaactatattaccaaatgattgggtctgagagccctgtggttggaaaagtaacataaaagtataaggaaagcatgagcatcttttttttttcttcttcaacttttaagttcaggggtacatgtgcaggatgtgcaggtttgttacataggtaaacttgtgccatcatggtttgctgcacggatcaacccatcacctaagtattaagcccagcatccagtagctattcttcctgatgctctcccttcccctgcccccgtgacaggccccagtgtgtgttgttcccctccatgtgtccatgtgttctcatcattcatctctcacttataagtgagaacatgcagtgtttgattttctgttcctgcattagtttgctgaggataatggcttccagctccatccatgttcctgcaaaggacatgaactcattcctttttatggctgcataatattctatagtgtatatgtatcacattttctttatccagtctgtgattaatgggcatttgggtccatgtctttggaaagcatgaacatctaaggaaaaaagttctgaaagcaatgactgtagtaaaatacagtgccttttaaagtcagacaaatttggttttggattttggctctctgttgaccttggacaatatttaacctctccaagcttcaacttttccatctctaaaatagggatgatggtagtacttcttcataggactgatgaaaagatgaagtgagtgaatacatgtaaagtgctcgccttaaccaaactgttagtgaataccaagaaatttaattggctcttaatgctccacttctctaaaatgaacctcaagtctcctattatgctgaattaagatgtagctgatggttcactctgtgacaacattgaattgttgctaggaagcatatttggaaatgacatgttctggatcattttattttctataagttcatcggaatacttattttgcttagacctttgctaaaatatttataaaatatgtccctgagaatatatattaagttaggtacttgagtctttggtggaggagcacacaattatctcaagaacatcattctgaacaccaatccttgggcaggtgttacagagacaagagatgtagaagattgtgccaaatctgtactgacttgtaacttgctctggatttttaaaattacatgattctctaatagttgtctattttataacttccttccctggggagaaccacagacggcagtcagtaaccatgaaattcttgctggctgaataaaacaaggctcactgtagagtaattgtaacgagagacagttaatgtttacagtgatcttagtagctttcaaatataaccaacaaactattgtagttgataataaagatggaacaataactaaaatatttttcccaaatgccctgagctttcccactgttgtgcccaatatctagtattcctatgcacaaactttgcaaaactatagtaccggcccaggtcaaatccatctccctcattcatcctgttcttatttggattattcaatctctcatttttccttttgagagaggaaggagcactctctgtaatactttcctggtgactcttgaaagtatttacattttactttaccttaataatctgtgtgtttttctgttgtgccactagttctacaaactctgtggggacactaaccaatcatctttatctgagtatttccataacacctaatgtggagccctcacacatacctagaaggcacttaaagacaactgtgaattgaacaatgtgttcacccatagattagctgttcttatgaatcatcatcattaagcggtatgtgtagaatgtagcagaacatcaatgtttatgctgtaggtttaaaatgaagttactacatgattttatcttacattgcacaatgacatcgtggatctttcaatcacaacacctcttaatctacctatgacatttttctgaattcctgtaaatctctgtctttccctttagctgttactttccttgctcagcttcaaacctttctttttgatcacctagattatgctagcatgcaaaaccaaggatactgagaaaagttttatcatttccttagaaatgccctacagtgttagctaggcatggtagcacccatctgtagtcttagatactgaggatgcggaggctggaggattgtttcaggtcaggagtttgaggctgccatgaattatgatcacaccactgcactccagaatgggtggaagagcaagatccctctgtaaaaaaaaagaaagaaagaaagaaagaaagaaaggaatgccctatggtattatatctttgcccagcagctacatgggtagtccttacttatacgcctttaatcttgagcaaacataaaatagcaatttttaaataattcctttttatcaagactgctatgagtcttcagaagagattattaactcccttgcagtcaaaaactataggtttattggcattatcacaactgcatcttggctatagtttgtattttattttggggggatatcaagatataaaacttctaccagtcgcaagagtaaattagccactattcatactttattgatttctttttttttttctttttttgaaatggagtctcgctctttcacccaggctggagtgcagtggcacgatctcggctcactgcaagctccacctcctgggttcacgccattctcctgactcagcctcccaagtagctgggactacaggtgcctgctaccatgcccggctaattttttgtatttttagtagagacagggtttcaccatgttagccaggatggtctccatctcctgacctcgtgatccacccgcctcggcctcccaaagtgctgggattacaggcgtgagccaccacgcatggcccatactttatcagtttcttacaggtgatctcaatgagctggaaacagttttccaagggctgctaaagtatttataacacgacacacaagcttccttgtgggttaccgacttaactttcctttcaaggaaaatgtcattaaagggaagttcagagggtttccctatataaaagaagtctataagttttaaatgacaatggtattttacttagaatgttatttttctaagataaaaattggattttcttatacgttctctgttttttagaggaaaaaaaaaggtttatttttgcagaatactctggctcccaccttcctcattcccttttacatattcaaactcagagccacttactatgtttctggagataaaactagcgggtgagaaaagagttaccctagtttaggaaaggttatgaatttttagttacttttatattactaaattagaatagagtatgctttaaaatttacttttgtattatagtacaacacgcaaagagaaaagcactgaaatcttagttgtacaacttattaaattttcatttatgtgttctccatcgaggtcaagaaatgaaacataattattatcaccaaaagccccattgtgttttctcccatcccttccccatgtgtaacccctgtcttgatttcctaaaccagagattcattttgctggactttaaactttatataaatgaaatcatacagtgtatttctttggtagctgggttcttttgcccaaattatgtttgtgagattgtatcatattgttgtctatagcaatagttcattctttttcattgttttatagtattccattgtgtgaatagatcacaatttgaatacttccttatttgattactatttgggtatttttcagcttgccactcctataaataatactattgtgaacattctaatatttgtcttttggggaacatatgtatgcatttccataagattatacctaagagtggaattgctaggccttaggttacatgtcagttacatgctttagtagatactgccaacgagtgtttcctaagtggttgcaccaatttacactcccactaacagtttcacatccttcacatcctcaccagcacttggtattgtcagtctttttcattttaaccattctgaaaagaatataataatatctcattgtggttttaatgtctatttcccagatgaataagaatgttgagtaccttttaatattggccatatagatatttttgtgaaatggtctgctcaagtgttctgatccattttctttctattggataattctattcttcttattggtttatatgatttccttatatattgtgtatacaagccttttttcagttatgtgttacaaactcatcctggctactgaatgcaaaataaatgccaaaattggtacatataagctatacattccaacaaacttttgggttactttttggaatttttttaaagaattaaacacagaagcttggaagaatatataaaattattctctaatatttagatagatgttgctcttgggttccccacaccaacccctcccaccattactgtattatttttctattacattgtagcaaaatgccacaaagggtagtgatttacagttttataagttagaaatccaggcaggcgtggatgagttttttgcttaggatctcacaaggcctaggtcaggatgacagcaggctaagctcttatctgtaaggtctgggaaataatcccttccaagctaacgcaggttgttggcagaatcaattccttggagtcagtccaaggtcctcatttccttgctgtctgctctctggaatcattcgctgttcctagaaaccacccacatttcttctgacatggccctccatcttcaagacagcaacggttcattgagtcctcgtatttcatatatctctgactttctcctctgccttcttctcatactactagttggagaaagtcctctacttttaaggactcatttgatgaccttgggaccacccacataatctccccttttaaggtccctgatgccaaatgacataacatagtcattggagttatatattgtatcatcatattaacagaatctgtggcttagggcatggaatctttgggggataaattcagaaattctgcctgtcatgggactgtccaccaaaatcaagacaaagagacaggaaccgactagaaaagaaatgccagtagttggaagtctaaccaattgtttagaggttatcagctagagcaactccaatgcctagcaatgtgcctggcataaaggatactctcaataatatttttcaaacaaatgaataagtagcttttgagattttttctaatctccatatttgactacagcatgttttattatctttctctggatattcttggacaaataaatgataaagtatcacaaaactatgtacattatatatgaggctcatctaggccagggggagtcaatgattttctattttttatgtcatctctgattaactggtggtggccatctgaaatactgcattgagaaggattttgcagtttgaagattgttgaggcttgaaggattttgaaatttaaaggaaaagagcactgtgattacctacaccatctacctgagcactacaggtacatatgattacaaatgcatcttattaccatcccacacccacttagagacccaagtgagattcaagccactagaccaaagaaccagtccatatctaattcagtttcagaggctttctatatgataaatctgaataatagaatagtttgttgtcatcttttcactgtaactaatccccattttttacaccctctacaagaggcaacaaactggagggcatggctgtggaacatgtatttttcagccttcacaatgtttttgagaagttggaatttgctttcaacacctaaaaagagagactttgtatttagaataaatctaaatattgggttactcttagtaattcgacatcactgggccaacattcctgcatgtaacccttagcttgagttgactctcagactgcccctcttgatggggatgttctcaccagtttgtccaaatcatttccctgacagtacagccttatagcaagtcaccatcatgcctgtccctcaggcacttgggtttgtgattcccgctctacacaatgacctttttgttttagccagcctagctccaagacagcctaacttgtatacactctcaaaaagatccctatgaaaagttcctgtcccaagtggtcaacagtcttctctttctaacctcacatttcccagaacagatatttgggaggaatgggaagtttctggcagagtcccagtctctctcttcatagccactgtaggctcccccaagcttttctcccttaggcctgcagcctcctgttcaccacactctgattgtttctttcagctcagggggcacatgtgtatcctgacaactcattctgttaggggtagaaggtattcaggttaccagtggcgaatccgtatgggtctgcagcaacctcgattcttgcctcctcagaagaaagaattcaactgaggggcataaggcagaaaaagagaacaaggcaagctttcggagcaggagtggaagtttattttagaaagctttagaacgggaaagaaaggaaagtacacttggaagagacccaagcaggcatttaaccttgaccctggggctttatatgctggcccaccttcagcatcttgcacctctttcccacgatttctcccttagggtgggctgcctgcatgtgccctccttatgcttgggaagtgagcatgtgcagtgtgtttaggaagttgtatgcatgcccatctgaaggtttcttcccttttctggtgggatgcccccaaaagtcatagtccaccattttgtctcttaatgcacgtgcccggttcactcgcccaatttctgagaccctgttgaaagccaattaccaattttaagtgtttttatctgtttgggaagttgcctctccctggtgtctgcattcagttaacacttcattgtgacagctgtggaccgtcaggagattatctctccctggtgcactggctgctgaattatcatttttagagcagcaatgtgataactgccaaaccatcacctgataatcacctgacattcctcgtaggtggggagcagagccctctcctgccctgctcatgcctaacttcatgtaacaatttctaatatgctaattgttcatttctgggtctttgaagtaatttggatagtctgattttagtgtagattatgttaggccattcttgcattgctataaagaaatacctgagactgggtaatttataaagaagagtggtttaattggcccacagttctgcaggctgtacaagcatggtgtcagcatatacttggcatcttggaaggcctcagtgagcttttactcatggcagaaggtgaagtggaagcaggcacatcacaggacaagagcataagcaagagtgagagaaggagagggtaccacacaattttaaacagccaaatcttatgagaacacactatagtgaggacagcaccaagccatgaggaatctgcccccatgacccaaacacctcccaccaggccccacctccagcactgggaattacatttcaacatgagatttggaaatgacatccaaatgatattagaggtattcataaccactttcaaattcctgagtaacacaaatgtaagaatacaaaatactgtagaatataatttaggagctccttctagaagcttagcattgtattaggtaccatggtgatgagtagttgattcagagtaggagtaacatggacaaataacttataaatttttctctaagggccaaattgattatattttaggtaatatccattgtgatagaatcagaagggttttttaaaaatctttgggccactactcctaactcgtaacataaggagaccagactatatcatctcagaggtccttccagctccactattctgtctctggacctgataaattctcttaaaatatttcagaatttatcatcactgcttttttcattgatgtaaccataaatacaaaacaaaaatgctataaataaaaatagtttaaccaatttaaagtgattatagctaaaatcactatctaagaaggaaagttgatcatttctcttgttaatcacatcaaacccagtagtcccattgacaattacaaatttttcaaagattacttcccagcattctcacagtaggtgtaaagccaacatgctgctgtgaagccattatctgtgaagattttgatcttagcattctgagatatttactaaattaatgggaagttggttaaaattccctccttttcagattatatatgggacttctaaaatgaaacatgtcttttagggagaaaattatccctttaattttagcatattttaaaaataggaaaaactgactgaattctgtcaggggaggcgatctctctttgtgtgatgagtttctttgaggtcatgtatatgtattagttagacaagaatggcttttccttttgagaagagtagcaggcaagcacttctattgatcacaaggtcagtctgaggccatcttttatagagtgctattaagtactaattaagattacttttctctgtgattgtatactaattttacattcctcttaataaaatgagctccagtcattcactggggaaaaaaatattcttcttttttaccttccattagccattatataatagtatatagcttcaaaagaaacaagactacaatattccccaccaggcgtgacgtaattttctccatgtttaagctatctttgtccaacagtattaacttcagtacttggtatgtaataaaattatttttttaagaattatttctggtataccagtgggtgttaaaataccaggttaactccaacagtcatgctgtcaaggagataaactattttactacttgtttctatgactttgacactgaaaatgactcctagatacacctgtgagatcacccaggagggtacagttgctcaatacagtaacacccactgagtcccctgtctcctggctcttctgtgtgacacaggtttcacaaccgtgatagaaactgccctgaaactgtcttgaggtcaggaggtcagagcattttggtaaggaccctctggtttacttttaagattaaagaagagtttctctactgcaaattctcagaagcaggttgagatcatacttttaatgtgaatttcttttgagagcacaccaatatacaatgtcttctttctgtaacacctagttcttactacctgaagacattctattggtagcagtaaaataggaaatggaaaagccagcaagctttcacctgatctctatgggggcatcacaggttggacttgtcctcactgaaaatcactgtagcatctaatggagtcattcacatggaacattgaatgattgactattacacagatcacctctcctactgaattattttacttaagaacaagtaaaatgcaagagactcactgtgaaatttttccctgaacctctttaccttttctgtctctaaagactctctctcataacattgacatctgttctcacaattcccatcgtccctatttagacatctccctgttagttataaaataaagaccacaatttttagtctaacactaagactctacccagcctttcccagacctacctctgctagatttgttttttgttgtgcttcagccacactgaacacctaatgatttgtcaccgaggttttactatgtttttctgtttcttcatgactttcgtcctatctggagacaatagagtattgtgattaaaaggactcagatttgtttcctggctctgcaacttactggatgtgtgaccgttctaagtctgtacaatggggattggtcatagcagctccttcctatggttattgtgatgatcaaagttgttaatacctttaaagcacttgacacatttttggcacatatagaaaattttgaaatctgcttttattgttgttttattattgttgttgttatgagattaattttcttactctgctattacagcctttcaaaattgttcctgtttcttggggttttttgtttgttttttgagataagatcttggctctgtcgcccaggctgttgtgaggtggtaggttcacagcagccctgaccccctgggctcaagctatcctcccacctcagcctcctgagtagctgggactacaggcgtgcacaaccatgcctggataattttgtatttttatttttttgtagagacagggtctccctgtgttgcccaggctgatcttgaactcctgggctcaagtgatcttctcgccttgacctcccaaaagtgctggtattacaggcatgagccattgtacccagcctgttcttagagttatcctggtaaacccagctaaaggaaatacctctattctaataactcccataccatcttatctttttttagatgcttcctatagtctctgccccattcagtgtagtactatagttatctgtgtgtgtgactgtctctcctcctaagcattataaactccttgacaacagaagctatttctacccatattgtatcctctgttgtgccctgtacataaaagatattatttgtttattggttgatgaagcaaataaatgaacaaataaatgaagagtatttgattttgagcctttctcccaaatgtaataatatccaaaataatttcttatatttagagtacttttggtttaatatgcacttttataatcttcatcatattttatcctcatgataacctatttaaggtaagcaggctacctcttgttttttgagaaaaagactgaaagggctgtgatgacatgggagtctgtcactttttgatgaatggaagaatccacatgacttccacagtgataggtcagttcacacaaggctagtgaattcatttgcaacttaagaggacaataaatcccattttctaaacaaaagatacagagcataataggcttcatggtcaccatacacttaatgttgaaggctacatttccaaaatattatgtaagaactttgtagttgacatttggatgtcctagggatctttttgctccttctcagtgatcatgagactgaccttaaataatacctttcccccaatgcactattctctttacagtactgtttttcacagagctcctgtggtcacaggctataaatatttataatcttctcctccttgtagtacaaagactatttcactccaaggcctcttatcacttatcaatggtataggttcaagactaaataaaaaatgttagagttgtaattatcatttttatattcttcatgacgtaggaaaagagggtaatttggctggttttaaagataagaaatctcaaatacattttttttttgcctgtatgacagtttataagtgtcaaagtcaaaactgagtcttttctctaacataatacattgccattatagtaatagtaatttttatttactaagttcctatgatgttcaaggtattttataaacattattacattgcatttttaccttaagagatagacttaagaatccctatttgagaaatcagaggaaataaaataacttgcccaggtagaaaataagagagccagaattcaaactgttatgcctgatttcagaacccttgcttaacagcaatttaaccagagcagctttaacacaacgtttatatgataattcttaaaattaactgtttagtacttctccccttagcctgttcctctcccatcttccccatctcaggcatgagtgcctccacttgagcaattctcaagccaaaagcctggaccatcttttatttgtcccactccactgacacccaagccttacactttcatgcgcgtctgtgtgaagagaccaccaaacaggctttgtgtgagcaacatggctgtttatttcacctgggtgcaggcgggctgagtccgaaaagggagtcagcgaagggagataagggtggggcagttttataggatttgggtaggtaaatgaaaattacagtcaaagagggtttgttctctggcgggcaggagtgggggtcgcaaggtgcccagtgggggtgctttttgagccaggatgagccaggaaaaggactttcacaaggtaatgtcatcagttaaggcaaggaccggccatttacacttcttttgtggtggaatgtcatcagttaaggtagggcagggcatattcacttcttttgtgattcttcagttacttcaggccatctgggcgtatacgtgcaagtcacaggggatgcgatggcttggcttgggctcagaggcctgacgtacacagttccctgactctctccagtcagcctgctcctctccatttttgctgtccacacacttgtccgtgcctctcactcacagatgctgccatctctctcccaaggaactgtagtcacctcccagctcgtgtctacctctgctcttcacatcacttccattcaatgccattccactaaatctgtgccttgcctccaaatcctacatgccctttacccagaattgccacccctatctcagtgttcaactttcccagttgctctcttccctttgattcccaatgctcttgttttaagctcctccccaatgccgggttcatgtcctcagggactttccaagttctgttccctctgcctaagaagtgattctccaatccctccacacattctttaccagctattttgcaatgttctttaaagactcagcctaaatgtctgttactcagacaaaacaaacttccataacatcctatctagattaggtctccctgttttactcccccagggagcccttacttttccttcatagtaattatcacaattataatggtaatttgttggtaagctaagctgttggtctctttcattagacaataagtaccagaagggcagggacggggaaacagggacattatgtatgcatttttgccactacatgcatagtgtgtacctgacacaccaaaaaagtgttaaatacttgttatctgaatgaaatgcagacagcttaaaagcagtgtttcatctaaattgagagtgcacatttactcttccctgaagaactccaaaggtagtagtaaaagatgcagtaacagcttaagtaagcaatttgtattcttattcatcctctctttccttccttttttcttttgttccttctcctttcctctcttcctctcctatcctctctctttcttttcttttcccttctcttccctccccttattgcccttctttcccttttcttccctttccttacagaagcatttcctccagctgcagataaaagcatcaggatgcctgaatctcagagcaccacgtggaagggtttcaggccattcattggcccataccaagagatgacttcctacccaaattttcattagcaatttctagtgattcaggagcactatagctccagagtctaacagtaaatattagtctggagattcagactttgaagggctgtaagagacatcccccagagaaggtacagtagtacacagtgacaaatcatttctctccagttctttgaatattgggaagcactggggtcagtctacaaagtggcctgtatgaccttgtgttcagccctcctattttagataacgcttgttggagcaaaatagcaaatatgagtctacatggtagaagtccctagttatatagcttttgaaaggtgccccgctgtggtaacttggctcatcgaaagctgggtgttctgtgggtcttttaaggaatgtaaatcttggtatccatattcgtggtccagctcctgccatatcccctatcttccacagagcctgaaccttgcaggtactggtaaaaggagatgctcttagacacgttcaggtgtggcttcagataaacatcatatatttgaacaagctaagtatcgagactacatttccagctcactggagactttccttctggcacatttaagcttgtggccctcaagaggttagaaaaagaaaggtactgagccacacacactctttcagagagtggaaaggagtggttatcattaactcacaagaattggttcaagtactgaagtcatatttcagctgcactcatatgaaatcccgccggccttctcctggcgcgcttcggttcatcaccattgctcacctgccgccgaggactcctttgctttcactgcaccacatctgaaatgtttcgcgctgccgggaacggctttgtgtaactctgggacctctgacttctcagaagggatttccttaactccagtgcatctgttgagttccttaaaagtcgatttcgtgctgagtggtacattcgccttgtggaatctgcttcccttacatttaactctccaaacaaaattagagcaggagcttggcagcctttcccgcagaattctcacacttgggagggcacgggggtggggggctcacgtaaattttagtttggtcagtcacgctgaaggtactatttggcaggaatattaactatgccacctgtgggaaaaaaaagtttcatttttgtaatttgtacagtctacatgctccacatgtagatttttttaatatcttgcccaagatatgaattcattagttatagattataaaactcaatccataacagtgtagataatctaaaattgcagatagggtaatattgaaataattcacaacactcaaagctaattaagtggaacggcacatgcaaatctaactgatgatacactagaaagctgtctggctccctcctgctcgcccttctctttctctcataactttcttttaggaacaacttcactgcatcgtaatagaagcaacattaacttaaaagttctggggacatatgaataggtaatttaattttttggcttaagagccttttctctagctttctctggccaagtaaagaaagtaatttttcacatcaactggaaaactaattaagcatcatagatggcatccttatttattccctgggattaacccaggaagaagtagagaagaaaactaacattaatttatgcagtttgtatcgacaagcatcgtacaaggtaccttacacattgtattaactctaatagttatagcaaccctaggacacatacattataattctttttatttcttcttttttgagatgctctgtcttaaaagagcttctctcttttttgctttctttgtttctgagatgcttctttccttcctgctctgtcaccctggctggagtgcagtggtgcaatcatagctcattgcagcctcaaactcttgggctcaagcgatcctcctacttcagcctcccaagtagctgggaacacaggcatgtgccaccatacctcactaccttttttttttaatttgtttttttagagacagactctcactttgttacccaggctggtctcaaactcctggcttcaagcaaccctcccacctcagcctcccaaagtgctgggattataggcatgagccactgtgcctggcctaatatccttatttttaacagatgaagtaactgtgtcttgaagaaattaatttattcaaattcacacagaccatgtagtgttaaacctaggattaaacccagatgaacctcacaaatctgacattatactcacagaagattgaaagaaactatagcagatgtatgaaacaatgttttaagtataggtaaaagttttgaaggcagaacaaatattggaatgtgactttatatattctaaatgtaagatttttgaattcaaagtttaagactcagttaatattcttacaaaaataaaagtcttaacagagtgtttaaaaataaaagtagaatcttattatttaaaatataatagttttaggtttaagtacatttaagtacattattgagccttacccaaaggaaaatcccagaacatcaaatatttaatgttaagcacctaagagagttctgagtaagaaggaagaaagtgagacaatgaattaattatctactcttgtttaatcattcaggtatttttattgattcaagttatggtaaagctactcagcctaagggagtgaggcatacttttcctggaatcctcctgcctctttttttacatatacccagaggcatctttacagattcctgggcactacacctgcagcccagatttttcataatgaagtgttagaatccagctttcctcaggagagaggagaggaataagcagcccaggaaaaggaacacaggtttactcccaatttagagtctgtgttcacttcttaacataataaaggtatcatgagtgatcctgcagtgccatcattaaaatcaagtttccataatgaaagtttgaaaatgaaacaatctgttaactcttgccctttagctaagtctctcaccttccttaattctatggacatgggcagaatgtgctctgcatgtaattggattccatagatcaagttatccacagaactatttggctctttctttaggaaagttttctaccttggtcttttacagtatttcaggagttccctcaatttctgttagtggtagtatatgttccagtggcataaagtgctatttatcactttcaaatacccttgctgtctaaaacctagtcaaaaaaacagatgtctatagaagacctatctcactgcacagttgaaaatacgagtttcaaaacatgctcctgaaggcatatacagttccatggacatggtgatctgcaaagttgttaacacacaataattgaatattagcatcatttacttggaccactctacaatgctaggaggccttcaggatctccttaccaaactcaatttgaaccccctaataaaagaaaactcactgctgagcaatgctacagtctaaagcaatagttcccaactcttaccaaacatcagaatcacctacagagcatttaaaatgcccaggcccatcccagaggggttttgtgagcaagaaaatggcatgatgtatgtgtaagcactttgtaaactcactataaaaatgtaaggcatattaaacagtaatttgaaagtattcacccaccattctagcccacctaattttttgtttgtttgtttgttttgagacagagtctctgtcacccaggctggagtgcagtggcatggtcttggttcactgcaacctccgccttccgagttcaagcgattctcctgcctcaccctcctgagtagctaggattacagatgcctgccaccatacctggctaatttttgtatttttagtagagatgggatttcaccatgttggccaggctggtcttgaactcctgacctcaagtgatccactcgcgttggcctcccaaagtgctgggattacaggtgtaagccaccatgcctggcctagccagtctaaattccttgattctgacatccaacttatttgctgtcccttctagctaggtcaaattctagctatatcaaattcttctaattggaaattggaaattttatttattttatgattaataaatgcacatttattggggactcactgaattcaagatcctggactgtgtgcttattacttctacacagcggtcatgctggtctcagctggtgcctctcagtgccttggctctcttgattccctggtcaggcttcccggttgacaggacattggttattttcatacataatcatcaaattgttgttctttttattaaaaaaaatctagtcccatctttagactggtactttagtagtatttggtttttaattttatgtttacctcctataaaaaccaaggaggtcggtcagaaatgtagatgctttaaatatttcaaagtatatttttggcaacttccaagtaaattggcttttaggaaatctgagtggttggtattcatttgtctcgtttcacatctggttctgaaagaactaggatacttttttttttttttaactgaaacatgaagccaactgtagcacaagatgccagagcatttgcatgttgctgttgagccattaactcttcctgactgactgttccttcccagtcttggaaagttaagaatatgagtagtaggaattctttctcaggctggcacacactggctgctacttaaacagtttctctgcctcagcagagcctgatggagattcattccatttttcctgtgaatcacttatccagccccgactatttttagattgaggaggaatccgactttctgtagaatgatgatagggaatgtgatgattgtgcagccaccatgtgtaatatactaaatcattttaacaggtagggcaaataattttttgccttggtggcaagtattttcatctttccattggtaattgtcactttaaatgctggatcggttttgctatttacactttttaaagtaaatgaggaagataaactttgagtttcctgaaagattggtcctcaaagaattatgcccccttttttctttgtttttgctcttatttttttcttcaactcttaagttcaggggtgcatgtgtaggatgtgcagatttgttacataggtaaatgtgtgccatggtggtttgctacacagatcaacccatcacctaggtattaagcccagcatctataagctattctttctgatgctctccctttcccccaagccccaccactctgacaggccccagtgtgtgttgttcctcctcatgtgtccatgtgtaatcatcattcagttcccacttataaatgaggacatgcagtatttggtattctgttcctgtgttgttgtgctgaggataatggcttccaactccaaccatgtccctgcaaagaacatgatctggtattttatatggctgcatagtattctgtggtatatgtgtaccacattttctttatccagtctatcattgatgagcatttgggttgattccgtatctctgctattgtgaatagtgctgcaatgaacatacacatacatgtattttaaaatagaataattcatattcctttgggtatacatgtacacagtaatgggattgctgggtcaaatggtaattctgcctctaggtctttgaggaattgccacactgtcttccacaatggttgaactaatttacacccccaccaacagtgtaaaagcattcctttttcttcgcaaccttgccaacatctgttgtttcttgactttttaataatcgccattctgactggtgtgagatggtatctcattgttgttttgatttgcatttctctaatgatcagtgatgtggagctttttttcatatgtttgttgtgtgcatgaatgtcttcttttagaaatgtctgttcatgtcctttgcccactttttaatgggattgtttttttcttataaatttgttttagttccttgtagattttggatattagacctttgtcagatgtataaattgcaaaaattctctcccattttgtaggttgtcttttcactctgatgatagcttcttttgctatgcagaagctctttagtttaattagatctcatttgtcaatttttgcttttagtattttcatcatgaaatctttgcccatgcctatgtcctgaatggtattgcctagatgttctcctagggtttttatagttttgggtttaacatttaagtctttaacccatcttaagttaatttttgtataaggtgtaaggaaggagtccagtttcaattttctgcctatggctagccagttctccaagcaccacttattaaataaggaatcctttccccattgcttgtttttgtaaggtttgttgaaaatcagttggttgtaggtgtgtggtcttatttctaagttctctactatgtttcattggtctatgtgtctgtttttgtaccagtaccatgttgttttggttactgtaaccttgtagtatagtttgaacttgggtggtatgatgcctccagctttgttcttttagcttaggattgttttggcaatacaggctcttttttggttccatacagattaaaaaatttcttttctaattctgtgaaggatgtcgatggtagtttaatgggaataacattgaatctatactgtactgtgggcagtatggccattttcacaatattgattcttcctatccatggacatggaatgttttttcatttgtttatgtcctctctgatttccttgtatggtggtttgtaatgctccttaaagagatccttcacttcccttattagctgtattcctaggtattttattttctttgtagcaattgtgaatgggagttcatttatgatttggctctctacttgccaaatcagagagatttgttgttggtgttaggaatgttagtaatttttgcacattggttttgtatcctgagactttgctgaagttgcttgtcaggcttaagaagcttttgggctgagatgatggagtattctcaatgcagcatcatatcatctgcaaacaaagataatttgacttctcccttcctatttgaataccctttatttctttctattgcctgattgccctggccagaacttccaatactatgttgaataggagtggtaagagagggcatccttgtcttgtgccagtttttaaggtgaatgcttccagcttttgcccattcagtatgatattggccatgggtttgtcatatatggctcttattattttgatgtatattctttcaatacctagtttattgagaatttttagcatgaagagatgttgaaggccttttctgtatctgttgagataattatgtggtttttgtctttagtgctgcttatgcgatgaatcacatttattgattttcatatgttaaaccaaccttgcatctcagggatgaagccaacttgatcatggtggataagccttttggtgtgctgctggatttggtttgccattacttattttattgaggatttttgcattgatgttcatcaaggatattggcctgaaattttcttttcttgttgtatccctgccgggttttggcaccagaatgatgctggtctcatagaatgagttaggaaggagcccctccttttcaatttgtttgaatactttcagtaaaaatggtaccagctcttctttgtacctctggtggaattcagctgtgaatctgtctggtcctggatattttttggttggtaggctatttattacggactaaatttcagaacttgttattggtctattcagggaattaatttcttcctggttcagtcttagtagggtgtatgcatccaggaatttatacatttcttctagattttctagtttgtgtgcatagaggtgtttatagtattctctgatagttatttgtatttctgtgggggtcagtggtgatatcacccttatcatttctgattgtgtttacttgattcttctctcttttcttctttattaatctagctagtggtctattttattaattttttcaaaaaagcagctcctagattcgttgattttttgaagggattttcacatctctatctccttcagttcagctctgatcttggttatttcttgtcctctgctagcttttgagtttgtttgttcttggttctctagttctttagttgtgatgttaggttgttaacttgagatcttgctaggttttagatgtgggtatttagtactataaactttcttcttaacattactttagctgcatcccaaaaattctggtatattgtctctttgttctcaccagtttcaaagaactcttttatttctgcctcaatttcattatatacccaagggtcactcaggagcaggttgttaaattttcaagtagttgtgtgattttgagttaatatcttaatatgagttctaatttgattgtgctgtggtctgagagactgttatgatttcagttattttccatttgctgagaagtgttttacttccaattatgtaatcaattttagagtaagtattgtgtggcaatgagaagaatgtatattctgttgtttttgtgtgaagagttctgtagatatctatcaggtccacttgatccagagctgagttcaagtcctgaatatcttcactaattttctatctcaatgatctgtccaatattgcctgtcgggtgttaaaatctcccactattactgtgtgggagtctaagtctctctgtagatttctaagaacttgctttatgaatctgggtgctcttgtattaggtgcgtatatatttaagatagttagctcttcttgttggattgaaccctttaccattatgtaatcccattgtcttttttatctttgttggtttaaagtctgttttgtcaaaagctaggattgcaaaccctgcttttttctgttttctatttgcttggtaacttttcctccatccctttattttcagtctacgtgtgtctttgcacatgagatgggtctcttgaacagagcataccaatgggttttggctctttattcagcttgccattctgtgtcttttaattggggcattatcctgtttacatttaaagtttgtattcttatgtgttaatttgatcctgtcatcatgatgctagctggttattttgcagacttgtttatgtggttgcttcatagtatcactggtctgtgtatttcagtgtgtttttgtagtggctggtaatagtttctcctttccatatttagtgcttccatatttaggagctcttgcaaagcaggcttgaggtggtgatgaattccctcagcatttgcttgtctgaaaaagaccttatttctcctttgcttatgaagcctagtttggccagatatgaaattctgggttggaaattattttctttaagaatgttaaatattggcccccaatctcttctggcttgtagggtttccactgagagtttcagttagtctgatgggcgtttctttgtagatgacctgtatgcccctttttaaaaaatcttcacattagtactgacaatggaagtaaaggcttccagagcttgtgcaatgagggccatgatggtatgtacaaagtgtgcccccagttactatgtctgagctcagaaagacctttaagaaattttgtgccaggcatagtgactcacatctgtaatcccagcactttgggaggctgagttgggaggatcacttgaggtctggagtttgagaccagcctgggcaacatggtaaaaccctgtttctattaaaaaattaaaaattcgttgggtgcagtggcacacacctgtggtaccagctactcggtaggctgaggtgggaagatcacttgagcccaggagttcgaggctgcagtgagctatgatcataccactgcactatagcctgggtgacagagtgagaccctcactcaaaaaaaaaaaaaaaattgagacctgctttttcttattgtctgctgaattagtttgttttcacactgctgatgaagacacacccaagactgggcaatttacaaaagaaagaggtttaactggacttacagttccatgtagctggggaagccttacaatcatggtggaaggcaagaaggagcaagtcccatcttaagtggatggcaacaggcaaagagagaatgaggaagacacaaaagcggaaacccctgataaaaccctcagatctcatgagacttattcattaccatgagaatagtacgggggaaactgcccccatgattcaattatctcccaccaggttcctcccacaacatgtgggaattatggaagtacaattcaagatgagatttgggtggggacacagagccaaaccatatcacctgccttaaaaatttaaaaattctttggctacatgggacaccattgagaccctagaaatttaagttggaagacttttattagtattctacagagtatttttaaatatatatatatatataaaccatgtcagtctatcaaatttaatactgaaatctgtcacataaattctaacatgattatttcatatattattattcccttggcaagggcctaaactctctcacttatttagttactgagctttactttttgctgaattaaatacacagtaaaaccacactaaaaggggtcaagaaagtcagggcagtcttaaagaacaataaagaactggagagaacccatactgctagatattaagatctattaaaaagctgaagtaattaagacaatatggtactgacacacgaagaaaagacaaacagaacagagtgtccagaaaacacacacacatatatacatatgtatatattcataaatacatgagtggtacatatgaatatatatattaatctgtctgtgtacatatattcacctgatttgtgacacaggtgacattgtaatgcaatgagaaaaaaagtagccctttcaaaaaatgataatggatcaattatatccatgtggagaaaatatatcttgactctaccgggcacaacacataggaatcaatttcagaggattactgatataaatataaaattaaacaatgaaacctgtaaaaaaaagcatatgagagcatcacgatgactttatagtaagcaaagatttcttaaacataacatataaagtataaccataatataaataatgtagaacttctctttatcaaaaaacacctttaagcattgaaatggtaagtcatagagggaggaaagtatatttgcaaatcacatatccaacaatgactcatactagaatatatattttgaaattattttttagtttttaaaactattttaattattttttaaattatatatatatatttaattttcacaaagcaataagccagacaactaataaaaaatcagggaaaatacctgatcagacacgtcacaaaagagaatattcaaatggccaataactgtatgaaaaattgctctactacgttagtcatcagggaaatgcaaattgaaaacacagtgtgataccactacacactcaactgaatggctacagtggaaaagactgaccacaacaagaggtggtaaacatatagagcaactggaattctcattcccttctggtgggacagcaaattcataaaactctttagaaaacctctttgacagtatctgctgaagctgagcatacgcataccctgtgacccaacaattccaaacctagttatggttcctacagaaatgcatacccattctcaccaaagacaactagaatgttcatagcagcaatattttttactgataataatagtacatagttatagggtacacgtgatattttgatacctacatagagtgtataatgatcaactcagagtaatagggatatctatccatcacctcaaacatttataatttctttgagttgagaacattccaaatcttctcttctggctcttttgaaatagacaataaagtgttggtaactatagtcaccctattgtgctatcaaacactagaacttattccctccatctaaatgtgttttatacccactaagcaacctcttttcacacccccgccccttctcctttccaacctctggtaaccaccattctactctctacctccacgagatcaacttttttagctcccacatataaatgagaacatccagtatttgtctttctgtgcgtggcatacttcacttaacatagtgtcatccagacccatccatgttgctacaaatgacaggatttcattctttttcatggttgaataatattccattgtgtacattttctttatccattcacctatcatcaatagacacttaggttgatttcacatcttggccattgtgcagagcatagcagaaatatttgtaatagccaaaacccagaaaaacttaggtagaatggatgaattatagcatgggtcacctcatgaaatacaatatagcaattataataaattacccctaacaatatgcatgactcttacaatcctaatattgtgcaaaagaagccaaagaagagtataaatagtatttctaaaaaggaaaacagtaagcaaagctaacttatcctgttagaagttaggataatgggccgggcgcagtggctcacgcctgtaatcctagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaagaagttaggataatggttactttttggatggtgagcaatgtaaaggagtagggggattatttgatgctggtaatgttctatttctgggtcttggtgtggttacacagatatattcagtttatgaaaatgtatcaaattgtaaacttgtgatttatgcattctctgcatgttgatatacttccataaaaagtttttaaaatactattacctaataagcagggtaccaaaaaaatctgtcatgtaaaataaggggtcaagttattccaaaattaatgcaattaccagggtgagcctgctgcagagagtgggagtcaataattaaacatgctttatccaaactcaagttagcatgggaagtattatcgagtttcacttgctttgtactcttcttgcaatacaataaatattcatgctgtgtctcctttaactccctggggaaaagttaggatttaagacgaagcttatttgaacattggaaggtgcacttttaggtgagtctttcccaagcactttatttcaatagaaaaaaaataaatcagcaatttaaaaaatatttaaaaaaatgtattggggtttggtttatctgaaaagggttgaaattattaatagcattatatgaataggtactattaataaaaatactgttaactaacgagcaagttgaaaggctcccaaaaggtactttcttatctaaaggaatgtaaggcaggcaaagttgatattaccatgcacagcctttccactacccccgggaggttctaatcaagccttgcactgtgattgcaatgcaggactcagaagtgggaaaactgattaacaaaataaaaatccagagtgtttcccatgcaaacagtcatcagcgtatcttctgtaattatgtagcccataaatcaacccagcatgcatgggcttcactcatggtgtaaatatcttaatgactgagatgtctttaaccatgaataatttatatctgtatcatccatttttctcaaccatgcttcatttcagcaggataaactaatcttctgtctagggatgggctcttgattatttcttcctgatttttcctctatttttctcattttgacacactccaatttttctcttgcactttcttaaataagagtgccccatttatccagcctgtctccctgcctttattttcctatgcatcttattagacatcttggaataaagccagggcttttggaatcctacttttcataaatccctctgtgaatggaattgggtggcagctagggaaacaggcttaataccacaaggcagtatgagctgctttgatgttgttgtggggaaacatttattatggaaaacaattgccagaaaaggctaatgatcaattaaacattaacattcgtagattcccttctgtgatgcagaaagtgactgccacatggataatgctggaaaacagtagttgctaaaatagttttgttgttctcctagagctcattaaaataaagtcaaatgagaaacattccaatcaaattctatctcatctaataagctcatcccagccatgtcagctcatcaggctcagcatcctcagatgcctagaagtctcactgacactgccattcccttgacagttattgttgtagttatttggtaacaataattgctttctatagcccttatggacagggagcatcaggcaccttctgtggatcttttgacatgcttgagtaatttttctggaaacctggaaatcatatcatattagataactcaatatttattattcttattatactttaagttctgggatacatgtgcagaacatacaggtttgttacataggtatacacatgccatggtggtctgctgcacccatcaacctgtcttctacattaggtacttctcctaatgctatccctcccctagcctcccaccccccgacaggcccagatgtgtgatgttcccctccctgtgtccatgtgttctcattgttcaattcccacttatgagtgagaacgtgcggtgtttggtttcctgttcctgtgttagtttgatgagaatgaagatttccagcttcatccatgtccctgcaaaggacatgaactcatccttttttatgactgcatagtattccatggtatatatgcgccacattttctttatccagtctatcattgatgggcatttgggttggttccaagtctttgctattgtgaacagtgctgcaagaaacatacgtgtacatatgtctctatagtagaatgatttataatcctttgggtatatacccagtaatgggattgctgggtcaaatgatatttttggttcaagatccttgaggaattgccacactgacttccacaatggttgaactaatttacacttccaccaacagtgtaaaagcatctctgtttctccacatcctctccagcatctgttgtttcctaactttttaatgatcaccattctaactggcatgagatggtatctcattgtggatttgatttgcatttctctaatgaccagtgatgatgagctttttttcagatgtttgttggccacataaatgtcttcttttgagaagtgtctgttcatatcctttgcccactttttgatggggttgctttttttttcttgtgaatttgtttttttttttttgtagattctagatattagccctttgtcagatggattgattgcaaaaattttctcccattctgtaggttgcctcttcactctgatgatagtttcttttgctgcacagaagctctttagtttaattagatcccatttgttagttttggcttttgttgccattgcatcccatttgttaattttggcttttgttgccattgcttttggtattttagtcatgaagtctttgcctatgcctctgtcctgaataatattgcctaggttttcttctagagttttgataattttaggtcttacatttaagtcttcaatccatcttgagttaatttttgtataggtgtaagaaaggggtccagtttcagttttctgtgtatggctagccagttttcccaatactgtttattaaatagggaatactttccccattgcttgtttttgtcaggtttttcaaagatcagatggttgtagatgtgtggtattatttctgaggcctctgttctgttccattggtctatatctctgttttgataccagtaccatgctgttttggttactgtagccttgtagtatagtttgaagtcagatagcatgatgcctccagctttgttctttttgcttaggattgtcttggctatatgggctcttttttgtttccatatgaaatttaaactagttttttttaattctgtgaagaaagtcagtggtagcttgatgaggatagcactgaacctataaataactttaggtagtatggccattttcacaatattgattcttcctatccatgagaatggaatgtttttccatttgtttttgtactctcttattttcttgagcagtggtttgtagttctccttgaagaggtccttctcatcccttgtaagttgtattcctatgtattttattcactttgtagcagttgtgaatgagagttcactcatgatttggctttctattattggtgtataggaatgcttgttatttttgcacattgattttgtatcctaagactttgctgaagttgcttatcaccttaaaaagatttggggctgacatgatgaggttttctaaatatacaatgatgtcatctgcaaacagacacaatttgacttcctctcttcctacttgaatacccgttatttctttctcttcctgattgccctggccagaacttccaatactatgttgaataggagtggtgagagagggcatccttgtcttgtgctggttttcaaagagaatgcttccaatttttgcccattcagtataatattggctgtgggtttgtcataaatagctcttattattttgagatacgttccatcaatacctagtttattgagagtttttagcatgaaggggtgttgaattttattgaaggccttttctacatctattgagataatcatgtggtttttgtcattggttctgtttatgtgatggattacatttattgatttgcatatgctgaaccagccttgcattccagggatgaagcctacttgatcattgtggataagcttttgatgtgctgctgtattaagtttgtcagagttttattgaggattttcatattgatgttcatcagggatactggactgaaattttctttttttgttgtgtctctgccaggctttggtatcaggatgatgctggcctcataaaatgagttagggaggagtccctcttttcctactgtttggaatagtttcagaaggaatggtaccagctcctctttgtacctgtaatagaattcggctgtgaatctgtccagtcctgggcttttttttggttggtagactattaattactgcctcaatttcagaacttgttattggcctattcagggactcaacttcttcctggtttagtcttgggagggtatatatgtccaggaatttatccatttcttctagattttctagtttatttgtatagaggtatttatagtattctctgatggtattttgtatttctgtgggatcagtggtgatatcccctttatcattttttattgtgtctatttgattcttttctcttttcttccttattagtctggctagtggtctatctattttgttaatctttacaaaaaaccagctcctggattcattgatttttttttctgttttatctctcacattttagggctacagtttctttctcttttttttctttttctttttttaatatatattttttattatactttaggttctagggtacatgtgcacaacgtgcaggtttgttacatatgtatatttgtgccatgttggtgtgctgcacccattaactcgtcatttacactaggtatatttcctaatgctatccctcccccattgctgcaccccataacaggcaccagggtgtgatgttccccttcctgtgtccaagtgttctcattgttcagttcccacctatgagtgagaacatgcagtgtttggttttttgtccttgtgatagtttgctgagaatgatggtttccagcttcatccatgtccctacaaaggacatgaactcatcttttttttatggctgcatagtattccatggtgtatatgtgccacattttcttaatccagtctatcattgttggacatttgggttggttccaagtctttgctattgtgagtactgccgcaataaacatacgtgtgcatgtgtctttacagcagcatgatttataatcctttgggtatatatccagtaatgggatggctgggtcaaatggtatttctagttcgagatccctgaggaatcgccacactgtcttccacaatggttgaactagtttacagtcccaccaacagtgtaaaagtgttcctatttctccacatcctctccagcacctgttgtttcctgactttttaatgattgccattctaacttgtgtgagatgatatctcattgtggttttgaattgcatttctctgatggccagtgatgatgagcattttttcatgtgtctgttggctgcataaatgtcttcttttgagaagtgtctgttcatatccttagcccactttttgatggggttgtttgtctttttcttgtaaatttgtttgagttctttgtagattaggatattagccctttgtcagatgggtagattgcaaaaattttctcctattctgtaggttgccttttcactctgacggtagtttcttttgctgcacagaagctctttagttaaattagatcccatttgtcaattttggcttttgttgccattgcttttggtgttttagacatgaagtccttgcccatccctatgtcttgaatggtattgcctaggttttcttctagggtttttatggttttaggtctaacatttaagtctttaatccatcttgaattaatttttgtataaggtgtaaggaagggatccagtttcagctttctacctatggctagccagtttcccagcaccatttgttaaatagggaatcctttccccatttcttgttttagtcaggtttgtcaaagatcagatggttgtagatgtgtggtattatttctgagggctctattctgttccattagcctatatctctgttttggtaccagtaccatgctgttttggttactgtaaccttgtagtatagtttgaagtcagatagcgtgatgcctccagctttgttcttttggcttaggattgacttggcaatgcaggctcttttttggttccatatgaactttaaactagttttttccaattctgtgaagaaagtcattggtagcttgatggggatggcattgaatctataaattacctggggcagtatggccattttcacggtattgattcttcctatctatgagcatggaatgttcttccatttgtttgtatcctcttttatttcattgagcagtggtttgtagttctccttgaagaggtccttcatatcccttgtaagttggattcctaggtattttattctctttgaagcaattgtgaatgggagttcactcatgatttggctctctgtttgtctgttattggtgtagaggaatgcttgtgatttttgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttatttctcctgtctgattgccctggctagaacttccaacactatgttgaataggagtggtgagagagggcatccctgtcttgtgccggttttcaaagggaatgcttccagtttttgcccattcagtatgatattggctgtgggtttatcataaatagttcttattatttttagatacgtcccatcaatacctaatttgttgagagtttttagcatgaagggctgttgaatattgtcaaaggccttttctgcagctattgagataatcatgtagtttttgtctttggttctgtttatatgctggattacgtttattgatttgcgtatgttgaaccaggcttgcatcccagggatgaagcccacttgatcatggtggataagccttttgatgtgctgctggcttcagtttgccagtattttattgaggattttggcatcgatgttcatcagggatattggtctaaaattctctttttttgttgtgtctctgtcaggctttggtatcaggatgatgctaacctcataaagtgagcataaaatgagttagggaggattccctctttttctattgattagaatagtttcagaaggaatggtaccagctcctccttgtacctctggtagaattcggctgtgaatccatctgatcctggactctttttggttggtaagctattaattattgcttcaatttcagagcctgttattggtctgttaagagattcaacttcttcctggtttagtcttgggagggtgtatgtgtccaggaatttatggatttcttctagattttctagtttatttgcatagaggtgtttatagtattctctgatggtactttgtatttctgtgggatcggtggtgatatcccctttatcattttttattgcatctatttgattcttccctcttttctttattagtcttgctagcagtctatcagttttgttgatcttttcaaaaaaccagatcctggattcattgattttttgaagggttttttgtgtctctatccccttcagttctcctctgatcttagttatttcttgccttctgctagcttttgaatgtgtttgctcttgcttctctagttcttttaattgtgatcttttttagatcacattttagcgtgtcattttagatcacatttagggtatcaattttagatctttcctgctttctcttgtgggcatttagtgttataaatttccctctacacactgctttaaatgcatcccagagattctggtatgttgtgtctttgttctcattggtttcaaagaacatctttatttttgccttcatttcattatgtacccagtagtcattcaggagcaagttgttcagtttccatgtagttgagtggttttgagtgagtttcttaatcctgagttctattttgattgcactgtggtctgagagacagtttgttataatttctgtccttttacatttgctgaggagtgctttacttccaactatgtggtgaattttggaataggtgcagtgtggtgctgagaagaatgtatattctgttgatttgggtggggagttctgtagatgtctgttaggtctgcttggtgcagagctgaattcaattcctggatatccttgttaactttctgtctcattgatctgtctaatgttgacagtgcggtgttaaagtctcccactattattgtgtgggagtctaagtctctttgtaggtctctaaggacttgctgtatgaatctaggtgctcctgtattgggtgcatatatatttaggatagttagctcttcttgttgaatttatccctttaccattatgtaatggccttctttgtctcctttgatctttgttagtttaaagtctgttttatcagagactaggattgcaacccctgcctttttttgttttccatttgcttggtagatcttcctccatccctttattttgatcctatgtgtgtctctgcacatgagatgggtttcctgaatacagcacactgatgggtcttgactctttatccaatttgccagtctgtgtcttttaattggagcatttagcccatttacatttaaggttaatattgttatgtgtgaatttggtcctgtcattatgatgttagctggtcattttgcttgttagttgatgcaatttcttcctagcatcgatagtctttacaatttggcatgtttttgcagtggctgggaccggttgttcctttccatgtttagtgattccttcaggagctcttgtagggcaggcctggtggtgacaaagtctctcagcatttgcttgtctgtaaagtattttatttctccttcacttatgaagcttagtttgactggatatgaaattctgggttgaaaattcttttctttaagaatgttgaatattggcccccactctcttctggcttgtagagcttctgccaagagatcagctgttaatctgatgggcttccctttgtgggtaacccgacctttctctctggctgcccttaacattttttccttcatttcaactctggtgaatctgacaattatgtgtcttggagttgctcttctcaaggggtatctttggggcattctctgtgtttcctgaatttgaatgttggcctgccttgctaggttgggtaagttctactggataatatcctgaagagtgttttccagctcagttccattctctctgtcactttcaggtacaccaatcaaatgtaggtttggtcttttcacatagtcccatatttcttggaggctttgtttgttccttattatttttcctctaatcttgtcttcacactttatttcattaagctgatcttcaatctctgatatcctttcttctgcttgatcagtttggctattgatacttccgtatgcttcacaaagttctcaagctgtttttcagctgcaacaggtcatttatgttcttctctaaactggttattctagttagtaattcatctaaccttttttcaaggttcttagcttccttgcattgggttagaacatgctcctttagctcagaggagtttgttattacccatcttctgaagcctacttctgtcagttcatcaaactcattctctgtacagttttgttcccttgctggcgaggagctgtgatcctctggaggagaagagacattccggtttttgaatttttaggctttttgcactggtttttcttcatcttcatggatttatctacctttggtctttgatgttggtgaccttcggttggagtttctttgtggacgtcctttcattgatgttgatgctattcctttctgtttgttagttttccttctaacagccaggcccctctgctgcaggtctgctagagtttgctggatgtccactgcagaccctctttgcctggatatcaccagtggaagctgtgggacagcaaagattgctgcctgttccttcctttggaagcttcgtcccagaggggcacccacccgatgccagctggagctctcctgtaagaggtgtctgtcgacccctgctgggagttgtctcccagtcaggaagcactgtcccctcaagggacccatttgaggaggcagtctgtcccttagcagagctgaagcactgtgctgggagatctgctgctctcttcagagccagcaggcaggaacatttaagtctgctgaaactgcacccatagctgccccttcccccaggtgctctgtcctagggagatgggagttttatctctaagctcctgactggggctggtgcctttctttcagagatgccctgcccagagaggaggaatctagagaggcagtctggccacagcagctttgccgagctgcagtggcctctgcccagttcaaacctcccagtggctttgtttacactgtgaggggaaaactgcctactcaagccccagtattgagggacgcccctccccccaccaaacttcagcatcccaagtcgactctagactgctatgctggcagtgagaatttcaagccagtggatcttagcttgctgggctccatggggctggggtctgctgagctagaccacttggctccctggttcctgcctcctttccaggggagtgaatggttctctctcactggcattccaggcaccactggggtatgaaaaaaaaacttctgtagctagctcagtgtctgtccaagtggccgcccagttttgtgcttgaaacccagggccatggtggcctaggcaccagagagcatctccttgtctgcaggttatgaagaccatgggaaaagcgtagtatctgggctagtgtgcaccattcctcacagcacagtccctcatggcttcccttggcaaggggagggagttccccaaccccttgtgcttcctgggtgaggcaacgccccaccctgcttcggcttgcccttcatgggctgcacccactgtctaaccagtcccagtgagataagccatgtacctcagatggaaatgcagaaatcacccgccttctgtgttgatcttgctgcgagctgcagactggagctgttcctatttgaccatcttgccagccaccagataactcaatatttttgtaagcattttgaccatactatattaaagatttcattgggcaggaagagaggagttgcaaacagtatgttaaaaagaaaaaagtaactagaaacttcatgagattcaatagaatatatttctttagtggaatcaaggagttcagcactactccccaccttcttggcatgggatcccaaggggttactagaaggaaagaaggaatagtaaatgtccatctttgaatccccactacctttcaatgtgcatggcatatagttggcagttagtaaatatagtttttaagttcatgttgttgaatggatgacaacttagaaagtccacttccatgggactatgaggtggacagacttctatcctagcaagaatataattaggcttccccagcctcctgatagtacattaatgctgctgctgattcatctgatgcccaaagcatatggatctggtcctagtcacttatgtaaaatgccagcataagagtgccttatcacaggggacttccttgaattgtctaatatccagcttcttttcaaaacctaagtgagagaaaagattgacatctaacaaagatcccaagagatattcagtctgttgaccctgggatccacctttagatcatgttgaccaatacattatctcgtcccattctagagacaccatcattgatttgctttttaatcttatatctcaaccttgatcagggaacagatgttggaaactacctctgcatcctatcataaaatgtgttgagggcattatccattatatcatttaccaccatctgtatataaaagcccatgagagggatatcttttagagctctctgctagaatcatctttatttccaccatagagactagtagactttctcctttccaatagtgagaactgcataattgattatgtttcctttattattcaggttgctgggaaattgagtcattctttttattggagcaaaattcacataacatacaattaatcattttaaagatacaattcagtggcacttagtacattcacagagttgtgcaaatattccctctgtctaactccagcacatttttatcatcccaaaaggaaaccttgtatccattaagcagtcatttttccctccccagcaaccctggtaactactaattgtacttctactttctgtacctatggatttacttatagtccagtgtcatgcttgcagtggagtcaaactgcacctctgttaacccttgtggtagggcatttgtagactcttcctggttgtttctttgtattacttattttgtttcaagcaaacagcctcaagatttttgtgtaaagatgagtagagataaatacaaataagaataccctcctttttacctccagagccacttgccacccttcttgctgctctgccatgacctatatggtctacactatgggctctcaagccttctggcttccagttgagtttggctagtagggaatcatggcagtcgatcagaggaagggaggacaatgatgaaaagtattactctcccgacttcgtccttgtgggttcactgaaactggtcccttgactgaaggtcccagctcatgtcaaggagccctcatcactttaggcttttctgaatcctggttctactagcaattctattctttgccttttcaggcttagtagggtatggtccctattatttctgcccccagagtacggtatcatcccttgtagtttccctataagcttctcacacctttctaaattgttcctttattaaactcttctcaagttatcctaatttgagtgtaccatgtgttgcttgctgggaccctgacttaaacagcatactctaccccatggttcttgttcagctgtcagtcaacataatttgcccagagtcccctgcagatgagcaggtctggtagattctcctagagccaaacaatgtcctcttcatcgtgtccactgcattcacatagggttctattaaagtgtataatgggtaggttgacatagtttgcaggtcagggcagtaatccctgaggatgtgacatttgagcagagcagttgttaaaaaaaaaaaaaagtaggtgaaggaagggacaggaagaggtggggcattctgtgtagagagaacaacataaatgaaggcactgtagcagcggctgacagcattttgaatgactaaaataggagttcaggactggaacagagagaagcagggcagaatggtggaagacaaaactggtgaaggaagcagaagccagatcatgcaggtccttgtagaccatgttaagaacctgtactccattaccagaacagctgtggaaagcttttaagcttgggattaacgtgatgagatattcaatttaaaggatcactctggattggggaaggtgaagggcatgagaggatgtggggaaatcagatgatggtaagttgggctaaggtggtgatcatggagatggaaagaaaggatgaaattgagagctatttagggggtaaaatcaagaggaatttataaggatctgggagaagatggagccagggatggctcctgggtttctggtctgtgtgatggagggcagcgtgaacccatcactggagaaggaaacctgcagaagcagtggagtagggtggtctcactcttcagtttgggacatgtgtcagtgttcctaggagatatccaaaaattgttctaagtgacagataggagcttgggggaatgatgtgtgctggatttaagagtgactgaggtaagtgaaactgtgggctactgaggtgagagaatacaagactgagctcatgttctgtagactgttgtcaataagccctgattgtctttcatgagataaacatcctcttttcttcatcattttttttctggttagttagattaggaccttactatgatagaatcttgctagaaagttgtagttgtgccctggaaacttcttaatgtggaagcttcatattatgtgatgtctctttgaaggtggaagccatccctccaaactcagtctttaaaggatattgttattgtcatacaaatatttgaaggtctgaggatttttatcccaccttcataaacatagttatcaagaatcacttttctatctagctactcatctcttctattgattgtaggatactgggatttagattctagctactgtatattttcataaagttggttaacctgccttaactttctctggctagctacttaactggcatcattatttctctgtagattcacagattgtaatgactagggaaattttattcaaatctcttcattttacaagtgaagaaaatgaggtctaagggagatgatggctcgggccacatgctgagttgatgatatagcaagaaccaccctctagctggtcctcagctccagccttgagccttgtgtagcaccacactgcctcttcccttaaccatgactttaaattaatcttacctcagaactgtaaagctttctactttaagttttaaaaaagattcattaattgcatatttgcatcccccaaatggaaatattacacctgttgttttttcaagccttaatggggcaagttgtacttaaagagagacttattctagtttccagtcacagaagcatactgtagaagctgtggatgctctctctcacaccctctaaattaatgatggcagaggatctggcatccttttcctaagcttcttaatactcctactcctatcatttctttctaccagaacaatttcatgttaattcttcatgatcattggaacattaaaaccacaaaaatataagttttaatactttggcaaatatacaggccatgaaaaaaaaaaactaacttaagggtttatatttagacaccttttgaatatcctgatgacctttttaaaaactctcatgtttaatcatgatttagtactttttagaaaaatgaatactttgtttgagtattgggtaatggttggttgtagttttataaaatttacatctgcacatacctactttaaatagccacttcttataaaaacagttcaagacagatacattggcgcagtcctctcaaatgaaaaggcctattggaataccaattcagtcattgtatcaaaggcccaaactcacaatgctcacataaatacgatagaagtttctttctcaatctcttgagaaatccctgaagattttaggaacctaggcttcatctatctcatggcttgatgccctggtctgcatggttgaagatggcttaccagttctgagcccacattccaccagcaagggggaaatgagggagaggtgggcacagccattctttttaagagcacatcctggaacacagtcacatctcacttcccattggctggaacctggtcctatggctacaccttgctgcaagggaggctgggaaatgtggttcttaactgggcagccatttgctcagctaaaacttagaaaccctattactgacaaaagaagagaagatgagatatcagggaacacctagcagtttctgtcattcctaaaagagattaataagtaatatagaaactttatcactttcacctgttaagtaaaataaatttatctttagacatgacaaaaccatgaggaaaaacataagtgattgtcaccccacaaacatacctattaaaatccaacaagaccatggaaagtgggtttgagaaatcaaaattagtcattctaaagttctagaaagataatgtgagaaaaggccctggtaggccagagctcatgtgaggtttggctgagcagaaaaaggttgctatgcagcgtgcttaaggaacagaaggatgatggctgactgctgggggtggagccagaggcatcatattgtgtgcactgggctcagccacagatctttgttaaaattgagaggtgggcaaaactaaccaccttagtgatagaaggacaactaaaacagaggctgcggggactaacaaggattctttactagggtctcctgactaaggctcatgatgtgcaaactaccattgcacatagccatggggcccactcactgaaaactccaagatgagagtaaggcaggacgcacaatgaccaggtgagactctgcagagaaacaaagcagcaaatgagggagaaggagagagagaagccaggacattgtcattggccctagtctgatgtcaggagatcaggggaattaatacatcaaggtgagcgagagcagagagtagcatccaccatagttaggcttatgggcaaatcaaccataggatctggagtagttgtaataccccagagccaaaaactctccttaataattaagacctttggctccttgcagatattattaatgaaactctgctctggaattgacaggaagagatataggccctgatggtctcttaacctttttaaggactaacatttcaatcttaccagtcagttaggaaacatggtgttaatacatacaagaatccttagcactggatatgcatgttgttggcctggatattgtcatctttactttaataagtatcttatctcaaactgaagatggctctctcccatggacctttcagcttcatgagtcagtgcatattacctgagcttcagcaatgggaatacagatttcctatttcactatatctgagtggggccttgatgacaaagatgttcttgcagaaaggcaaaattgtattaatggagtgtcaaacatcagaacagttgaaaattagaaaaagattacagaccaatatgcagtcttgaaaaatgacatgactcaaaggcttgaggtcataatatagcaataatgaaaatatcctatatgtataacaaagtgctttgttcattggtttggttttaataaacactgtggaaaagataccattgtataggtaagcaagcaggcttagaaagttttagtattgttaattgtcaattttatcaaaatacaaaaaaaggaaagttttagtaactagtcttgtcttagataccatgacacaaatattgtgaaaatgagaattgaatccagatgttttaattctgtgtcccagactctttcccttgtgtctgtggctctaatgagctttaagcaacatcatgagctttctcatttgttcatgcattcattccacaactattagtggcatacctctgatgtgctaatcattattctaggcactgagaatgctgtgattgacaagacatagtctctaccttcaagcatgtttacaatctggcaaggaacacaggcatgtcgtccgtactggccactatgaaccagtgagatgtatgctacaacagcaggaatagagcaggctgtagaagcacatgtgaaaagcatcttaccaaattacaatttaggcttcccgaggaattgatgttggcattgagtatgcaaatgttagaaggagttgaaggaacaaagagtgttccaagccaaaaataaagcatatatgaagttaagctttacaaattcaacttagtgtaacattcctactacttggctagagacatcatccatccatccattcttctgattatctatctacccatccattcatcctcccatccctcttgtcattcttttatttatccacccatccatccttcttttctttcttcctcccttcctcccttcctttctttcttctttccttcctttcttttttatatccatcctttcatccattcattcatccatccgtctatttattcctggtaggtgctaagatatttattgaattaagtaattaatttaaaaaacctttactgagagacctagtatatgctcggcattgtgccaagcactgtggaggggataaagatacataagatattatcccaagtgacatgaagcttaaaatctcattgaagagatgaacattacacatacattaacacaatacaagctgaatggaacaggtgtgttaagaggtgccctatgaatttattattggctgtggggatattatatggagggaaatctaagtttcagtgataaaattaacaggctaacaccaaactgaatattcttcatctctttcttttgtctctttgcttatttgttttatttgttttgttttctaaaatttgttctttgacagactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacaggtaagtattgtagaaagtgcctacttttccgccaggcgcagtggctcacgcctgtaatcccaacactttgggaggccgaggcgggtgaatcacctgaggtcaggagttcgagaccagcttggccaacatggtgaaaccccatctctactaaaaatacaagaaattagccagtcatggtggcaggtgcctgtaatcccagctactcgggaggctgaggcatgagaatcacttaaactcgcgaggcagaggttgcagtgagctgaaccattgcactccagcctgggcaacaagagtgaaactccatctcaaaaaaaaaaaaagaaagaaagaaagaaagaaagtgcccctttacaaaattgcatgtgtgcaattttaaatatatatacatacatatgtacacacacttgtaatacacatatacacatgcatatacacatacacacacacacacacacagttctcttgccagtttatacaggtttcacacacagaagcaagttactgttacagggcttaaaaattcacctatgtgtcagccaccccatgatgtcacttcacgtcatccagatgtttggtgtggcctttagcaatagaaaaaaaaatcaagcaactaagcaagttttcttactgtgtcctagggcactagcctgttcttaatgtagggtagctgagtagatctttcttaaaccccatgcagagcagtgatgggttttcctgaattgttgacaattaaatcctgctaccataaaatctgatttctttgtttcttaaataaataaaacaatactttttaaaatattttttacaatacttttaaaaagtcctatactctcatagcatgttaatcttaggattttacaaccttcgagggtgtcttaaaacatcattcgcttcaatgccacaataaaaatgaaatttcatgtttctaattaatattttatactcgtaaggtaaaaggggaagataaaaaaagactacctttccatctaattaattattttacagctcctggtaagaaaaacctcatctcccatagctaaagcactccaagtgcaaaaaatgtggaattatgtttttagttggaagatatgacttgaaatgcttttgtcttgagacgtagactattcacactgggaatttatagatatactgcacctgaatgaccagtctcccctgtatgtttccagccctcttctccacgtgcccctcaacctgcctttccacctccagccatggtgcagtgaactgcagcaaccccccgtagtggtcagtctacatctccattgtggtcttacccaacattcagtccttatcagtgacagccattgatccaggggtgttgtgcagttcaatggcacaggatgctttaattttctccctctgttttttcccattccacagggggtaaccagtttaaggagctgttcacttgactggtatgtggggatgctgacgactgcgctagcttttcttaactcatccagtagccagctcttgagttcagcaagatgtagcagctagccccttccctgcccccatctttccccttgactcaccatgcaggcctggttttattactcacttgactcctgcataatttctaccattatcaagagcttttatactaatacatgttcaactccagaataacataataataaagaactggtgatcttggagtttgtgtgaggattccaaggaagtattactgaaatctccccaagttattcttctttacacataaaatagaccctattccaattctgagagtcatgtttgagattctgaagatttacccactcatgtttatagatagaaaagcctagaacaaaaaaacacagacaaaagtccaggggaaacattttcctgtttttccctttcctcttgctcgctttccctcaactttccacacaagcactccaaaataagattttttttttaaagaaagacaagagaaaacatttcgttgaatttttctctattttccacaaggttttacttccttgttcatattcaaggtacttaaaatttggcagatggtgtttcctataacactcaaacttttcttttcttttattttaagtaaatgaaaaactgtgaaattttaactatgaaggacatgaaagtcagattccaaagaggaaggcactgcctcttaccgagtatttctcctttccgtagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatggtgagatggtccacctggatcaagctctttctctggccctcacagtgttgctccctctagcagagttagacagcagaaagacactgggtctcattctgccttttttttttttttttttttttgagatggagtctcactctgtcccccagactggaatgcagtagcatgatctcggttgactccaacctctgcctcctgggttcaagccattctcctacctcagcctcccgagtagctgggattacaggtgaccgccaccatgcccagctaatttttgtatttttaatagagacagggtttcaccatgttggtcagactcatcatttcttttcaaaacaaggttatgtttgtttactctaattcatcttccaaagtcttttttctaagccacacataatttgcttgaaaccctaacatcgaggaaaaaattttcaggctagtgctatttgatatttttttcttaaaaaagtctttggtgcaaattgaatgtgcagacaaggaaaataatttgacttcctggtatacattttgaatttccagcctagatgaaggccaatgaaggcaaatagtaaagctctcacttaaaaataaataagtaaagtggattttaatagcagaaccttcaaatatttggcaggaatcagagggaaccagttatatgaagccttggtttacaatatattatgtcttttgccagtggagtttttttcttaggatagagaacaacctgtctgagcaaacatcttgtctgggagaatcagaatatttaactccatttattcaatagaaagtgtcagctgaaggtatctgtattttgactcccttgaaattcacagatacatttgctgggtgtttataccatctacctaggcacctttaggcaaaacctggtatgagaaaggggtctttgagccccaaatcaaatgaagtcaagttttccagtaggatatttgttccgactccctctcctgccctattccttaaagcaaacaccattcctttgtactccttgaaattagaggcctcactagtattgtcagggtggcctgaaggaggataatgcatttctgtatatttagacacagtgcagttttctctgaaattgaaattttgcttatgagggggtcatttgtattgtgtctcccaccttttaaaatgcactacacttctccacagtctggggcggggggaaagagggaccagataattttcatactaaatcagtcagctggatgcaacctttttaattaaatggagcttagacagccctgaagctaatgaaaatctctagtacaacattacccttatcagattttaattttacacattggagtagagaaatgatgcagcataggcaggttatgaaaagaaaatcagcatcacagtattggaatagcaatgcaaacagctgtaggaaggtgccgttcacaaggatgcacaccattcctatcaggaggccccgtgggcccttcctgcactctggcagagaggagagatttctgaagctgtttaagtttctttaaattaatcggcagtcatcattggatttggagcacagtagccataagaatgtacactgtgtagtgctctctcagcatggggttttgcttgctaaattctggtatcagcgaatcggaaatgcataccagacccttttaaaatgttagcatctttagtaatctcttttatttttctttaattggccctatatacaattcataaataattcaagtgttttcaactcatggaatattaaattttttaacctgccaaggcaatttgagtttaatttatacactaaaatatatggactaagcacaaattttttgcctttattgtggaaaacctgatgtcgtttgtgttgcagggataggaaactgataggaagtttaagtaattctagcttccacttctgactccatcgtctacgtttactgaaagttgttcactgtctttcttatcaagcaggtgtttccgttatattgcacattaaaatcagacttggatttccaagaggaaataaattttggctcctaaacataattaaatcatagtaaagaagaaaaacaaacaaaaaattattattgtgtttacaattctcaaatttttgactagtggagttttacatagttttaccctttctccacaagaaagttctgattgttttttcaagatctctgatgcctgaacagtgtgtctctcaacacacttcccaaatttccagattgtgttagcagtaaagcatataccacagagttttcaggccagtgtggaaatgaatatctcaacttgggataagagattagctatgcctttcactgataaatagcagcattaaagaagctgacagaaatgagttttcagtgaggttagaaatttttcccactgagggttttcaggagacataattggattgaaggaaactgacgttttggaaaggaaaatgtgaccagagtcactagactcgacacattcagtaccaggaggaccttccatttgagagctccagggcaacctggaaccactgtggtctgctctctcgaacatcctgaacagagtaagaggctgcaattagagaaagaagaaagaaaagtaacttctgtggccatatatctcttgagactgcagtagtgacgtcaccatggaatgatacaagaaccataatattttaaatgtgttgttttcttatccataacaagggacttagacatacccataggaagaggcggtatgtctggtggttgaagcggggactttaggatcacgtgtccagagcttcacctctgactccaccacgtggggtcttaagcaagttacccaacttttctatacctcagttgcttcatctgtaaaatgggggtcataataatacttgcctcaaaggaatattgtgaacattgtctgagctaatccatgaaaaagcacctagcacagtgcctagtatataataagtaatcagtgaaagtaggctacaattattggctttattaaatgagagaatgtctataagtgctctttgcaaaatgacaggacatgccaaaaatgtaacatcttattattaaactttggaaatacttgcctatcaagtacaccactgtaaaacagaaaacatttggagtgtacattcaaaataggcagcagctctcttctctggcctacattatttgttcaacaccttttgcattcatcatccatggcatacagttttgtgcattatcttatatcatttttgtctcttaattattttatatgtatgaagatttaatccccagtagtaattcaaagtcaaggtaaatggtatgacctttaacctgcctgtagcaattggcacagtctgagaaagcaatagctggtaaataatatcttccttattgacttattaattgtgctgtacagtcctaacaaatgcccagtaattttcaaagctctcaatgaagaagcgggtcaaaaggtgggtgtagaatcccgaagtgcattcaccgtaccctggcttcatttgaaacacagatggtactttgtgaaaagtacgctaaagtgtcggtggttgtaaattggccaaacacagtaataactgcgtcttgctgaaatgtcttcttgtacacccaaagtagaatgaggatggtgagagagaatccattagggacatctcctgcaataaatactcttttgtctcaaggaaaatgctgctgcagtgttcacatggacactctggctgatattcccgttcattcatgcatttgtttattcattcattcatgtattagtcattatataccaggcactgttctagttgctaggatatatttagtgagcaagacaggcaaagtatatccctactcttatagaattcacattctagtacagacagacaaacattaaaaatatattaaataaataaagctgtttcagacagcaataagtaccatgaagaatgtaaaacagtaatgagatagcatggggagggcagctccttcagccagggagatcagcaacaacttctctgaggaggtggcacctcgggtgagacctgaatgatgagaaggaggcagtcatacaaacaactggggaaagaacagcaagtgcaaaggccttgaggcaggaaggaacctgacttgttctaagagtagacataagatcagtgtggctaaaatatacaaatgatgggtagagtgatatggatgaaactagagagataggcaggggctgcctttgattctctttgtaatagttagctattcaggcccggcgcagtggctcatgcctgtaatcccagcactttgggaggccgaggcaggcggatcacctgaggtcgggagtttgagaccagcctggctaacatggcaaaaccccatctctaccaaaaatacaaaaattagctgggcgtggtggtgggcacctataatcccagctactgggtagggtgaggtgagagaatcacttgaacctgagaggcagagtttgcagtgagctgagattgcaccattgcactccatcctgagtgacaagagtgaaactctgtctcaaaagaaaaaaaaagtaacctattcaaacaggagtggcatgatctaacttatatatttagaaggccaccctagctatgttgtggaaggtaggtatgcaggagatgagttgggaagccatgtctgaaggtgttacagtggcctagatgaaggaggtggcagcttgaagtaggaaagtggagagagagggggaatccaaaccacaaacagggcagttgagtagaaggagcagaccagatggtttagggtaacaaaattatagtggctatgaaagtttctgctgcagatttctgagaaattctctaaacttaaatgtccaacgagtgaaatttgttgagtgaaaaataaatttatttcctttaaaagatactttattgttggcacgtaaatggaaaagtagacaaatcaatatactctaaactcatttgtttttattctgtgtgccagcaccatgctaagcaccgtatttgcctaattctcaatatccctgtgaggtagatgatttcatgatctccatttgacgtatgaggaaattcaggtttagagtggctgagtagctggccaaggtcatacaaagaggaagggctggaggcagagctgaaacccaggtctgcttcaccccgcagtgatctgtccgtgctagtgctttttttttcatgtcctgtttcattctagaaaggatgcgaattgaccaattcagctggcatcacagttgatgtaacttaagttcttatctaaacgactgtcctttcaatgcatagagtatttcacctctctacatattcacttgtaagacacctaacaccaaaatcatgaaagtagaaggagatataaattcatatgttaagtcaggcatggtggctcatgccttaatcccaacaactcagggctgaggtagaaggatcacttgagaccagcttgggcaacataggcagaccctcatttctacacaaataaaataataaaaaattagctgggtgtggtggcgtgggcctgtagtgccagctactcaggaggctgaggcgggaggattgcctgaacccaggaattcaagattacagtgagctatgatcacaccactgcactccagcctgggtgacacagcaagaccccatctctagaaaaataaaataagttcatatgttattttgagttctttaagattattaaatgaaaaacttcatatcagacataataacaaacattatattgctcatatttcagaacactgggtggaatatcaaatcttaatattgaagctagaatggaaacatgataaagattttctaaaacataaaagggacggcaatttgaaattttaataaagtttgaaataaactttattaaaattttatggcatcaaggaaatataaaaacgtgaaatattttaataattatttctaatgtaaatatgctttttcaaaaaatcataaaatatagagacttttatcttctccttattagtcgagatacagataagattctgatactgatagatgattagagtggtttattgttgaggaaaatcaagtccaagtgatggattgtagtgcaattaaaatgtcagagcagtaaattctgatgtgtgactagtaaaccacttgaatcatgcaccaacgtgatttattgctctttcttttctttttctcaaaacaagtgctactaactggccaagatttgcaaatctttaattactaattgtgtgccatagatctttgaggggctgacttttaagttaaaaaaaatgttcttaatctcagctgcaaagcactgagggagattagaaattgattcaatagtcatcttaaaagaagaaaaaacgagctgaggaaagatatgcattattcttgggaagatgaaaagtttacatcctttatgttaatcatctattttgctgaccactgagaaaagggcaaagccaagtagatttgtttttatttgcaagcagctttcttttttgttatacttttaatttgggcaattcagttatttttcctcttttttggttctttgtttgttcgtttgtttttcttatttttcatcatcacttcatatgggcagtgaaaattcagaggagcgacaggcaacttacctgggattcctgggccagcaaccacagcagccttcacaccaaccatcactataacacgtaccaccctgaccattgcagagtaccagccctgacattcccgaaagcacctcctccaaacagccctcgtaatgttccatgctttctcctcctggtcttttatttcaattatatttttctcacactctccttttctcatctttggcttcatggatgttgttttttctgtttcttatagtagcaatttatcatttctgacatctcctaggtttttttcttttccatcagaaagcatttgttgttaggaaaggatgtaaatgttcagaatgctttatatgtggctcaggaagtaacaattcagaatattatacagagacaatgttctcaggtcttctttgtatatgtggaatcacttatgaaattcatgtcagaaaatatgaaaatgagattatgtatctgatgcattgagttgttcatggacaaagttgttcttttgtttgtttaaagcaattctcacagagtctctttgtgttcctatgagcttataaagatcctgctgcccctcagcatttgtaggctcttgtaaagcattgtctcatgctcctgagagctggcctctagctggctggggtccttcctagccattgctatgcatcatgtgtgtctttctggattgttactggttgacaagtgtggcgggctcacacctcacctgagagtgctctgtgcaacgtcttcactctcttgcagcagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcatgtaagtgaaatgacagccaatggcatttggcctggaaaaaacctgtgggcaatggagccttgaaaataccgaaattgtgggaagagtgtttcacagttgcttaagtgatcaggtagatgctgagcagctaacagctctgtgccaaagaccgttgacacgatacccagtatctgtttggcaatgactgcaccccaatttaacttcagactgaattcattcatactacctttgcctacaactttttatttgagatttgagatttttcttgctcttttgatgtcataacatacccaaagatatgatttttcctttaagactccttttattatattctgggtggctttggacatgaaacctttgttcttagtttcttactcattctaaagaaattttgtgaaaacgatgctccccttttgataaatataagattctcatgcattcatttaatgttgtcataaattttatactaaattatattttgttaccctcctccccaaaacaatgataaatatgaacattcccttttaaactatatctcattccccaagactccaatactttttccagaagcctaccccactggtaatcagtgatctaacatacacttcttactgtccactccagcctaaggaagattggaaggatgctcagctttacaataagcatcctaaagtctaggaatttcaaccatgattcttgtaaaaatgatctggacagccaaacacgatatagactaagcaaaactaggaagatatagttggctacttgctttgggatagctggttgtctgaatagaggggtaaaaaaggtgattgaatgccttaaaaagaaagaaatataaatcactcctacatttatcgtttctattggggaagatcattctctcttatcatgatcatataacttgtggaagaagagaacactgacctttctaactagacctaatcatagtctagagagtctgtttcttgtcatgtatcccttttgatggccatgattatgatttaaacagagaaatttaaagaagatgggatctcttcctgtgctcaccatgggaataaaaataaggaacatccttaagttacttaaataaaaccaaagccagatacttcacagctgttatggacttactggcttttcagcttgtttgcaagagattcatctccccaggaggatctctctccagtctcaccagggccaccctaagtgcccaagaccagctatcacccacactgggagctagtttcttcatgatacaggaaactgaagctttccctacagtgaactccattgcataagacagggtcaccactgtggtttgtacatgatttagacttgcacatacttttacatataaggagatttgtcatctttggtatatgaaaatgatagtaaaaatgaaattaggaaagtggaagattgagtttagtcaaaatgagaacaaagtactcctggagtcccatgtgttttttagctgacactagagtaaattatttactcttggaagaaactagttgaatgcaatacagtgaactggttataagcctagactctggaaccaggctacctgggttccatcccagcatcattaccttctagctgtaggaccctgagcaacttctgtaaactctctatgcctcaactgaaaatagggaaaatcacttcattgggtaattgtgaagactgcatgaggtatgccttgactgaaaataggaagaattacttcattgggtaattgagattacatgagattgcatgtgtatatgtgtttagaacaacacctggtaaatagtaagcacaatttaattgttagctattttgaatagtttgtgttaactgtcatcggcctaaatatgaattgtcacatgagaaaatctcttgacagtgctctcaaagttcaatctttttaacgaggggtacattttggcataatacgtagatctttagtcttctatgtaatgccttcagggtttgtggtgggtatttgtgtatgaatttttttaacagataatggctttgtgtgtagtactcctcagtgacaaaaacaggctaacagcactcagcagggaagagcaattaaaatgaattcattagtgttcatacttctgcttcaaaggctagtatttgtttgtgttaggtaagacttgctgtgttgattagggacattagtgaatacaaacaaatgatgtttggctatctcaggttgatattttcatatcttaaattttgtagtaggaaacaaagctgaggcagcgctgtcactgatatgcataaccaacgcataaattctctcttgaatcaggacattattcttcaacatggtagaaatacctatttcaatacatttctagttgtttgtgtttgctgtagacattggccactagagcaccactcacaataaacataccagaatgtttataaatgtgtctcaggagatcacacattttgtattttattcaaaccataaattccaaaatgctatgaacttttattcacacttcaaaaagacctgaaaaaatgatagcattgcaaaggtttttttgttttttttaagtgaggatttttttcttttcttttattgcataggtttggtatggtcacattagatgtaaaggtcttcccaaataactgataataaaagttttattgccactcttagtataccatggtttatttccactgctttatttatgtctttatcctgtgccaccatttgctgccccctttgtaatacatatgtttctatagcaaccaggccatttgtgtagatggtgaatcatggcaaaaagtctctttgctgtattggtgatgacttgaggccagagtttgcaaaacagaaaatgctcatatgtatttccaatgccaaggaaggagatgcccagaaaaaaaatgaaatcttctcacatgaaaattaaaacattctgtatcactgatcaaagaggaaatacaagaagtctgtatatagtgatgtgttacaagtattaaaacaggaaggtgtcatgtttgtttcatagagaaaataattaatacagcacacattaggctttgacaagtgtcacaaagccctggaggcattgccaagccatgtcatagagggagccctctcatctcctctgctggaatcttactgccctttccctggctgcctgtgctgcctctttttctgccaaagaggccaagtctccttccagaacctcatcatctccctgtaacaacagcatggctgagcaacagatctagctagtttgccctgctttctgttccccaccactgtaccctgggccagtgtagagactccgtctcttcccagtctgcctgaattgcggcaaagagtagaagttagaacacatttccagaatggtctttgctgcttttgtcatcagtagtaactactattagagagagtgccattgaaaagagctgaaggaaagaaaatgaaaaaacctaacaacttttctggtcccttctattgacctgggaacaaagaatggaagataaaggcagctactggtaagcttttataagtgaccattcagggagccctgaagaagacaccctaagaactgtcctcacaccctcatttggacaaaggagctgttggccacctctactgcgttcctgaaccagatcacatgatacacatgtgttaggtctatggcaggttgactatagtgtgggacactttagtgagacagaagtcttagattacaggatcaataataaaaacacattattccttgggaggctgaggcgggtggatcacttgagcccaggagtttgagaccagtttgggcaacatggtgaaaccctgtctctacaaaaaagagaaaagaaaaaatcaaccaggtgtggtggcacacacctatagtcccagctacctggggggctgaggtggaaggatcgcttgagcccagaagatggaggttgcagtgagccaagattctgccactatgctccagcctgggcaacagagtgagagcctatctgaaaaaaaaaaaaaaaaaaaaaaaaaaaaaaaaaaaaaacagattataataataaatctttggggtccttagttctctatattttttaaatgcttctcatagctgataggaaatctttcagccttctaaattaaataagcatttggtaaatttttaaacttttggaggtgtttttggctccccctgccctttcttacactaggaagaacaagaattgacaaaaatgtagtcattccctacaaatctgaagagttgtgaacagaaccctccatgtgagaatgggaacaggacagagcaggaacgaatcctgaacacaacctcggcatacaccagttaggatgtcagcaatttagtcatttccatcttcaccttgaggagtaggcaagcctcagccaaagccggtagcttgcagcaatgacgactgaataccttgcggaagcatctgctactagagagacaattcaccatccacattttcaaatgacgggggaatattcaccttcatttactttgctggttgaccacattaatgaagcaggataatcaagctcatttttttctcctccaagttaatattgattgtttttttcttttgattccttatctttaaatcacaatatatctttttcatatctggtaatagttttcaaaacttttatatgtgtaactaatcaatacatataatttcaaatgaaattttgctctttgtcaaataaaagattccaatatgtcagaagactttcagagttaattataaaatcataaattatttactacaatgctatatgtataatataaattataactaattataaaaccaatacataatacataaatttattttaaatcctaaattcaattttctaataatttttatcatctcaacttgcctccaaatagagcttataaatttaataatattcacattaaattagtacttattttcaaaaccttctagagaataaaattattcaactatcttctctgtttaaaaaaacatagcaagtctttcctttgagaaggcttcactatatctagtataatctcacctgttactattaaactgacttcttttttcttggctctttcttttttttttttttttttttttttttttttgagatggagtctcactctgtcacccaggctggagtgcagtggcgagatctccgctcactgcaagctccgcctcccgggttcacgccattctgctgcctcagcctcccgagtagctgggactacaggcgcctgccaccacgcccggctaattttgtttttgtatttttagtagagatggggtttcacgctgttagtcaggatggtctcaatttcctgacctcgtgatccgcccgactcggcctcccaaagtgctgggattacaggcgtgagccaccgcgcccggctcttggctctttcttagtgaagatggtaaacagctgccttaaagtttctgaaacagcttttaactccaattaagtagtccgataatctgtatcaaattgtgatctcaaatggaaaaaaaaattaatatgaacctataaaagagtcaaagaaagtaaaggattactgattaagtccaaaaagcttcacctagaagataagtggaagttacctgccaaataggtgatgctgtaacatgatactctcatcttctgtgagtaataactggaatgcaacatactctccagatccttattgacaggaaatggtgtctcccagtggtttggtgccactgatagcaaaaattattatctggagagtaatcacggtacactctacatcagcgaaaccacactagaacatgtgatctaaattaatacatgacagtctatgtgtcagacctggcaattgcaagcttccacctgtaagaagcgtagggttggaggctatcttcaccccccactgcaggctatgttaaccttaatccagctgagatggaatgagaatggtgcttcttaaggaaaagtcgattttttttcttactcctcctagacaaatgatctacttcaccctcccttgccccatcagctgcaattacctgggccctgaagaatgacttgtagttccttatggtaactcagcagcatctatgagaagtgttgtttcctaaaaggaatatgtagatgacatcccaaaatttgattcattcctcatttattcagcatttgttgaatcttccaggcactaagatttcagagattgaaagagctggttccaacctttcaaaaactcagggtcaggtggagagaaacaggcatatagagacctgataaatgctgaaacgggaccatgtattagaaatgtggaaatgcagaaaagcaagtacctaattctgcctggataaaacagagaaaaggacccagagcaagagctgagtggcagagggcacagtatatatgaagacacaaaagtgtgtcaagagggttggggcacatggcacatgaagggatcacagagaaacaggagagtggatgggcaggagaaaggaactgatgaagggtcctatgtgctctgctagaattgaaaagtttgttctataggaaacaggaagctattgaaaattcaaaacagggcaggggttacccttgcatgttagaaaggctaccctagcagcaattggaggctgttagcataaaacaagaggcagggtcactagttagaagtctatccagtattgtacactggtgatgatgaggccttgctctgtagtagtggcaataagaaagggaagaaaattcactcagttttgaaaacattgagtttgaggagccaatgagacagtttgtggatgggatatccattgagtagggaaatccatcactggagtttgacagaaactaaagagaaagagttgagaagatacatgcagagtaaataagttggggcctcatcatatccggaaagtttgacaggaggttcatctggaaataatatgtggggaatattttgcatgtaaggacccagaaataagtacattagaataattcaaataaaaaataatgaaagcccaaattgaggtactgaaattaataagggaaaagaggatttttgtaagatatatttcactagtcatccagaaaggatttagcaatggatagaatttgagacaatggggagttgtgagttaaggctactttgagattttaagcccagagggcaataaaaatgatggtcctgttcacagaaatagtagtggcaatgagagagggaagaggattcgctcaattttgaaaacattgagtttgaggagccaatgagagagtgtgtggatggcatacccatcaaggagggagatccattactggagcttgacaaaaacaagagaaagagttgagaagatacatgcagaagacatgtaggcatgaatgagggaaagaatgagagtagaaaagacttggaggatggaactgtgcgctgaaatgcagagggaggcaaagcaactggctggggctgaaaaagtaagacactcgaaacaaaccttcatcaaaaccaagcaaacaattttagaaagcaagggatggtcctaaagccagtcgccagctagagcagatgaggccactgattttagaagtcaggaagtcattggtgagagcagtttcagtaaatggtgaaggcagaagccaagtttttagccacttcagaatcagtacacgtctatagacagaagtcagaaagctgggggagtgagcagaaaagtttggaaaagcagcaagaggcaaattttttcatggcacaaaatcatggggggtggaaagggatagtattaaaaacactaaaagggggaattagccttgaaatggaaggaaggatacaacctcctgtagtgggggaaaaaaggaagagggaacaaataatgataaagagaaattgaggctaaacagaatgttgtttaaggaactctcgtcaaagggttgcatcttttcagtcttataggaaatgaggagtaacatttgaccatgatttagggtagaaacatttgagacaaatcctttgtggaatgaaataaggtgtcaaaatatcacacaacaaataatttaaggacctaataggattgtgaattcatagtgacttttcctagcacccttcagcaacttagtaacaacagtggagttgaccgggcattaccatagaggataaagtattagggtataggaaaatcccatgaggtttaggaatctttgagcctaggagatgcattattaaaatgctcaccaggggtccaggcagagtgtggggaaaatgatgccagcaaagccagtgggcgaagacaatggctttccacctgcacttaccagatccccacatgaggccagggaaaacctcaggggtctcccattcccacatcaactacagtagctgtttttatctggaatacaaaggcatcccttatatgttttcattttaagggggaaaaatctgttgctaaaatcaatagactcaggagacaagtgagagggaatgggactgaaagtcataaagaggagacagattgcaggaagtgggagagatggctaataaagggtatgtgatcaacaagggggattcagatattgagatcttgaagatctattcattttgaaggaagatggagaccaccatagggctctgctggcagagagtggaagtagggtggtattgctaggaactgacatgaagagagttgaagaagcataaagccagcttgctagaaggttatcatcataatggcaaagaggcagaggacaaggaaaagctataggttagaggaggcagactaagaggcaagtcctgaagtcatgaagaaaagggggagaattttgaaaaagtagattatgggcttgaaaatgagacagagcagaaataagtacagaatatggaattttaaataggagtagttgaatcaatgtaccgtatgtggagagcaaggagtattatgaacctgtcttcctgccacctgtagagggagtaaaagaaaatggcttttgaagagggttatgaggtatatggtgttatcaggttttagttaaagggggccagactctttctggaggaagactcagtgcagcataggacctgcaggcagaggctgtgctcacagagagcacgggtggccacactccaatgggcagggctgagagaaagacatggaggagtggagcagccctttcatgagttcagaatggaaataagatggagatgtctgctggaaggtgtagatgaatatcagagagataaatgaaagaggagaaataataggaaataaatgaaatacaacaacttagactagaaacccagtgggaaagagcaaggactgaagagaccaaactctggggtggtggtggggggcggcaggaggaatgtacagagtttaaacaatgtcatcatgccaacccaacactagattaaggttgaggaccagcacagcctcaccacgccaggggccagatttagtttaattatttcttcaaagctgaagataggattgtttaaaagtcacaaagcccagatgcaaatggctaaagtggaaaaaacatgaaaccagctagctcaactccctttttcttagataggatatagacacacaaagagacaaaatggcctaccccaaggttccccagctggtgctcagtgatagagccaggactaaaacccatgtaacctgaccctaaggccatcctcttaaagcccccacaatgatccctggtttgaggagtagggagccagggtgcagggatacactgatgttattatagaattgtgatgaatattgagagattcatttatctttttcaactcttgctaaaccagaggccataatttaacctcccaccattgccattcagtttttatgcagagacatgatctattttggaaatgctggtattcctggtgcttgctccaacctaaagtcagtattttctgtttgttcctctagtgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagaggtgagacactttctttcacagcatcattttctgctctgcgtttctggtacctgctatctttgaatggctagtaaattatgaaacattgctcaatgcaggaaatgcaagatatgatgaactgtcttctgacaataaaattttatgttcttgatcaggtttgaaaagagtaatgagcatggatgcctttaactagcagattttgtccatcaagggactagaagctatattaattaaaaaggagaaaaatccataaaataaacatatcctgaagttcaacttcaatagtttctgccatgggggaatatacattcatcattactaaatattggtttggatcagattctaacaataccatggttatgaattattaattacttctctgggatacttcaggattcccctgctcacaattataaccatgaactgcaacaacacacgacgttgaatttgacctatatgatgcccacagcattgaataagcaagaccaaattatgatgctattttgcaaggatcaagcaaggtagatttggcaagctcagcttggtaattatttactccatctacaacctctcacatgtggttctaaattagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcaggtataatcatatcatctcaggagtggactgcatgtgagttatattggttatgtggcagagaggaaactattttttttttttttttttttttgagacggagtctcgctctgtcgcccaggctggactgcggactgcagtggcgcaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaagaggaaactattttatatgctgaacctgcttttgtttaggaggtttggggtgtcgttttgaattgaacattgttttggattattccttaaaatgtcaccacaagaacaactgaaaataaatgtgacaaattgtataatagccacaactatagaggcgataaaaataaatcatgtggccttcattctttctttcttctgtatactagagaaaccatattcttcagtcacagagacaagtaaagcctctctttgacccttcacactgcaaagaacacatgaaacttcttttgagagcaatgaaaattccctaagtgtatttaaacaagcccagttggcaaatatttagtttttaatattaaagagaaatgacagcagatacttgttaaaaatgacaaggaagacttttgttggaaactactgcagtagggggtcaagaatattgcagtaggccaggcatggtacctcatgcctttaatcccagcattttgggaggctgaggtaggtggatcacctgagatcaggagttcgagactagcctggccaacttgatgaaatcctgtctctactaaaaatacaaaaaattagccaggcatggtggcgggcacctatagtcccagctacttgggaggttgaggccagagaatcgcctgaacccgggaggcggaggttgcagtgagctgagatcacaccactgcactccagcctgggcaatctgggcaacaagagcaaaactccacctcaaaaaaaaaaaagaaagagaaaagaaaaaaaaaatattgcggtaggggagggagattgaacacaactccaaatatagccagagcagttgggaatttatagccagaggacaaagtgaagaggagggagtcattgaatggaaaattactaaaaggaactcgattaaatatcaaaggtggggggcaaaggggattctccctaaactgactcagcaggattcttgctaaaattgggctcccagcccaaaaacaaggcataatcaagaagagggctccagggagccaaactaaagtttggttacaggcagagtcctgatcagtagctaacaggtgtgtggattttagagattggtgctagttcccatttaagaaaattgtcttcacacaatgaaagactacctcacagacccaataacccttaccaattagtaaagatatgcttgtggactcagggatcacattattccaacaaatatttactatttaccatgggccagttatgcccctacacaatgtagatgtaatagtagacaagaaagtaaaaaaagcttatattttttaaaaagcttatattgtatgaagcttgtattgtagcagcatatagaaagttaatttaaaaattaacaaatattgcccagtgtggtggcttacacctataaccccagcactttggaggccaaggcgggaggatcacttgagcccagaagttcaaaaccagcctgggaaacagggagacctcatctcttaaaaaaaaaattttttttaaattagcctggcatggtggtgcatgcctgtagtcccagctactcaagaggctaagctgaaaggatcacttgagccctggaagtcaaggctgcagtgagcagtgattgtaccactgaaccccagcctgggtgacagagtgagaccctgtctcaaaaaaattaattcattaaaattaacaaatataaatttagagaataagtgctctgaggaaaatacagcagcatagagggttagagaatgactttaggggagctagttttgtaggctgatgctctaaggagtgacatttgggcagggatatgaaagctgagacgggtaagccttgtaaggctctcggaagaggcgtgctagggaaagggagtaggcaatgtaaagaccctaagccagaacaattagcttgctggagaaacaacaaaaagggctgttcctggaacaatataagggagttgggtttggatttggtttggatttggtgatggagttagaggggttagagagaccgactaatgcagtgtctggtaaggaatttagatcacattccaagtgtaatgaagccatggagcattttatgcagaggagctaatctgaggaatgttttagaaagagccttctgacatgggaggggaaaatagcagaagcagaaaaaccagttaggagattgtggcagttggacacgtaaggcatgatagtggcttgacacagtggtagtgctggaattggagacagatagtggaatttaggacatggctcgaagcagagctaatagcacttgtttatgggttggatatggaagatgagggagaaggaagagcatgaatggctcctgaggtgtgagggtgagcagtcaggtagacagtgatgtctttagctgagaagactggaagaggggaaatttggagataggaaaaataattctattttagagatgagttggcaaatccactgctaatactagagaaaaaagataagcatgtctcttccttaattcaaatgacagttattgagcacctgttactaggtgctaagcactgtactattttcagatcattgaaagagaaaatagaaaggatccatatcctcaaagagctcaaagctaaataggagagaaagagctgctgaatggtaagaatagacttgccaaatttgtgttgccactggaatgcagaaagaagggcccaggagagagtagtgcaggcattaccctggagcctaggattcagggtctgggctggatagcaagaccgaggaataaccaacatggcagtgatggttaaagtcacaggaaaaaaggagacccctaaggaaagagtggcagtaagaaagggaccaaggaggggactctgcctgaggaatactgagacttaaagggaaaaaagtgtgagcaaaggcgatgaaggtgtaccttgagaaacggaaggagaaccaaaagaaggtggcattttggaagccaaagaaagaatttcaagacaaaagtcactattgatagcttaaatatactatggagaattcaagtaacataaggtaggaaatgtcccttggatttggccattaagaagaaagacattgccatagtatgaattgatctgaaaagtaggggcggaagtcagattgcagtgagctgaggaatgagtggagagtgacaaatacagagatgctctgcttgctgtctgctttaggaactggattttggaagagagtttggccggaaaaatgcactgaatggatgaaagagactggacaccattgtgggctcctcttttgagaacttctgcatttacttatgtgcttgttgctctattttatattgtattatatcctttattcagtagttctcaactggggtcaattttgccccaggggacatttggtgaggtcaagaaatttagctgtagagaaagaagaagagacaacagatagtgagagactcaaagttcagaggggtgttattttgttttgcggctttgttttgttaagattggagagattgagcatgtttggggcctgacatgaatgagggagagaagagataataatggaatcagatccacaaaggaatgagaaagagaagtccaggacagaaggtagaagacctcttatgaatttgtagaaaaggttgtgagacacagaaagacaaacatcacatgttctcacttaactgtgggagctaaaaattaaaacaattgaactcctggagacagagagtagaaagatggttaccagaggcttggaagagtagtgatgatagtggggagtggggatggttaatgggtccaaaaaaaatttggaaagaatgaataagacctggtgtttgctagcacaacagggtgactgaagtaaaaaataatttaatcatacatttaaaaatagccagaagagtataattggattgtttgaaacccaaagtgtgggtactggagaggatggacaccccatttgccctgatgtggttattgtgcattgcatacttgtatcaaagtatcccatgtaacccataaatatacatgcctactgtgtacccacaaaaattaaaataattttaaaaaagaaaagaaaaggatgtgagaatataaatacatttttagctggcttttagatggttcatgtaagaactgtcaagcaagggtgaaaagatcagcagcttcgagggttgaaaagaatgaagatttagaatagcaaatcagaggaatgcatgaggaaaccaaccagaagctgtaaaaggatattcaagcagtgtctggaagcttcaagtttagagcagcatcagcctacacagtggagtaagttgttgttgttttttattttcaggagacctcagctgccaagtaaaaagagcagagaaaatgaaggattagattgagccagagattgaggtttccagagaaggttcaacagaagaactagtcagggaggttcaaaatgcttctgggagagcagatgaaaaattatgatagtaacatcataattattatggtaatatttatcaaatgcttgctctgtggcctgtcactttctaaacgtggtgtgtgcatcaaattgtttaattcttataacagcaatggaagagattactatgattatgtcctcagaaaattgaggcacacatagttgatggtaggctggaattttaacccaggcagtctggcttcaaaggccacacctgcagcactacactacactacactactgtgtttgaaagaatctgagtgggagagatgagaatcaataatagatcagcctgatagactgagagaaaagggaagacttaaggaactagagatcttcaggaagaaaaagggatagtgagagaaaggaatgagggagctgatgtctaggagattgaggcccaagtgctgtattagagtttaggatttcagagaaggtccagcaagacttagggtggtgatttgtaaaagtggagtggaggtaaagatcctcaaccaggagagatctgagaattgggaacacagtgtaatggagggaccagccatgcagtgaaatctcacagaaggatggcaggacttagaattaggaggggagtaagaactagctgaattgcacatgccaagcacaattccacagaagaagctttgcagtagatgctttctgtcatgtttgggtggtttggctcacttcattcaggtctttgctcaaatgtcacatgctcagagaagccttccctggccatctatcactctctattctcttgctcagatttatggttctgcttagccattctcacactctgaccttatattgtatgtttatttgtttattttcactctcctccagtggaaaaacctatgaaatcagggactttgtgggttttgtttatgaatgtacacctagcacccaatgtattgcttggaatacaagaagctgtcatttggtcagtactcagtgaatgaggccaggcatggtgactcatgcctgtaatcccagcactttgggaggccaaggcgggtggattacttgaggtcaggaattccagaccagcctgcccaacatggtgaaaccctgtctctactaaaaatataaaaattagcctagcatggtggtgtgtgcctgtgatcctagctaccagggaggctgaggcaggagaatcacttgaacccgggaggtggaggttgcagtgagccaagaacatgccactgcactctggcctgggcaacagagcaaaaaaaaaaaactccgtctcaaaaaaaaaaaaaatactcggtgaacgaatgggtagagagcagttggctctactgaggaactgggatcaggaacttcagactgcatcaggagccgagatcatccctactgtttctctggggttcctggtctgtcagtgctgcttgtttctgtatatctgctccatttgtccctatagacaagtttcctctgactttttattgtatgtaattgtcccatctttgctaaagtacccagccagttctaatttctcattcccaggagaaagaatctaatggcccagcttaggtttggtatcctacccttctagtcagctgtgaccacggaagaatcaagtaggacttttcaaggatggatcagatggtggtgaagatatggttttcaaagaaggctgtccagcaaccccagaatgtacaataactacaataacacaacattaatggttaattattgttaactacaataacagaacattagtggtgaaatgtctcttgtaatccaatacctttattcattataaatggggaaactgaggctcaattggggaaacccaaggtcatacagcagggtgaatcgtagacctaggtcggttgacttggagtctctcttcaccatatcacactgcactgactcttcaaagagatgttaccaggatgaagcaattagagcaggagttctaaacctctgccctactgacattctttgttgcagggaggtgatttgttgaacattgtgtgcactgtagaacattcagcagcacccactcactacattccagttgtcaaattaccagcacaatttagtcttcttcataagcagtatctaagtatttacttgtgaatatatatgtgtgtattttaatatttgttgattggatactctaatatcttaaatttgagctcctaaaaaataggaactgtgtctgttaaacccactttgttcagtacccagcttacttgataagggacaggaaaaggaaatgttaagttcatctcccactgcccttgattgttccagaaagtaacccacttcaaatagatggcaataatacagaatagggcaagaaaagctatgttcccatcttgttgttccttcctcatgacagacatcactagttgacaccgatattctcccgctgagcccagatacagcatcatagtcctcaataaaacactctagttagtcattaccaacctactagtatcaactggaaactactggattcagaaaaatcctttctagccagtcaagaacttgggacattggtggggaatcactggatgtgagttgtttcaagactgttcagtacttctgaattcactcctaattttctggatgtaagccatccgtttccaaaattctgcctcagaaatgttttacaaccagatattaattcccaaacctttggacctcagagacaaattcctctattttataaatattttaagctgacatggagtggttaaaaaagcttgactcatttttgcccaaatctctctcccttttctccttttttttttttttttttttttggagacagagtcttgctctgttacccaggctagagtgcagtggtgctatcaacctccgtctcctgggttcaaccaattcttgtgcctcagcctcccaagtagctgggattataggcatgtgccaccaagcctggctaagtatttttgtatctttagtagagacaaggtttcaccatgttggccaggctggtctcaaactcctgagctcaggcaatccgcctgcctcagcctcccaaagtgctagggttacaggtgtgagccactgcgcctggccccaaatctgtctctttaaatataggtactatactccacaaacagcatagtaactttaatgaaattgttttaagtaaaaggtgcttataaccccatcatgctaataaatatgtttaaattttttatatttcttaccaaaatccttaccatacatataattttataaagctgtaaccataatatatgcacaatttatattttgccttgtttgttactgccttttaaacacccatctccaactaatatcatgaataatacctgaagtttctactttaagtctgaagttattttgttggaaaaaaatatatatctttgttctggaaagaagtctcggtgagaatcctatcaaataatgtttgccatcattatggagcccccagtgcctttctctgcattggtgggagttaaacgttcacgttcctcacaaagggtgtctgcattgatgaattacggtgtggttgttatcttactgtgctaacaatgaatgcttcaggcagaaaagcagaccacttggaaagaaggagacctttgtttacccaaatgtgtttttaattatagcattaacaaagataaagcaaaatcagggaagtacaaaataattacatgcgagtctaacaaaataaacatcatttgttcttagattctatgtacttcctctaaacctgctgtttttccaaatattggaccttttcctctttactagtgtttctttaagaaaccccaaattaaatatgcctttgctttagcagccaaataattatataaagaaaaaataacaaatataaaataaatcatgttggcatttaaagattaaaatgaagccacagcttgatcaaagagatttattagttgatatttgttcatcattatgaatatttcaaatctcatgtagtcagaagtgattcattactgttttccaggaagtgataatatctcctgcagtgtcattaacaatgttaatcttggtcaagtttccctggattaaaaatttataaaagcaaaatgttgctgtagtaactattctagaacagcattttctggcccttgtgtttcaaagacctcacttacacaagcttagcatcatgggcaagatgctatatacgtatacagatatacagatacatatgtacaaatatgtgtatgctcccctcccctttcacagagaactgtttcttaaaacagaaaatattaaatgggtaggacaggtgcagtggctccgcctgtaatcacagccttttaggaggctgaggtggacggatcacttgagcctgggagtttgagaccagcctaggcaacatggcggaaaccccatctctacagaaaatacaaaaattagctgggcgtgatggcaggtgcttgtagttctagctacttgggagactgaggcaagaggatcacctgagcctgcagaggtcaaggctgcagtgaactgtgattgtgccactgtactccagcctgggtgacagagtgagaaccagtctccaaaaaaaaaaaaaaaatggtcacacgtttgtgaaatgagttctacaaatagtgatgcttcatgcacatttacttatgggccatttgtgtgctttatccaagtaatcaaatcatttttttctgctatgcccgtaaacacttgtgtggaggctttctgcatgccctcatcccatttcctctaccgaatcaatgtgttcatcagggatctttcagttgccagcaagaaacatgcactccacctggtttaatcagagaagaggcattcactggaagcgcaatctgtgtttcacagccaggaagggctagaacctgacttcaatggctgtcaaggccaggcacaggctctctcctcatacacacttgcttctttcttccttctctctgctgactggctgctggtgcatatgggcaaaacctggccacttccaaaggccctctctgcccccagtgtgcatgctaattccaaattcttaaactgtcactttgaaggtagaaggaaggtggcaattagccttttgttgttaaagcgcagtatggggaggactcaggaaaggcatagattggaaaatattttgtaaggaaatatttatgacatttgcagctcctgaagtcaggaagtaaagcacacctaagtggttttttacctacttcatttctctttttcagattagccagtctttttcaaatctcctgtgggaaataatttgctctatctcaagtcctactgagaaattgaaaggatacaaattcttagtgaataaataaacaaataaatatatgtggattcacttcctggcccatgagagtgttagctgaagacaaccccgaagtcaaaggtgttaactcagtccgtgacactcacttggtcgagggaggaaatgggaaaggcagctgattgcctcactcccctctgaagtaaataaaaaccagagcgaaggagggagcccagagaaggaagaccccatagcaccactgatgctgagagggccagtctggggatccttttttataggtggctttctaaaagctaggcgggcccagggaaatcaaatttctattgtgctctccagtttaacactgtatggcaaaacttctgagttgaaaaatcagattctggtcttgtgagacatttaatacctgaatttttcctcagaaaggatgagaggtcaagaagagcaattcaaggccaaacaaagaagggagtcctctctctctttccatgaatccagtcctaaccatcacctccactttgcacagactcaaatgtgttaactatgtggttagtaaattaagctaagggcctgagtgcctaatggttctgctgtggttaattgtctgtgtgctggataggcacctgccttgagtcaagctgaccaagccggccaagtggatagctcacccatcccacaatcctctgcttatgctaaagtttccactgttcctgaagcctctccccacttctttccaaaaccatcagaaaggattatagtcattagcaacttagcatgaatagatgctatctcttcaatggatatttccattttaaccttatcattaattaaaggtctttctgactgttaaggaattttaagaagagtatatttaagaatctgtagcaatttcttcctttctcagacattaattaggtctggataaaatcagcttagctctgtcctgcgttgagattcagccagtgtacactggttctctctctgttgccttgatattagcttacttctatactgactggccagtatctgagcccactttcactcccttccagtgccctgtgatcctctctggaatctctaaaagctcctcattatacagaaactaaaggatcatttaatgtagttggaatctgctgggtccctgtgttccaactctgtggtcagcatctagtttgattggttgttttagtctttttgattgataaccagtactgttttggttgtgaaatattttgaatgtcactcctgattctacctctttaattgtacttttcacattacaaattaaggcacctctccacccactctcactgcccaatcagcaaccatcacaccaaactgacatctctcctgaaatctgttttcccaggtaccttcaaacaataaataggagtggaggtggggggaagaattactgaatagcacactcttggaaaatatggttgggggtggaaagaatataataggacctaaggttcttaaactttactatgcctgagattcacctagagatctctaggcctcatctttagagattctgattcatagattggaattattcaggaatcattatttgtaactcccattccaggtaaatttgatgtagatggtgcatgcatcacacttgagaaatactgaactcaactgttggtgtgaattatgcacagttgcctgtggataggaagtgtattcatcaccaggagcttaatttactaggattttaaaggccttcatcttacttcagttcctacagttttagctacatatgattatgatacaagtattcctaatgcatttttattgatgggtgctccagtcctcagtgttctattaacacattcttttttgttttgatattagagtctgtcatcccaagtagtggaacatttcatgtaaagctgcctaagaagcacaatgtggaacttggaataaccataagttgtaagtagaagttatttcttttaaataatttttaaaggcattagaaaactgtgttgtcaaatggtttgcaggtgtaacaaatgttttatatgtctttgcgaagtttttatatcatgatacaaaaatgtggagtcagtcacacctccagcacttactggctgtatgaatgagacaagttactcaaactctctccaatcttatatttcttcatctgtaaaatgaaaataaggatagctagaaaatataggattgttttaattattgaataaaatccatatttatatacctagtacagtgcttggcaagtgatgagtcctggtgagataaacatgtatctcacacaactagataaataattagatgagagatagatgcatatagattctctacattttatattgtgaattattagtatatcgtataatatatattattagcatattgtatattaattcacagtgtattgtgaattaagtttttataatctatttaacaaaaattacctttatttacttttaagactatcttcccatctgtccactaagcatctataatccttttcacaagactaaaacaatgtctcttactttaagtaaatccttgaattcctccatagtgcacagtgtctggaaaactgaaccagaaagaaaagtggagcatataaatgtactcaattccctcctttcctcgggctttagttttataactgctttggtaaaaacaactttgaaagtgttagctccagtggactttcatagaatggaaattgagggttttggggggcttttaatatccatagactaaatgcatccataaatgtcccaagaaaatgaagcaaatgttaaatgcctaaagaccaaaggagacgtagaggtaatgactgtgaccaagagctggtttcttcaagaaagagtgatgaggccacataaaagtgcctcactgcactctgttggatagcatttctgtcagtggttcaggcaaaaaataaataaaagttctcaattgggcagtatgaaatggtgctgtctgattcaacatggacgatacaaatttaatactgaaaaatgaaattttatttataaccaataacccacacatatctactgcaacactaaaaagaacggtactgcaattcaaaataaatattaagagcaagaagccacatgtatgggagagagcctagatccccccaaaccctaatgtgacctagtgggagaaaagtagaaagatggaatgggattttagagactccagcactatcctaagtgctcctaaagtcatttattcctttaattgggtcacttagcctctcagttttttcactatgcagcaaagatggtatgtcactatagtgtcaacaactagggctactaaaattaagaaagcgtatcagaatttactgttccaaacatatttagggctcaagatggcttctgcatgcaaacactcatgcaactttaaggttattctcttttgtttattccaatccattcatttattctgtcagaactagctgtgggagtggtgcgtcttggagttgtgcactatataacctgcctctgtacacagaaaccctgcccccacttccattctttcattcttctgccttccctcaacaaatgcattctgagtgtccaccatgctctaagccctaggctaaattttaagaatatacaccctgtccttctagatgcttcctgctggttggtattgtgaagtcatctattcctcagaagctttatcaccactgccacacagttattttactctcaaattttaagtaggaatattgtctttaattttgttttatacaatagatgtattcttagttacagattgatataaataaaaaatataatttagtcagaaagtatccatctaaaaataccctatggtgtatttcttattaaaaagtagacatttatatgctaatttgtttgagatgtagtcttgtacacaaactacaaaatatttgttttatccacatgaagaatcatttaatattatgctttatgatggtgttttgttttgcatgagtgttttacttctaaaatgggttttagtagcaataatggcaacaatctaaaaacccccataaagatggcttgcattttagccagccacaagcaaacgcattcatggaagctgaaagtgttatgctattcccggacagagaaatgatacatgagcttgtcaaacatgcttgtcagttcttctagagctacagctccatttgcacaactagtcgtcaccaccacgctgacttttgtgtctcctcatgggaaatactcatattttgccagatgacaaagcagactttgctctttaaaaaaagaaaaacaaaaaggccagaatccattttcattgttatgagttagtaaaatcctgaggcctagcacagttcctgacatacaatgtgcttatataatgcctccatttgctgagtgaatgaataagaagctttacctgcaaatgttttactaagcactatgtactccaagaaatgagcttccaagggagatgataaatgaatataaatgtttgtgcaaaggctgatgcatagacagaagaaagactgacttagaaaatgattaagagcaaggactcagagcctagactgtctcatgccctgattccctcaacctctctgtgccgtttcttcatctagaaaatggtgtacatattaccttcttcatagtattgttgacaagattaaatgaattactatatgtaaaatgccttaaacacattgtgaaccctaacaaacattaatgatgatgatcttcgtcattatttactttacacacagagccttttgaaatattatattatttatttatgttttattttttgagacaggatctcactctgtcacccaggctggagtgcagcggcactattagggctcactgcggcctcaacctcctaggctcaagcgatcctcccactttaacctcccaagtgtctgggactacaggcatgagccaccatgcctggctaatttttaaatttttgtagagataaagtctcactgtgttgcccaggctggtcttgaacttctaaactcaagcgattttcctgcctcagcctcttaaagtgttgggattacaggtgtgagccaccatgcctgctaaaatattttaagcacagctccagcccacaaaatctagtgccaacataagaaggaaatctgggaaccctcttctcagacacacacggatactgttagtgaaaccgaggtgctgcaaggacttgattcttctcattatctctataccaagtcctctttctgtcgtcttcaccttgtgcaagctctaagtattaagaaacagcccctcatctctggaagcataccagcagagcctttacggctcactcttcatacctaattgactgagaaatgagtctgtctgattttagacacagtgagcagtttcagactaattttcttaagttccgatgacacatttgcagcatattagcaccaggcattgcttttattgatgttattgctgtaatatagagtgatttattgtagcaaataaagtggaacagcctagcagaaggatgcagttcaggactggaagtcacatcctgatgcctccacaccttaaccagtcagaaatcccagagctcacaccttcctcacagcccacctctctttcgagtcagcgaatcctgattgtctctgtcacatcccattatcagtaaagtcctttttacatgggtgttttcccttgaggttttattacaggggtttgtgtctactttgtaccaggcatggcactatgcagttttatatgttttcttacttaatcctgaaagtagctctgtgacatctatctccattttacaaagaggaaagaacaactcagctgggtaacctgcccaaagaccaggggctaataaaaagtgaagcagggatccaaacccattgtctctgacttagcactggctttattttcaccacaccactcatccctgtcaccatctgattgatgaaactccctatatcctatatcagaaaagcaaaagacagtattttgtgagtacagtgaattcactgtctttcctttttagttctgactgaattgtttgcaggaacaaaggcttgctttattttcttataaaatcatgaagcagcctttgtgatgacaagcacaacaaatctgtcatttttcccctaagttttaaagtatatttagaagagattggttcctgttattttgccaactttgcagtaaaaagctctactcactgctccatttcaaatcaattaacttgttttacttaccatgtatgatgtatatggttgcaattaaagtaaagctgaatgattaagagtttgtatgtgtgtgtgtgatgatgagtggtttttaaatttctgaggtcaaaatgttaccaaaccaaacttgggtccacttgcccagcatacagaaaatgccaaacagtgacactaggattttcagcgagagaaagtgaagcatttgttgcagggtgccaagcaaggagaattgggcaactaatgcttaagacttgaactccctgatggcctagatggtttttaaaggtagaaggcagaggttataggcaaagtcataaatcaatacatggagactttacattggtttggccccaaaaggcaggtatcttaaagtgggggcttacaggtcataggtggattcagagaattttttttgatttgcagttggttaaagaagcagggctttgtctaaaaacttaggatccgcaaaaaaggaatgttaaggtgtggcctttaggcgtgactctctccaggtctctcaggaagaaatttagaacaaaaaatggtagagttcagttctcacttcttccttatctccatgagatctctgaggtctatgtaatggtggtcagcattttccatctggtgtgggtccaggtttctgaaaaacaacataagaacatatgttaatatattatcttttagtttctatggggaaccaaaatgctttgtgatgctgacttgcttgggaaactattgtttaagttctcagtattgtatcttcttgcttatagggttgttaattgacttttcaagcctacctaggtgcctggaatttcccttgaaaatactattttttttatacttctatgtttggggggtggtgctcagcaggctcctaagaggggtccctgctctgtttctaaaagacagtagcttgaacacaagcctttacttcttctcccaccctacactccactttaaatgacaatataagatttttcaaagggcaaaaactcataaggacaaaaagaaaaggaaaatagacaacagcaaccaaatttggcaaagaagataaagaaagatgaatttaagtaaagaagcagaggggaagctgatagtgagcctaatttctatcctgtactccctttggagtacaggttcagggaccagaaacttcgggaagtacatttgatggaaaatcctaaggcaggaggattggtttaaagactgctaagaatgaccttagtctttagatgccttctccgactccgaagtacccttcccctaccctggcagaagcctggagttttattctctggaaagcatgcaatagagagttctttggactgagagcacacagctgaatgcagcagtactgctttaaaaatggaaattaggtgaaggtttgcatactgaatgttgagactgagagccttcttcccccaggaagcttaaagaagccagatagccaagtttaatagccttcaagtggtaggaaaattcaggaccatctgacccaaataaacagcctggcctcaacttacacttaagacccacagtccacaagccctacttgggtacaccaagcttttgaacagctctttaggaccacactctttaatataaacagacagctaagagaaaaatggacacttgaggaagaatctaatatgcgaggctgtcaccagaaacaaagggggaaatcagagaattagcacattcaggaagaagaaaacaaaccaaacaaagagaaacctatcattgacatcattagcaacaaatacattgcattcatgaggtgagcagggagtggacgctattacaaaatgacattcagagggggaaaaaagtgggccttgaaaattaagagaaatgaaaaaactaaacttctatacaaatattggaaaataaagttaaggaaaatgttcagaaattagaacaacaaataagtgaagaatctagaatagatgagaaaattatacaggttgagtacaaatgacacaacatccaagtaataggtgttacagaaagaaagaggaaagaaacacattaaagaaataattgtataaatgtcttagaattaagggatttatttccaaaatggtgggtccatacctgtggatggaaatacccacagaaaagcttgtcatcaagagatctgagaacactggacgaagcagtaatcttacagggttgtggtgctggagcagcagggcatgatggggtgtcatacaatgtgttagaataatacaaacaataatcaaataatcagaatagcatcaggcttttctttttttattttattattattatactttaagttttagggtacacgtgcacaatgtgcaggtttgttacatatgtatacatgtgccatgttggtgtgctgcacccattcactcgtcatttagcattaggtatatctcctaatgctatccctccccccttcccccaccccacaactgtccccggtgtgtgatgttccccttcctgtgtccatgtgttctcattgttcggttcccacctatgagtgagaatatgcggtgtttggttttttgtccttgcgatagtttgctgagaatgatggtttccagcttcatccatgtccctacaaaggacatgaactcattattttttatggctgcatagtattccatggtgtatatgtgccacattttcttaatccagtctatctttgttggacatttgggttggttctaagtctttgctatcctgaatagtgcccaataaacatacgtgtgcatgtgtctttatagcagcatgatttataatcctttgggtatatacccagtaatgggatggctgggtcaaatggtatttctagttctagatccctgaggaattgccacactatcttctacaatggttgaactactttacagtcccaccaacagtgtaaaagtgttcctatttctccacatcctctccagcacctgttgtttcctgactttttaatgatcgccattctaactggtgtgagatggtatctcattgtggttttgatttgcatttctcagcatcaggcttttcaacaacaactctggaagctagaaagcaatggaaaagtgccttcaaatttctaaaagaaggattgccagcctagaattctttactcagcaaagtagtcaatcaaatatgaaggtagaaaatgacattttcagctctacaaggtctcaataaactcttctcccttgcactcttcctcagaagctactggagaatgtgcaccaccaagagtgagagaaagtaaagccagaaacagggagagttgggttcaggatacaagggatctaaggatgcaagagagaagagaagagaacctctgggtttcccagggtttgtgggaaggaagtccccaagatctgtgtagcaaacctagaaagcaaccagtccagacagattagcaaactctgatagaattcctgataagatttgacacattgagagaagatttatatatcctgggaaatatgaggagttgaattaataataaacacaagaaaacaaagcaaacaaaaacatcaagacatcagataactaaaggaaatacatattctgcagaaaaggaaagaaatcatggaatgctatatgacttacctctggatgctgttgacatagtcatgctaaaataaattccaaatgttgatcaataaataccaaaaattatgacaaaatggtattgggaaaatggggggacaagaagggtatatgagtatgttagtggtctagaggtgggagaaactaactcttcatctttcataatagaaagtaaatagaaaatgactaacaccagaaaataatttggtagtaatagtcatatattatttagcaatatggaaacagccaaaagaattgaaagcatctggggaagcaagaaattgaggacggctctttcagaattcttgactctttaaattgtatgcatgtatatttttggtacaaagaaaatacattttaaaaagtaatatagtaagttgtttccttgtgagtaccaagaatgtatatctataggcagcatgaaaaatcttaatattgcagtgttattaaaatggattcttgtgatccgggataaaatttccaatgacatcgccttgctggattgcagaagagctgtagacacacatgacgacgatgaattctgaacaagcttgtaaatgactcaaataatgcaaatctagtaacaacaaaaacacttgcattggagatacaagtgacgagtttgaattaaaatcatttcataaaatatgaatgggaaagaggcagtactaatatatatcatataacacaggatttagcatcattgctcttttttgtcaggctttcagttgtgtgttcgaccagttcagctgaaatttcaaggagtttgaaatttcaaagagttgtattgttttttctttctgtttcagaacttaataagcttttattgcccttttcttcttaaccacactcttggaagtattcagtatccttccccatccccatatgatgtgtttgtatggatttcccacttggaatcacttgacagaagagagaaaactatttcatgcctaataacttcaggagatttaaccagccctgtctctcctttttattcaacttccctggaggttcatagccagtgcccagagcagaggcgcttgtctcatagttggtgttcaaaaactatgtactaaataaacgaatggttctgtggagaactccaatcaaattccaagcactcagtgaatgctagtgtattctcattcaaagggtcacaaactcagaagctttcatgggtgaggcaactcagtgagtgagatcagcccaatgaggatagaggcaaatgggaaatcaaaggctccatctaaaggaggtagtgggaaacagtccactgttgttaaacaataatagcaacaataaacatttatgtaattccttatgtgtgcactcatccaatctctttacatgtaatagctcacataatcctcccaacaaaaactgtatggtaagcactgttattcatgaacaccattttgcagatgaggaaactaaggcacctgagtactttgtgctcaagcacatatagctaataagtggtagagccaggattttggacccaaccattctggctgccaagtcctgtctctcaatcatgacaccatattgcccatctatttttttaaaagaagccatgtatctatataaaatctactaatttgtaagtgttggcaactaaatatttttaaagcactaccagccaagcaaagcatgcttggtttgtgatttattcttaggtagtagaaaattaaaacatggggctaggatacacaaaccatgactgggcccccggaccatgcatagccacatttaacatgcatggtggtgatgggcaggatctcatacagatctggatgacacacttctgggttcgaccccatcatcccaatgggcatccaccctatcgagtccattaaaggagaaagagaagaatctagtaaatgtgaaaatggccaccatacatgtctgtagaccatgagtagtttcaaactcctctgcaaagctgtgtaggtttgaccaagaccttatagtgctatatttctctctttcaaggatgacagagataggtctgatatattttgttgcctctactattgtttggttttacagaccatttcagtggaacatggattttttttaaaaaagccaaaggaaacattgagtgctatgtgatggttactacagcttggcaaaaatattgtgtcaattcattggcagatgctagaaaagctgtacttgctggtaataacaaagtttttgtttttgtgccctatgcccagaacaatttgcagttttgaaatatgatgtaactagaaatcctggatgcttatatgcctctagaggcattctatcaaatcattgaatgaagttttaaattatgaattaattgtagtgaagagaatgttttgcattctttgctggaagctaagaataatgattaaatgaagtcccattagcatttactatggactaatttagacagtgggtaaggtatcggtatatgcgttttctttttctttaaatgttgtgttaagatattaagccatctgttcttgtgcataaacattttcctgggattcagatgggattatgggatatgatatggctctatgattattatggggtgatcagactgtttataataaaatcttactttaggggcctgttaatgatctctaaaaggaaaccactccagccttcaggttggcaaaatatctcctcttggaggcaaattgtttttcacaaatgttggtatggctaattttaaggatccaattcctaaattaagtgcaaacctctaatccaagatttttttttgtatttatatggactataattagtttctagggttaattctaagtaggctcatttataattgttttttactctcataaatggaaatattcctgagaaaattgataaaaacccaaaactgaccactgtgcagtataatagttttatctaaaaactcaataaaattacatgtacatgtttagaatatgagcatatataaaaatttagttaactagcaacaaaatatttactaaaaaaaaaaaaaagtcacattccaagagctttctaagtatgaatttgtgagcagaatttaaagatttagagtccatctagcaaaagatttccttgtgaggaaaaaaaaaagaactttattgattgattgatcaagacggagttttgctctgttgcccaggctagagtgcagtggtgtgatccttggatcactgcaacctctgcctcctgggtaaaagcaattctcctgcctcagtctcccaagtagctggaactacaggcatgtgccaccatgcctttctaatttttgtgtttttcgtagaggtggggtttcaccatgttggtcaagctgatgtcgaacttctgaccccaggtgatcctcccacctcagcctctcaaagtgctaggattacaggcatgagccactgtgcctggccaaaaaaaagaactttaaatcagtaattcttatccactttcccactctacactgaagtgatatatggcatattcccatcaacagtggtgtctcctcactggaaaggaataaaagaaggggtaactaaggggagcccccaattgattttaatactctccaactgagatacccacccttcaggtcctctcttgagaattgcttattaaaatagatttaaattaaatgggtacttatccaattgctttctctaattacaaatttaaagtggcattgctttagtttttatgtttgtaaatattttagcacaaacatttgtaaagacataatgtgcatacttcctaattcatttgctgaccatctttgttttgcatacaaacattacttgcattaagttattataaaacaggggaaatgtacagtaaggggtgaataatggatataaagatgtgattattctatctccattattacagcaccatccagtagaaaaccaggagaccccctcgtcatttcagatatcaagaaagggagtgtggcacacaggtaaggaaaatggattttctgattcattttaaggcctctcttaatttaagtaaacatgacaccttccacacccaaagcaaacctttctaatgggtcactgtattttcaaaaacttccaagcagccactattaattgatcatatttgacatccctagttccagtggctccatagatctcttcctgcttatcaatttatttctgcacagctgaaaacatttcttagggtctttcatgaatctagcataggctctccttcactggtcagcttccattcattttctgaccaaaaaaaaaaaaaaaaaaccctgaaagtagcagcacttattagaggtacccaaacagaggtgataagttgtgcaagaattttgctgttaccagaatatcccctctgggcaagcaagattcttgagttttaaaatgttcatgtcacctatttggcccatataccatcaaaatcaggaggtctcaaatttttcatttcataaataaaaatatttttaaatgattgaggatactgatataagaccattaactttctttttattttccaattcaggacttaaaaaaatttcaacctattatcacaattattttattaaataaatactttgttttatttttgagaccgagtgtcacctgtatcacccacgctggagtgcagtggcacaatctcggctcactgaaacctctgtctcctgggttcaagcgattctcctgccccagcctcccaagtagctgggattacaggtgcacaccgccatgcccggctaagttttgtattttttactagaggcggggttttgccatgttggctaggctggtctcaaactcctgacctcaggtgatccacccacctcagcctcccagagtgctgggattataggtgtgaaccgccacacccagcccaagaaatactttaacattcaaaaagtaggaaggacattgtgtgagtttaggtgatatatgtgcaggctccactgctatgacaaagagacatccaaagacagtggatcaagcaagacagaagtttctctctcataacagttgggagataggcaggcaatccagggctatgggagccatcccagcagcttgtcagttattaccatttttttatttttaatttttgtgggtatatagttggtatatatacttatgggatacaagagatattttgataaggcatgcaatgcacagtaattacatcatggaaaatagggtacccatcccctcaagcttttatcctttgtgttacaaacaatccaattatacttttttagttatttttaagtgtacaattaaattactactgaccatagtcaccctgttgtgccatcaaatactaggtcttagtcattctatttttttgtacccattaaccatccctactttccccacgctgacccccccactacccttcctagcctctggtaaccatccttctactctctctctctccatgagttcagttattttgatttttaaataccacaaataagtgagaacatgtgatgtttgtatttctgtgcctggtttatttcattgaacataatgacctccagttccatctaatgcattgcaaatgacaggatctcgttcttttttatggctgaatggaactccattgtatatatgtaccacattccttttatccatttatctctcagtggacacttatgttgcttgcaaatcttggctattgtgaacagtgctgcagcaaacataggagtgcagatatctcttcaatatacagatttcctttcttttgggtatatacccaagcagtgggattgctggatcatatagtagctctatttttagttttttgagaaacctccagctgtttttatggtgcttgtactaatttacattcccatcaacagtgtaccagggttccctttcctccacattctctccagcatttgttattgcctgtcttttggataaaaaccattttaactcgggtcagatgatatctcattgtagttttgatttgcatttctctgatgaccactgatgttgagcatcttttcttatgcctgttagacatttgtatgtcttcttttgagaaatgactattcaaatattttggccattttttaataggattactagattgttttttcctatagacttgtttgagctccatgtatattctggtgattaatcccttgtcagatggatagtttgcaaatattttatcctattatgtgagttgtctcttcactttgttgattttttttctttgctatgaaaaagatttttcacttgttgtgatcccatttgtccattttgcttaggttgcctgtgcttgtgggatattactcgagacatatttgcccagagcaatgtcctggagagtttccccaatgttttcttgtggtagtgtcatagtttgaagtcttagatttaagttgttaatccattttgatttgacttttgtatatggcaagaaatagctgtctagtttttttcttctgcatgttgatattcagttttcccagcaccatttgttgaagagactgtcttttccccaatgtatgtttctaggcacctttgtcaaaaatgagttcactgtaggcatgtggatttgtttctgggttctctattctgttccattggtctatatgtgtgtttttttgtcagtgccatggtgtttgggttactttagctctgtagtataatttgaagtcagataatgggattcttccagttttgttctttttgctcaggatagaattgggtattctaggtcttttgtggttcagtataaattttaggatacttttctctatttctgtgaagactgtcattggtattttgatacagatagcattgaatatgtagattgctctgggtagtatggatattttaacaatattgatccttctagtttataaacatgtagtttattttctatttgtttgtgtcctcttcaatttctttcatcagtgttttacagttttcattgtagagatcttttacttctttcattaatttctaagtatttgattttatttgtggctcttgtaaaagggattacttctttaatttctctttcagattgttcactgttggcatatagaaatgctactgattttgtattatttattttgaagcctgcaactttactgaatttttttaatcagctctaattgttttttgtggagtcttcaggtttttccaaatataagatcatgtcttctgcaagcaaggataatttgacttcttcctttccaatttggatacgcttttatctttcccttgtgggattgctctagctaggacttccagtactgtgttgcataacagtggtgacagtgagcatccttgttgtgtaccagatcttagaggaatggcttttagtttttcctcattcagtatgatactagcagcagctctgttgtatatggcttttattatgttgaggtatatttcttctataccctagttttttgaggatttttatcatgaagggatgttaaattttttcaaatgctttttcagcatcaatagaaatgatcatatggtttttgtcctttattctactgacatgatgtgtttcactcacagatttgcatagcttgcaccatcttttaatccctgggttgtgatccaacttggttgtgatgaatcatctttttaatatatttttgacttcactttgctagtattttattaaggatttttgcatcaatgttcgttagaggtttttggcccatagttttctttttctttttctttttcttttcttttctttgtgtgtgtgtgtgtgtctttgtctggttttgttatcatggtaatactggcctcatagaatgagtttggaatcattccctcctcctctatttttcagaatagttttagcaggatttatattagttctttaaatgtttggtagaattcagcagtgaagcctttgggtcccaggttttgccttacttggagactttttattatgacttcaatcatgttacttattattggtctgttcaggttttgaatttcatcatagttcaatgttagtacattgtatgagtctaggaatttacccatttcctctagcttttctaatttattggcatatagttgctcataggagccactaatgatcctttgaatttctgtgatatcagttataatgtctcctttttcatctctgactttatttagttgggtcttctcctttttttatttttgttattagtcttgctaaagctttgtccattttgctcacctttttaaaaacattttgtttcattgatctttgcattgttttcttcatttcaaattcatttgtttttgctctgatctttattatttattttctaccactaatcttgggttcagtttgctcttgcttttctgattctttaagatgcattgttaggttatttatttgaagtctttgttcttttttgatgtaggcacttatagctaaaaatttcctgcttagtgctgcttttgctgtatctcattggctttagtgtgttgtgtttccattatcatttgtttcacgaaattttttaattttcttattaatttcttcattggcccacaggtcactcagaagcaggttgtttcatttccatgtgtctgcatagtttacaaaattcgtcgtgttttttttttcttcaaattttattttaagttccagggtacatgtgcaggatgtgcaggtttgttacataggtaaatgtgtgccatggtttgctgcacagatcaacctatcatctaggtattaagcccagtctccattagctattcttcctgatggtctccctcccatcacctcacccatgacaggccccagtgtatgttgttgtttccaatgtgtccatgtgtcctcatcgttcagctcccacttataagtgacaacatgcagtgtttggttttctgtttctgtgttagtttgctgaggataaagccttccaggtctatccatgtacctgcaaaggacatgatctcattcctttttatggctgcatagtattctgtgtgtatatatatcacattttctttatccagtctatcattaatgggcatttgggttgatcccatgtatttgctattgtgaatagtgctgcagtggacataagcgtgcatatatctttataatagaataatttacattcctttgggtatatatccagtaatgggattgctgggtcaaatggtatttctgcttctatatctttgaggaatcgccacactgtctttcataatggttgaactaatttacattcccaccaaccatgtaaaagcattcctttttctctgcaacctcaccggcatctgttgttgcttgactttttcgtaattgccatcctgactggcatcagatgatatctcattatgatttcaatttgtatttctctaatgatcagtgatgacgagctttttctcatgtttgctggctgcatgaatatctttttttgagaagtgaagttctttgtagactttggatatcagacctttatcagatggatagattgtgaaaatttcctgccattctgtatgttgtctgttcactctgatgatagtttcttttgctgtgcataagctctttagtttaattatatcccatttatcaaagtttcttttgttgccattttcctttggcattttcgtcatgaaatctttgcctgtgcctatgtcctgaatggtattgtctagattttcttctagggtttttataattttgggatttacatttaagtctttaatccattttattttattttattttattttattttattttattttattttattttattttatataaggtgtaaggaaggggtccagttttaattttctgcatacgattagccagttctcccagtgccatgtattaaattgggaatccttttcccattgcttgtttttgtcaggtttcttgatgatcagatggttatgggtgtgtggtcttatttctgagttctctaatctgttcctttggtctatatgtctgcttttgtaccagtaccgtgctgttttggttactgtagccttgtagtatagtttgaagttgggtagcatgatacctccagctttgttcttttagcttaggattggtttggctatacaggctctttttttattccatatgaattttaaagtagtttttttctaattctgcaaagaatgtcaatggtagtttaatgggcatggtattgaatctataaattactttgggcagtatggtcattttcatgatattgattttttctatccatgagcatggaatgtgtttccatttgtttgtgtcctctctgatttgtttgagcagtggtttgtagttctccatgaagaggtccttcacttcctttattagctatattcctaggtattttattctctttgtagcaattgtgaatgggagttctttgattatttggctctctgcttgcctattgttggtgtataagaatgttagtgatttctgcacagtgattttgtatgtggagactttgctgaagttgcttattagcttaagaagcttttgggctgagatgatgcggttttctagatataggatcatgtcatctgcaaagacaatttgacttcttctcttctgatttgaataccctttatttttttctcttgcctgattgccctggtcagaacttccaatatactatgttaaataggagtgatgagagggcatccttgtcttgtgctagttttcaaggtgaatgcttccagcttttgcccattcggtatgatattggctatgggtttgtcctatgtggctttcactattttgagttatgttccttcaataccgagattattgagagtttttaaatgaagggatggtgaatattattgaaggccatttctgcatctattgaggtaattatgtggtttttgtctttagttctgtttatataatgaatcacatttattgttttgtgtatgttgaaccaaccttgcatcccagggatgaagccaacttgatcgtggtggataaactttttaaagtgctgctggattcagtttgccagtattttattgaggatttttgcatccatgtttatcaagaatatgagcctgaagtttttacttgctgttgtatatctctcccaggttttggtatcaggatgatactagcctcataaaatgagttagggagaagtcccaccttttcaattgtttggaatagtttcagaagaaatagtaccagctcatctttgtacctctgttagaattcagctgtaaatccatgtggtcctgggatttttttggttggtagcctatttattactgtctcaatttcagaactggttgttggtctctttgttctcattagtttcaaagaacttcttgatttctgccttaattttattattcacccaaggttcactcaggggcaggctgttcaatttccaagtagtagtgtggtttagagtgaatttcttaatcttgagtttaatttgattgtgctgtggtctgagagactgttatgatttcagttattttgcatttgctgaggaatgttttacttccaattatgtgatcaattttagagtaagtgtcatgtggcaatgagaagaatgtatattctgtcgttttggggtggagagttctgtagatatctgtcaggtccacttgatccagagctgagttcgagtcctgaatatctttgtttattttctgtctcgatgatctgtctaatattgtcagcggggtgttacaatatcccactgtcactgtgtgggagtataagtttcttcataggtctctaagaacttgctttatgaatctgggtgctcctgtattaggggcatatatatttaggatacttagctcttcttgttgaatttaacattttttttctatctttgttggtttaaagtatcttttgtcagaaattaggagtgcaggctctgcttttgtcagtttttcattgcttggtaaattttactccatcactttattttgagcctatgtgtgtcactgcatgtgagataggtctcttgaagacagcataccaataggtcttggctctctctttatccagtttgccattctgtgtcttttaactggggcatttatcctgtttacatttaagtttagtgttgatatgtgttaatttgatcatgtcatcatgatgctagttggttattttgcaaacttgtttatgtggttgcttcatagtgtcactggtctgtgcatttcagtgtgtttttgtagcagctggtaatggtttttcctttccatatttagctcttcttttaagagctcttgcaaggtaggcctgatagtgatgaattccctcagcatttatatgtccgaaaaggatcttatttctcctttgcttatgaagtttagtttggccagatatgaaattctgggttggaaattattttctttaagaatgttgaatattggcccccaaactcttctggcttgtagagtttctgctgagaggtctgctgttggtctgatggacttccctttgtaggcgtcctggcttttctttctggctatgcttaacatttttttctttcatttcgaccttggagaatccaacgattatgtgtcttggggttgatcttctcctgtagtatcttattgaggttctctggatttcctaaatttgaatgttggcctgtcttgctaggctagggaagttctcctggattatatcctgaagtacattttccaacttagttctgttctccccttctccttcaggtaccccaatcagtcatagatttggtctttttacataatcccatatttttggaggttttgtttattcctttttattctcttttctctattcttgtctgcctgtcttattttagaaagatagtcttcaactctgagattctttgttccacttagtctatttggctatggacacttgtgattgcgttgtgaagttatcatgttgtgtttttcagctccataaggtcatttatgtttgtcactaaactggctattctggtcatcagctcctgtaatgttttattatgattcttagcttatttgaattgggttagaacatgctcctttagttcagtgaagttcattattacccaccttttgaagcctacttctgccaattcagtcatctcagcttcagcccagttctgtgcccttgctgaagaagtgtcgcagttatttggaagagaagaagcactctggctttttgagttttcagcagttttaagttgattctttctcatctttgtgaacttatctaccctcaatctttgaggttgctgatctgtgaatggagtttttgtggggtcttttcgttaatgatgttaccgttgttgctttctgcttatttgtttttcttttaacagtcaggcccccttctgtagtgccgttgtggtttgctgggggtctactccagaccccaagcctggatccctcctgtgacagcaaaggctacaaaacagcaaagatgggagccttctccttcctctgggagctctgtcccagaggggcactgacctgatgccgatctggagacctggagacccctgttgggaggtcacacccagtcaggaggaacggtatcagggacccgcttaaaaaagcagtctggctgccgcttgacagagcaggtgcactgtgatttggggaaccaccctcatccagaccacccagaccctccagagccagcaggcaggaaaggctaagtcaactgaacaagagagaccatggcttcccctcctgcaaggggctccatcccaagaagatcagagttctattcataaaaccctggcttagagtgaatttcttaatcttgggtttaatttgattgtgctgtggtcttgagagactgttatgatttcagttattttgcatttgtagttgctgaaattcctgcaggtggtctataaggttcttgtacttgaatattgatatctttctctatgtttgggaagttctctgttattatccctttgaataaaatttctaccccatccctctctctacctcgtctttaaggccgataactcttagatttggccttttgaggctattttttagatcttgtaggtgtgcttcattgtttgtctgtttgtttgtttgtttgtttgtttgttttgagacagagtctcactctgatgcccaggctgagtgatgtggtgcaatctcggcccactgtaacctctgcctcctgggttcaagcgattctcctgcctcagcctcccaagtggctgggattacagctgcacaccaccatgcccagctatttttttttttttttttgtatttttagtagagacgggctttcaccatgttggccaggcttgtctcgaactcctgacctcaggtgatctgcccacctcggcctcccaaagtgctgggattataggcgtgagccaccatgcctggcccagcttttttttttctttcatcttctctggctgtgtattttcaaatgtcctgtctccaagcttactaattatctcttcttttttttttttttttttttttgagacggagtctcgctctgtcgcccaggcgggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccactaattatctcttctgcttcatcaattctgttgttaagagactctgatgcatttttttagtgtgtcaattgcatttttcaactccagaatttctgctggattttttaaaattattttaatctctttgttgaatttatctgataggattctgaatttatgatctgtattatcacacactcaaaactttattgtttactcaaaacagtaatttagaattctctgtatgaaaggccatacatctctatttctctgtgattggtctttcgtgccttatttagttcacttggtgaggtcgtgttttctcagatggtcttgatgctcatggatgttcattggtgtctgagaattgaattgttaagtatttattatagtctttgcagtctgggcttgtttgtacctgtccttcttgggaaggctttctaagtattcgaaggggcttgggtgttgtgatctaagtttttggtcacttcacctgtatctccattagggggcaccccaagtccagtaacactatggctcttgcagactcaaaaatactgccttggtggtcttgggtaagatccagaagaatcatctggattactaggcagagactcttgttctcttccttttcttccaaacagatatagtctctctctcagtgctgagctgcctgaagctgaggggtggtggggtgacacaagcaccccttggtcaccaccactgagactatgctggttcagacctgaagccaacgtggtactaggtctcaactatggctgccagtaaacccttactggctaccactaggccatgttcactcaaggaccaaaggctctacaatcagcaggtggcaaagccagccagggtagtatccttcttttcagggcagtgagctccccctggccccttgcaggtctaaagatgccatctaggagcctggtcctagagtcaaaaaccttaggaatctacctggtgctctattctactatagctgagctggcacccaagacacaagacaaagtccttcccatcctttcctcaaggagagaagtctctccccctggccaccactgctccaggcccatggcaagtactgcctggctattgctgatgttcactcaagacccaaaggctcttcagtcagcttgtggcgaatgctgccagggccgggactcttctttcaaggcgatgggctcccctctgtcccagagcaggtccacaaacgtccaagagctaaggcctagaatcagggaacccaagagcccacttggtactctaccctactgttgcagagctggtacctaagcttcaagataaagtcctttttactattcctctgcttttctcaagcagaaacagcctctccccatagccaccacagctgggaatgtgctgggtcacacctgaagccagcacaactcagagtctcacctaaggcccacagcaagtactacctgactactgctgctgattttatttttttattatatttaattttatttattttttgagacagagtctcattctgttgcccaggctggagtgcagtggtgcaatcggctcactgcaacctgcacctcccaggttcaagtgattctcctgcctcagcctcccgaatagctgggattacaggcgtgcaccaccacgcctggctaacttttgtatttttagtacagaccgagtttcaccatgctggccaggatggtcttgaactcctggtctcaagtgatccacccacctcggcctcccaaagtgctgggattacaggcatgagccaccgcgcccagccatgctgctgattattcagggcccgagggatatttagtcagcaggtgaaaaatgctgccaggactgggtccttcccttcaaggcagcaggttcccttgcagccctgggtgtgtctagaaatgttatcccggggcaaagacctagaaaaggggccttaggactctgcccggtgccctgtcgtactatggctgagctgatatccaagttgcaagacaaagtcttctttactctcccctcttctctactcagttagagtgaaggactctctctgggagttgtgagctgtgctgtgtagggctaggggaggggtgttgcaagcactcacttagccaccccagctggtttctcactaggtcacatgccccccaagtctactggctctgagctcagcacagcatcagggcttgtccaggaattgctgtctttgtggctttaaactgtcttgagtttatttagtacccaagaacactttagcgtgcagcagtgaggcgtgttggaactcaagttctgaccaccggaatgggtgattcccctctgcctagggctgatctaaatgttccctccgtggatatcagctgacttctgcccagtgttgctttccgctgtgacagggtagcactgagtttcaatgcagtctctccctcactgtgttctccctcccacaagtgcacagtttttctctccatgccatgtggctgctgcagaaggaatgggggaggggccggcatcatcagttcaagactttctttcctaccctcttcagtgcctctttcaatgatatgaagttaaaaccaggtactgtgattgctcatctgatttttggttcttataaaggtgcttttctgtatggatagttgttaaatttggtgttcctgcaaggaggatgatcagtggaggcttttattcagccaccttgctccgcctccctcctgttaccattttctagctacaggcaggaggtggggagggtccccagagagtctggggcatgcatttttagagggtaacttaaaagaagggaagggagaatggatgctgggagacaattagcagtctctggcacagatataatgcataaaaggctgttcttacaaatctgtgtatatatacatatacacacatagaaacatatacatactacattcacattattttttttgttgtttcattatggaccttaaaatttttttcaacagacctaccctggtccacagccagttttagagtctcagtggccactttccaaataagaagctatggattcatctataaattttcatgctactctggccatagtgagtttccagatgcaagtggaagtagcagaggtgcaagccttaggcttccactaactctattacaccttgccttctgtcattctcttaatgctctcctagtatctggactaccaaggatcaaaagtaatacaacaatatggagaaagacaaggatacctgggtctatgcagaccctcgcccattacctcccttcctaggaattgtatgcttcctgagtgacacatatgttcttgtttaattgaaaaaagtataagaaaaaatgtttttaatactctgcaatttaatatcatggcaggcaacccaaataagactagaagaagggagggagttgtcaatgaagtacaatttaaaaacagttgaacctcttttcctctaaagactaccataatgctgcattatgcttaatgcctctttaaatggcctagttaagtgctcatcattagtcatgtgttactttgcattcactaacagaactgggaccctggaacttggggataaattgctcgcaatagataatatccggctggacaactgttccatggaagatgcagttcagatcctccagcaatgtgaagacctggtgaagctcaaaatccgcaaagatgaagataattcaggtattgagagcatccttagttaaaactgatttttcgaactgcccatctgtcaccaaagatattagatcttgatgttttacatacaacagctggctagtgatgtggcagcagtgtttcacagctaaaagagtctttaaattttgtgctgagagtgtagtacaaattttaaataatggtgcttgtaaatgatatcattaagatattttcattatagaaaacatattataattgcatgaaaataatttttaaagatgaaatctaaatcatcatctaatacagtgaaactggtagttttctagtttttattggtattcatatggcataactataaccaagtgaatgttgcatttttttacctaattttacattgtaaacatttgatcgttttataaactcttaatatctatcatttttattgactgcctgtgatttacctttcttctcttcttaaatcactatattgcttccaattgtttcattattgtaaatagtactcttatagacatctttatgcatagatatctttatccagctttttttttcttttgaaataagaaaatattcctagaagcaggatggctgagtaagaatacaaaggaaatgtctatgattcctgatgagtcagtcatgccccatgttgcttttcaaaagggctatacacattttttaggccctccaatcaaacttaggagggcatagaatcatatctgaagagcttgttaaaacacagatcctggcaccaccccaggtgggacctgagattctggattcctaataaacacccagatgctgccacagctgtggtgcaaggagcacactttgggtagccctgaaataagagacatcttatctgattatgataagaatatagagccaattgaaaagtgtccattcaccaaaagagtcagctaatgtggggaattacagaatgtgatatggatccataaagtaaacgtttaatttacaattttgccaatctcgtgggtaaagtcaaggcctttcctattaatatggttctgctgattatacttacaagtctttttgtttgtttgcctaaaccgtatccacaatatatattttatgatttccagttttattttggtttggtttggtttttaatgcagtgagactttaaagaatttatagcaatctgaattcttcctccacctagattttggttttccccaatgttgtagagtttttccattaggtaattaacagtagatgttttgtttgtttgtttcttgttttgtgtggcacacccaggctggagtgtgccatggagtgcagtggcgccaactctgctcactgcaacctccacctcccaggttcaagcaattcttgtgcctcagcctcctgagtagctggaactactggtgtgtgtcacctttcctggctaattgttgtatttttagtagagatggagttttgccatgttggccaggctggtctcaaactcctgacctcaagtgatctgcccacctcggcctcccaaagtgctgggattacaggtgtgagccactgcgcctggccatagatttttgcctaacgaacccttattgaatctttccaaaccattggattttgttttcatagaacaactacattcatatttcataggttatataagattaattaaattacatagttaaaataacaagtacagctggcataaacgggtttaggaataaatataattgcctctagattttgaagtttacaactcaagcaggagcaggagcagaagcccagaggggcaacataaagaaacctattgctctggagcatgccatggcattggtctgtacattttatggtggaagacgaacagccacaattaattcagtaaattggttaagtggagattggttaagagaacgtctactgtatataatttcattgcaaccaataatgaagttgtggcaatgttctgggattttgttaatcaggtcatctagatctagagttcacggttatgtcaggctatgtgtttatgattccttttccaagtaaaaaaaaatctatagttgcatccatcagtacaattgataataatgattatatccaaatatattttataaccaatgtttaaaaatatgcacaggtttgcactcattatttcttaagcaactgattttctgtgccaacatttgcatttctctccttacaagcctgcttcagttgcactttcttttggggattgatttcaaaatagagaggaagcctttagcatcagcctgggttctgtcctagtgaagaggcaaagccctgtggagaaacctgttttgcatgatttgccctgctcagcagatgtcagctaccttccttgcaaagtgaaaaagccaagccagagatgaatatgtatagtgtgcacagctggcaatgcacccagtttcaaagccaggctgtgtctaccagttggcaggagtttctgaaacaactgagcacttggagagctagatcttattttcagttactgatttcctttgcctcattttccccctttatacccttcccctacaatctctatgtatactattatgatggttattgtgcttattaaatatgttttaattttaagaggctctgtttttaaaatcctaaaccttccattgaaaaacatacaaccacccaaaataagactataaatattggcatgagagatatgcttacccaaaccagattttctcatattgatatacagaaatatatactcattcagacatggttttataaaagatcactctttgaaaattattcagttattgatttggaagaatttatatgatcctagtatcctcttccctcataacatcataaatataatttgagtatctgaattcatttttattcagagcaaagtaagggaggaaaaaaaaacattattcaaaatgtaaagcctgaccacagattatttaaaggcaaactaaatcttcacaaagagcaaatgttttaaaaccagacatgatataagaactcagaagaagagagggtagacgggggatgagggacaacaacaactacatattgggtaccgtgtacaccacttgggtgatgggtgcacaaaaatctcaggcttcaccactacacaattcatccaggtaatgaaaaatcacttgtacccttaaagctattgaaataaattaaaaaaaaaaatcagacctcagtttaaagttcagctctaccacatttgagctgtgagagtttgggcaacttggtaaacttgtctgagatttggtcccattttcagtaatgtctacataatagtacccatctcagggagctcttgtagcttactgaaggaaatactggcacagtccatgctccactcaataagtggggactatctgtattctaattacctcctgaaatccctttctctgcattcgttctgatccttgatcaagatatgactgagtggaaaataagcatttaccctttggacagtcactgattttgaaagtttgatataatgcttaatctgaaattatgctggtgattagaactatcacattaaatagttgtcatgcttcgtctcaatatttttgaatggtaatattcagcgtatattctccacccccagaaatattgctcatactaatgtgggccctctgcactgcaggagttttccagtcctttaactgctggctgctctccatccttcagtgatgattctctctctggtcacaggaagtttataactatacttgatggaacttggtttcctaagctagcttgtactgcaattggggtttaacagatactacttcaaaatgtaagcatttcttccagcttcccaagtctcgctaccctgctgtgtaccttacccaaggagatggtagaactattcccaaatgctgctaaagccctcgattttcagtcatgccatcagcattcgtttattgtctatgaagtatcaggcaatgtgccatggactaccagttcttagataaaagggacacaatcctgcccttaaatcagttaccaccaaataggagaaacaagaaaatcaataattaacaatatgatgaatgtcataaggatatgcacaaaatattccacaatggtaagagaatgtgaaggcatccatttcagcctgaggacctcaaggaaaagattctaacaaccttggtctcgaagggatttgtgaagtggtgcagaaagttagggagagcatggcacactctagtaggcagatatggctcaagcataacgtgtgcaaggacttggtagtaggtaagctagaaaggtatactggagccaagtcattatgggccttgtaaatcatgttaagaaatttgaattttatcccagaaaccaatggggggccattagaggacttaaaacaggaatgaggcccactggacttggttagtgaccattaattttaatcacttgatgaaagcgctgaatgagccattcaagagagtctgaattaactctgtttctagcccaagctgggggaaacagtagaatgaaagactaagaatgccagactggcttcacaactgacaatctgggaaatttaggcaaattaacttctctgagcatcagtttcctcatctgtaaatgtccatttaatgcttactttacatggctgttttaaggattaaaggaggagatatatgtgtgtgtgtgtgtgtgtgtgtgtgtgtgtgtgtgtgtgtgtgtgtatatatatatacacacatatttttttttttgagacggaattttgctcttgtcgcccaggctggagtgcaatggcacaatctcggctcactgcaacctccgccttccaggttcaactgattctcctgcctcagcctcccaagtagctgggattacaggtgtccaccaccatgcccagctaattttttgtatttttagtagagatggagttttgccatgttgggcaggctagtctcgaactcctgacctcaggtgagctgcctgccttggcctcccaaagtgctgggatttacaggtgtgagccatcgcacctggcctaaaggaggtaatatatttaataactcaccaataagtttgcacctagtgaggcccaatgaatgttgactatcagtggtcattactgtatttggatattttaaaagtgaatttcagctttatttaacaatggccaaatcttttggaacacttggggttgtaggcgttttcctccctcactctgaattcagccaccctcctgccttcaggagcttctgcatttgtcgtcttccattactgaaggaatgtaactcaggtagtgtccagtggttcttgtgtgggtccaaggctctgggattcctgaggctgctacccaatccccaatacccaatcagcaatgcaaataatcctcttgaaaaaaatctattgttttgccttgatggtttctgagtccaaagtaaatgaagagagttggaagacctggctagggcctgagaggaaaccctgaagcaaagcagtagagacttttggggatttgtaggaagagatagaggtttgcaaatctatcacatatagttttcaaaagtcggctttgtattaccacctttttgtcaatcaaatatacagctattaatgatttctcgcttggtttggggaatattactctaatatatagcatatttttggagaccataaatcaatactttaccttcatgggctgtaatctgtgtttaaaaaaaaccattttcaggctgcagcttgtcctattcaaaacaaataacctttatacagccttattactgattaaattagtcctttgaagacagattcatattttgggcttcaaatatttatagtttaccagtgttaagccaagctaagtaatttgcagtagctttttcccctaaacccagattggagtattggtgtagcagagatgccccattccaagctcccaagaatgatcttggctgtcctaggagcagtggaaagaggtgtgttggcaagaagctggctgcaagaaggacctatgataaaaagtacttttctcttttttgcatgcttgatctcataaagggacggctctcaagcttgagtgtacatcggaatcacccagaagacattaaaacacagatgactaggcccctctcccagagttcccattcctgttggtctgtggggtagggattctcagtcaaatgcaaacttgagaatttgcatttttaacaagtttgcagatgatgccaaaactgctagtcctagaactacactttgagaaatgctgtcacaaacaaacctagttttgagacttaaaattatcacttacacaaagaaatttgaattctactctgaaacactcaacacttgcttggacatctcttggtatatcattgtgacatatctatgtaaaatgaccgtgcagcagtaagggagctgtagagagtgttgttcaaatggtttactttctcaggcctgtccgactccaagaaatttagccgtactctaaaattaattccatcacttttagttgaagtgaactttgactgacctgcacatgtacgccttccaaaggctctctcccaaatccaagcctcctatttggccacagaagcagctaccattatggattcaagccagatagcattcattttgttaaacaggcagcactcaagaagcctgaaaataacattgcagataagtaatgcagcaattttgcatctgttccgtgcttccattaattttgttaactagagctgagcagaacaaacaagtaggcttgccccctttcctgtctttcactaatcgttgtaaaccttctgttgggatataaaagttgtttataatatcattaacatctgcttaggctcactttgaaacttactagtgattctacgtttttctttctcagaagtttctcttctagttaaacaccctagttgctcctttctaagacttctacactggagcagcctcaaggagagtgtatctaggagtgcttcaatctccaaaatagtctgagtattccttcttaaatggcaattattaccctcctcctaagctgcagggcctcaccagttgagttaaagcccgagaaggcaggtggaattggcagttgaccctaaagctgactcaacgctcctggcacggtggagggaggaagttctaggtttgcttgtccccacaatggcagctgaggttgtattctcaaactttgaatgagattgggtttgcatcacatgtcttagaaaaggaaactagaccttggcatagcagggaagctgactcgcaatactcttctggagatctcagcctgggaaccaatgactacatgctaatattcattcatccttctgctcacttgttcaagcatttactgagtttgctttggtaccagacatagttctaggttatggggatatgagttaaaaatctctgttttcaaggtattcttattctaatgaagaaccaagtagcgagatccttaaaacatagagtgaaaggcatatgctagaacatgcattctcaaggggggcaaaaattggttcttaaaagttggttcttgtgatagcttggatattatattataatagtttgtggccctccaaatctcaatcatacctgatggaattctagtccttaatatttaacttctctcattaaggagaatttaaaaataatttcactcttctccttgtttgagagcaagaatgaaaataaaagtttagaaacatcagaagaatgcacagaagctgtgggtctcataggaaggcctctagcccctccagctaagccaccaggaagcctttctgaaggatgagactctgagccaagctttaaagtaaaagtagaaattctacaggataacaaatgggagaaaggtgtttgtgcatagggagtaacaggtgcaagggctaaagatgttagaaaagtgctatttaaggaattgcagtggttctatgaagagagaatttagcagattggattgggatgggggagaatggcgtgaccctctgggggccagctcagctcttgcacaggggttgtattttattcttaaagaactgaggaaccaatgaaaagctttaagtaagagagtaacatattcagatttatgttttaaagatattctgggaaggaaagagaagaaattatatgttggcagcattggtgaaaatagaagtggggaggaggggcaaaggctggatcccaagcaggaaaactgtttaggaggaagccattgctatgaaaaactgggcagagccacagtggggcccttctcaagagcaagtggcagtgggatgccctggagagcttgtcttgtgggcagacgggccatatggtctggaaaagactgtgtgcgggcagccatcaccaccgtctatgaaaggaaagccagactaattaaatatctgtttacacaaggcatccacatagggctttctaagggaattgatattattttctttttcaaaggcttgttattaaattcaaaatatatacaaaaataaaaatagcataatgaatcaccatgcatcatccagtgttaacagtgatttgcttacaaccaaccttgcttcatctccactctcagtctggtttctccacctcaccggtggagttatgaagaaattccaggcatcatcccatctttttactaacgtatgcctaaaaaatactctttcaaaacacataactaaatatcatcattagcaatatttttaatcttataaaatattcactcaatgttcacatttccctgatatatataaaatcctaattaaaaccaactgtttttttaaagcaatctatctgatagaaaaacacatagctttttttttttttttagagggtgtcttgctgtgtcactcaccctggagtgcagtggcacagtcttggctcactgcaacctccacctcccaggtttaagcgattctcctgcctcagcctcctgagtaggtgggactacaggcacgtgccaccacacttggctaatttttgtatttttagtagagacggggttttggacatgttggccagtgtgatctcaaactcctgacctaaggtgatccgcctactttggcctcccaaagtgctgggattacagccgtgagccactgcgcctggccaatagatacctttttataacagttggttttattagaatcccaaatgatctactcattgcttttgattgtaatgtctcttaaatctcccttttctcttttttttttttttttttttttttgagacagagtctcgctccatcgcccaggctggagagcagtgacatgatctcagctcactgcaacttccacttcctgggttcaagtgattctcctgcttcagccttctaaatagctgggactacaggcacgaggcaccatgcctggctaatttttgtatttttagttaagacggggattcatcacgttggccaggctggtcttgaactcctgacctcaggtggtccacccaccttggcctcccaaagcgctgggattacaggtgtgagccactgcacctggccaaatctcctttctcttttgtgtttctggcaatttatttgttaaagaaaacagaaatcagcttccatttctgtcataatttaaatagaatatcatgtcatcctgtttccaccccaatgtaatcacaggaatgtgtccttcttagttaagaggtaccatttcccagatttgcatctccatcactatctaaactcattgggtgacctaacaattgccttctagtcagtgaggactcagatgccaataaaaaaatgtctccaaataaggcagcctgaaacagactatcctaaagccattcacttcatctctggtattattttgtcatctttgcgtctcaagttacattgtcaaaaaataacatggaatactcactctgcagaatgagctgagtagaaccaggtgccccccttctcccaatgaatgggactacccccaactccccttccatagtccagtgtttgttttcatcttgactgcagtttcaatggacacttcccactggttcttgggtctccaggtcctgggcaactgtccttctccccaaaacccataaagagcagatgctccaacccaaaatgcttggcacccattgacaagtttgtgctcatgcttgccttatgcagagagcaataaggggtcaaggtctttcctatggcatacacacctccactgaatggcccacacagagtgtccagcagtaactaatgttcaactgtgccagggactactaatcaaatgactcattcagaatttcatccaggatattgttgatgatgagggctgcaaagtacatgtaatctatccaatagtactctgttcatttaggtcaaagccagctctgaaaggtgacaaaatatcgtactgtaggaaaatttagacttttgacctctgctgattatttggttaccctctatcttgatgtttctctctggagcccttagcagatcatcaccagcctattggccacaacttcagcatcagcccagaagaaacttgtgaaccagcaaacagagctgttttaggcttgatatgggagcttctcagctgctaatgtaaatttgagcccaatgttgaagattttgtgccctaaaatgttgacttaagcattgcagtgtgtggtggatggtctttagttctgaatgtgtggagtaaatacgttgagtagagcactcagaaagtggaggtaatggctgcattcaaaactcccaatctatggccagaagtgaagtaagtgctggcgagagaggacacattgcttcccaaatgacttgatagacctttcattttatattcatcataattcttcactgcaaacacaaataattgaattgttaactcaagctttggttttcctccttattttaggatttcatatcgtaaacgaacagctgctcactgcaaaaatgtggccatgttaatgcttcactaggatgtagtctgactgtaaaagctgactattttgctaaagtagccactgaaccatttcattttatccttagttgcagaaatgaaacagttccttaaccattcacagctcccaggcccaaggaataaaacaagaagtgcccaagaactttaagcatgtcagaagcaaataaaacctttgaattctgagacttcttatttgcaactctgacaccatcacaatacccatcacgttgaaggcggcccatgatatctttctggccagtgctttaggcagagcacattcacaagtgtcttcaactataataatgttgaatagccaaaattagtttatgacagtgtggcaggctggtctatgctgttgaaacatagcttacaacagctgttactccattgaaagaggagagatgatcattcaaacctccactttaatatccgtaattcactgataggactcacattagaagacagtcagtggaatgatatctaagagattctagatttcttgctgttgtcttcaagtttacttatctaagttccacttaaccatatatatgttatttgttccaacccttcgcaaaatccacttttctatatcaaaagttagcatgcatgtaaagcttaaaacggaaacagcgtgacccaatgtctgtcttctttgttactgagtgactctctcctctcatattataatgcctcctcagccatatgtttatttcacagatatttactgcatacttactaaatgctaggtaagcactgtcctagacatggacacagttgaaaggtcctgcagccccagctgggcggatctcacacatttaaaacataagtcattaggcagtgttcctctcccctggcactgacaatgattatatccctgtatttgaatgtaagatcctactaaggaaatgctacttcccaaaataattattttctgtgacatgatactttgacgaggatgttttgaattcttttatgtatgaatctatgcatcttactcttttgctttttccaaagaaatcaattatgattccttggcatttattacagatgagcaagaaagttccggagcaattatttacaccgtggagcttaaacgctacggggggccccttggcatcacaatttcaggaactgaagagccgtttgatcctataatcatttcaagcctcactaaagggggattagctgaaaggtaaaatttgaagtaactgttataattacctgtgtctgagacgggcttccttcctcacaaccacataaaaacatgctcctctctctgtggttatctgttggcttttaaaaatctgcacaaaggattgatcttagagcctgagaactctcaggcagagttccgacttgactctgaggggcatcttacaggcagtaaaagacgtcttgggcttagcattgatactactctctgaaatgtataagctgaccacaattgactgaaggcggatttgtattgtgtccattttgagaggaggaaactaaagttcagggaggttgaacagcttgtccaatttcattcagcaaacacttgctgagcctctgttacctgacaggtgccacacttagctgctgtgttttcagaaaaggatgatacagacatcatcttcaaggattatgggaaacaaagtgtataacccattttaataatgtcttaaaagctggaatgtccattttttcctttggcaatgatgtacacacacacccactccccaccctccgctaaactgcatttctttctgagatgtgttgttggacatataacaaaccctataagcaaatctgccctccagtaacctagctcaggaatacacaaatgcattgttcctgctaacagttgaaaacagtggctagcaaaatagagacacagcattgcaaaatgttggagctgcagtgtaccttagaaattagctcatacaggccaggtgcggtggctcacacctgtaatcccagaactttgggaggccgaggtagatggatcacgaggtcagttcaagaccagcctggccaatggggaaacctcatctctactaaaaatagaaaaattagctggggatggtggtgcttgcctgtaatcccagctacttgggaggctgaggctggagaattgcttgaacccgggatgcggaggttgcagtgagccaagatcgtgccactggactccagcctgggtgacacagtgaggctctgtctcaaaaaaaaaaaaaaaaaaaaaaaaaaatctgtagaaagaaaggatgctccatgctatccactacatttgtcattcaacattgttcattttcttgggatttttagggtgcttaaccaatgactcagctttcttggaattaaaaaacacagttcattttaataactaattaaaacaatttttaaaattttattggaaactaaaaagtaatccacaacagatgcagttatcttataacattgcccaggagaaagcaagaagggacttctggagatccttaccaagtctttattatgatgaatgtataaggtatgtcagggaatttatattcagtaccatacagggattatttctacctctcctattactatttggcttttcagaactggcgcaatccacataggagaccgaatcctagccatcaatagcagcagcttgaaagggaagcctctgagtgaagccatccatttgttacagatggcaggagagactgtcaccttgaaaattaagaaacagacagatggtgagtagtgaattgaaagccacaattaaggatttccagtgcattttcttccttgaaagaatgtgctagtgtctgtgtgtaattctagggaaacaaatctctagccacggagtatcttggtatatttttatttaaatttactctgatacttaaactcctttcctgtctataaagcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggtatgtctttactttgtcccccagaggacttgtcattgttgaagcccatgcttctccaagattcatcctctgctccatgaggagaatatctttctttaacttgtgtctgctttggtgcagccataatcatattgaacacattgaatacttacactctgctggccatgcattttcttctagtgcttataaggcatgaacctttaccaaacactaacaggcctccattaggtctactgatggccaagtatcccatccagggcttgtccttcaagcttagattaatgtgaggcaaaccatacaataaagtggctcgttcaatacaggccccattgccttatttttcagcaagctttccacaaagatggattggggagtttggaagaggtgcataagagattagccaatgatttgtgactctatttattcctgcacactcctgacttttttttttcttttagagactgggtctcactctgtcaccccagctagaataccctggcaccatcatagttcattatagtctcaaactcctggactcaagggatcttgctgcctcagtctcctcagtagctgagactatgtgcacacaccaccacacccagctgatttttaaatttttgtagatacggggtcttgtcatgttctccaggctggtatcaaacttctggcctccagcaatcctcccatcttggcctcccaaagtgctaggataataggcatgagccaccatgccctttccctgaatgtttataattagagcactataatcacaatataggaaagtatagagtagatttttcttcataggtgtcatcgtcatgtgaagaaatactatctacattaaaaagcctcactcatggaatataaacacataaaaggtgtcagactgaatacagagcataaactaatagcttcttttaaaaaatattttcttcccagtgatccgtagcatcaacaagagaagtatgtcaaaacttcttggtatttctcctcatctgagccttaccttctctcatgttctatgtaaattccagcctctgaatcccttgtttgctctgggtttcagtcagtcaaataataaaacacataaacagtttagagaacacattggtgtgagggctgctttgtcactgagttaactgtactttttaggagtgtctgtatccagtttgctctctcctggttttcctagtttccttctctcagcctgcctatgttgtgtcactctctgttaagtcctctggtgaacaaaaaacaaaaatggaagggagaaaaaactggaaaaaaaaatgaaaggagatgatatttcaaagttgtcaagttgttactttcattagagatgatactggagttaggtggggaaaatactttgaacacctaagtagaattggggctttatctggcaattaatttttccaagtcataataccttgtgacaagttcacctatgccaccaaataacagaccttctgattgcctgagaattgatgggccaccagaagacactgagtaaaggacagaagtcacattctatcagagtagactcaggtttatttatcaatttattgtgtattggttatttatttgtgtattttttgtgtattgcttattaatgtagagatatttttgttaccagagatttttgtgagggtgctattgatattaattagttcttccctgtaaggtgatctgtaagaccttagctactccatcccttgaaaccacagacacaggaccatgagaagcaaactgaatataggacctgcccctcactagtaaaagatgaaaaaccatttactatttgtgaagcattttgaaattttgaatcatagtcataatattacattttgcatttataatttagacatttttatgaggttgaagggaactgagggataagtagagacaatggcaatcaggatagaatcgaagtactccaaggtaatgaaaaaatagtaataaccctttatatatatagaacactctagagtttacaaagcactttcacataactaatccccattaattcttgtgacgaacatgggagctgaaggcaggatttcaggtttggaaagggtttaggagtcagctagtctgatgtccagtgcagcccttggtgccaggtcctgcctcactgcacgccaagacacgctgcatggacttgaatgcccaaggtgacaggttgttccttgtgctgaggcagccccccatctccacgtagctctgatgactctaaagctctcacttgtattgagctgcagtatgcctaatagtcccggctataccctcaaggtcattctgcactagactaaagcctcttctcctgacagccccttagatactcgaagacagctattgggtctctgttgaggctttccttctccaagcaaaatagccccagttcctttaactgtgtcttctataatttactgacgagtatctgtatcgtcctgtggacctcccttacgaatgtgcttcagtttacctgtgtacccgttaaagtgtaacattcagaaaggaaaatcacacaacagcccgacagcccggagcaaagcaagctggtcactggcatcattgaagacaggagaactgatcaatgacacctacctcaacataagaattttagtggtcatggcacatctgtcactcattttgcgcttacagtttaccgagatctcaaagtcttgtgaatgtgtttttttttctttacccgtgatattcagttaaactgcatctctccagattgtgcttgtgaggttgactttttaaaagcaaggcacagctgggtgcagtggctcaggcctatattcccagcactttgggaggctgaggtgggcaaatcacctgaggtcaggagttcaagaccagcctgagcaacgtggcgaaaccccatctctactaaaaatacaaaaactagccaggcgtggtggcacacacctgtaatcccagctactcgggaggctgaggcaggagaatcgcttgaaccaggaggcggagattgcagtgagccaagatcatgccactgcactccagcctgggcaatagaacaagactacgtctcaaaaaaaattaaaacaaaaataaaagcaaggcatagaaccacacttttatttttcctattcaatattatgttgtgagatacagcttatctctccaacctgtccctccagcctctcagcaggctctctgccttgttccaggaagcccctgcacattctctctgttccctttaaggctgtaatagttgccttgttcccaggagactccataatgcacatcttcctcctggggctggaaatcgatgtctttgcagcaacattccttactgttctctccttcttctctaaaatatcaagcttgctccattcattccttcaaccagtatgtaatgactggctcaatatcaggcccatagaccatgtggatacactcttggacaaaggagacatggtctctgctcccatggaagaggttacccagctgaagggacagtcagttaacaaataaacaaacagtggccctatcacttcgttagtgaaaagggaaatagaatggaatgacgaaaccttgtggggaaagaagggatatgtttaaggaagtcccacaaggggctgattctcagttccactgtgtggctgacttcttccagttggcctccaggtcagcttctttcactccccattgtcttgcccattagatgcctcatgcccttctgccttatcaaaatcttaggcatttggcctccttgcatcttattaattcttccttctaactctgagaaaaccctatgactgctttacttggatttagcaaaggtcaatacaagaggagactggcaaattggtggtggtacatagactgccatgctcgcgggctgaatagctcttgtgctctctgtaactttggactctcaactcagatagctatatttctatcttatttttctcccttttgaggtcattttgatcatttgttttctctcagaaaatgaaattatttcatccagatgtcaaatgtattttatataattaatctcttttttaattttttattttctcagtttctataattatatccataatattgttccttaattggtatatttgtggttttattattttccccatgattcgattagtaacagtttatttgatttctttgtttggtttttattttttcccagagaactgactcttgcatttatttattagttttactctagtttttttttttacgtacaattttacttttaattttactctttcattcagttccttttaaattttattccttttatgacttaagttggatgcatgatttatttattttcattgctttataaggatatattccttctttgtgttttcataaggatgataactgaaaggacaccaacatgtgcagtcagagtccaactttatttaatgtcattaaagaatacaaatcatacagaggatagcacagagtagaaacccaatggtatcctcctctactcattagcaggattttatttttctctttcgtttctcttctgatctctacaagctcatgtttcatcatcatcttgccttgcccaatttctctagagttcttatatttctgctttgatctcttgttttatagaggtgatggctttgctgtgtattttttaaattttgtgattatttctgattggtcatgtttatcatttgctctgaaccaggctttttctcatgagtattcttcatctgctatcgctttgtttttctatgcctttgctctcatttgtctgatatttacttggtatacatgttatgccaattccttttcaattactgctcaccactgaatgagatgagttcttcctgaactggaagctgctagaggctctgtttccaaggtaccaaacacaccccagttccagcatggtatgtgtgagtaaattcttccccagctaccagagagcagcaacagcaggctgctcacaaaacagaattcctctctgctatcctgcctcattgagcaattgctcccttcagtctgtgacatgtgttctctttccctgactttaccttgatgccagatgggatcacatgtactttctgccaccagccatgcagtgcatactggtgttccaaacaaagcattggagttttgcctcatgccaccgcccctgctttggtagactgagttgtctaccaaagagtagtttggtagtcctggccataggtgtcttctctccacttcttaccaccaccacccccttcccatttgacttccactggatttatgtattatgtattttcttatgtattatggtctgagattacatgaacactctagttgtgattaagatggaggttgcattctgttatttatcattactttttgtcttgaggtgatttctgagagaagagagaactgtctttgcattgacatttagatcacagcctcatctgaatactttgaatatttcttggcaagatcaattacaaatagttacacaaacatatgatttgattttctcatccttcacaaaactgggtctttagaaaacaaatttggcagcgaattaactggctctctttcctgtactaaaattggtttccaagaatgaaagtaatggcaagagctacagtcccaaaattgttgagatgaaaattgaattctatttttttttctttttttgttttttgagacggaggctcgctctgtcacccaggctggagtgcagtggtgcgatctcagctcactgtaagctccgcctcccgggttcatgccattctcctgcctcagcctcccgagtagctgggactacaggcgcccaccaccacgaccagctaattttttgtatttttagtagagatggggtttcactgtgttagccaggatggtgttgatcttcctgacctcgcgatccacctgcctcggcctcccaaagtgctgggattacaggcgtgagccacagcgcccggccgaaaattgaattctaaactttatgaatatgaacccacactgattagttcacttttctaaattaatgctgggtatgaattaaaagctacaaatattaatctgtattagtacagaaaaccaaatattacaaggttggaatgttagaattttacaaatatctaaggcatagttaccctaaaaataaaaatcatcctatcaagattccatctactttcagaaatacctactttgctgttttccacttgtgcaaataaagacctattttttatgaagacctgttttccattatgcaaataaataaaactaaacattaatatcagtgaaaggaatctggactaaattttatacctcctattaggatacaaagtataagatcagatatggaaacccagatgtaaaataaagaaggaaagaagaaaaagttgccaattctaaaccaaaggaggccaggcatgcaggcccacatctgtaatcccagcactttgggaggccaaggcaggcaatcacttgaagtcaggagttcgaaatcagcctggccaacatggtgaaaccctgtctctactaaaaattcaaaaattagctgggtgtggtggtgtgtgtctgtaatcccagctactcaggaagctgaggcaggagaattgcttgaacctgggaagtggaggttacagtgagccaaggtcatgctgctgcactccagcctgggcgatagagtgagattctgtgtctaaataaataaataaataaataaataaataatccaaaggagaaatgacttaggaccatacattttatttattttttattattttattttttgagaccgagttttgcttttatcacccaggctggagtacaatgttgcgatcttggctcactgcaacctctgcctcccaggttcaagtgactctcctatctcagcctcccaagtagctgggactacaggtgcccaccaccacgcccagctaatttttatgtttttagtagagatggtgtttcgccatgttgtccaggctggtcttgaactcctaacctcaggtgatctgcccgcctcagcctcccaaagtgctgggattgcaggcatgagctaccgtgccctgcctgagccaccgtgcctggccagtacatttaaaaaacattatttcttttttcaacttatttattttatcaatttttaatttaaaatgtagtttccaatattatatgtgtatttcatgtgcttacaccatcattcaacaacaaaaaaaatttcattatctatctggcagttgattttttcttacgcctgggctgcctcatttattccctggcttttaagcttgactcctggtgtaaaggaatattcctcagagcctgttaactttttatcagtaatggcaacaggtttgccttttacctaaacataattttcctcagatattccctcttttaaatcatggtatcaccagccagctgtatcagttaaaggtcaagtttagctgatttgaagattttcttctacatacgaaacaaaatttaagtgatggcatttaagcaacatcaggatttatttttcccatggtgtcatcaggacccaggtatctcactccctctactcacttagcatctctgatgtccctccattgccactgcctttgtttcaggcctgatgaaatatggtaactccttcctcacttatcttcttactttgagcatcttttcccacatttctatctataatctttagcaaaaccaaatctagtcatgccactcccttaaaccaaaaaaaccctcttttgatggttatctattgttataggataaagtcaaaggtcttcagtttaaaacacagggttctttgtaatctagtccccaaatactttgtcagtccatctgctgacacttccttgcagtaccttttagtacacatacccggaatatctcacaattctctaagcaagctttgcattttggtatcttgataacactaggtattttgatatgttaattaacctcttaatcggtttcaaatccattgagaaatagaaatgagagtcagctatggattaaaatatcagcatttcattttatttttttgctagaaaaagctggattggtcctgcagccagaatcaggataattattttcctaccctcaacccaagtctagacatttaaatttaaataagacgcaagtcagatctacacagcaaaccataactgaactggttaccaatcaatgagattaggttcagctgaagagaactgaaaactctaataatacattgacttacattataaagaaacaggcacttcgagctggtatgtaactccacagtgtcatcagaggcccatgcttctaaatatttcggctctgttttgcttagcacttgactttcatccttggggtcacctcatagtccaagacagttactggggctccagcaatttcatttgcattccagacagcagtagcaaagatgtaaggagccttctcagaagtccccttagctacgtcattgaccagaacatttcactaagttgcacttagctttgagagaagctaagaagtatagttttagtctgagcaataatttgctcaccccgaaactggtattctggtactaaggacgaagaagagaatgaatgttctgatgagcaacaggtagtctgccatggttatccaactgcctagtcatgccttttcttgcctccatcaagctcagagagccccaagattgtgacccaggcttgcttaccgcacagcacagcagcagtgggagagaaagcgtccagagaaagccaggaatgggctgagtgacatgcccaatgttcttttccaaaactcaccagttgggtaaatcacattcctcctatggggaggaataagtacacatggtaagagggcccagaatattcctggaatacttttcccttcttaggagtagaacagagacccactgatagaatcgaggacctgtttaccctgactgcacctttaccaggctctcttctacttggccaacactgtctgttgttgttgttgttgttgttgttgttgttgttgttgttgttgtttttgagacagagtgtcgctctgtcgcccaggctggagtgcagtggcatgccttcagctcgctgcaacctccacctctcgggttcaagagattctcctgcctcagcctccagagtagctgaaacaacaggcatgcatcacaatacccagctaatttttgtatttttagtagtgatgggctttcgctatgttggccaggctggtctcgaactcctggcctcaggtggtccacctgcctcaggctcccaaagtgctgggattacaggcatgagccactgtgcccaccatgtactgtcttacccaacagttccaactagtaaatgctgacctgctatctaactgcaagcttatatgtcatttttcctttggcacccttcatgacccaccttctaatccccaaacctgtctctgtccttccatattagtgcattaagactaaaaggatgacactttcacatgctactagaactcactttctatgcctctttcttctccttctcctatacatataccaaacaatgcagtttttgaggacaggaatcagttttatttccctttgcattttagttcctgatatatagtatctgatacttaagagacacccaagtgtttactgcattaatgatgctgagacttacctcttttccttgtctccctactttaaagataaggaaactgagatcttgagaggttgaagggcttagtatatagtaacaatgggcatctgtgttcattaaaacctccttgtgttctaggcactttcataaggtgtgcattcattcttcttcattttcttatcaacctggtaaactacctattgttatccccattttacactgaggttaattggccaggctgtgaagtgaggaagtggctaagctaggatttgaaccttggtcttttcttacttttattaagttttatttatttgtttatttatttatttttgagacagggtctttttatgttgctcagactggtctcgaactcctgggctcaagggatcctcttagcctctcaagtagctggtattacagatatgcataaccatgcccagttacttttattttttggagataggatctcactttgtcacccagactggagtgcagtggtgcaaacttggctcactgcagcctcaacaaccagacttaagcaatcttcttgcctcagccccccaagtagctggcatgcgccaccatgcccagctaattttgaggggtttgggatttgtcttttttttctttgtagagacggattattgcccaggctggtctcaaactcctaagctcaagcgatctgcctgtcttggcttcccaaagtgctaggcgtgagccaccgcacctggtcaacttttcttactttaatctctgggtcagcgtagcacggactagagaagagctgggatcaggttttctgactttacatttcacccagagatttgaatcttatccccttttctttctctgctttgttgtaatgcaataatcatttaatagtgcttattaagacaaggcatccttattagagatacacatgcctttcaaggttagcagtttcctactgatggtggtgcacatctgctcaagcccattcttgcactcttgcctaagtctccaagaactacttattatacatacaacagttggaaagaaaatcagtctaaaatgttgaaatttcaccagggaattcagtggtcatcggggttaatgtttatcagaaaaggatactccaggaagacaccaccaattagcattggctctttgaaaggttgagggttgaaaccagtttaagtgaggtacaggcttccccaaactctttgtattataaaagctgagacttcatgtatttggggttggtttgattggttcagaaggggaaaatggttagtccatcagagggagccaggatgaaattcacagctacttagttccccttcaagagaagacacatctgtgtttccttaagtcaacacttttgacagaaaactgcattcataagacttcttcccagatggctaaccacacttttgcagttatctaggaaaaagagaatgagacattgaactgtaaatatttcctctgctccaaggtcttctaatccttggtgtcctaaaatagaaggttcttagagtatttccatcatgtggtggtaggcattgccctgggttcttaagatcaaatccttttgatcagagagtattatccttcagatatcctgctctgcttgggctttaaactagtagcaaaaatggcattagaggcttcgacaacaggtggagagaaagtgaatggggaagaggaagcagggatatcatggagacagaatcatcttacgcaatcaggccatttaactgtacctgaaaatgcgggtacaggtctgtttgctgtattaaatgatttaagtacagtaagaaacacataccatattccaagccagcgcatccatgtaaatacacatgcacacacacaagtcacaacctgaggtagtggatgaaggcgtatgtgatgattacagcacaagctatggaatcagacctacaatcgagccccacttgaacccccataataattttaaagaaccacataccccatcacctactaaaagttgttgtctaaatgtttttctcacaaaatgtaaatacttgcaaagactataatttccagtttgttgtaaaaatgctttaaaaacatttctatcaaaatcttggaactacagcttggaaatacttttgtggaaagtgtccattatgtaacataattgccaaagccattcctcactgtctcacccatcaggctaatcagatgtaactccctggtggaaaaaagtcagcattttgcaattcaaataaacaataaacgcagcaggcttcttatccctgacatccgttgcccttctgagttctctgaggcagcatgagagatggacaagagagaggggtgaaagccttgctgtgagtttgtgcctggttgaaataaggccttgctcccaacagacctcatcacaggaacaagtctttcccaaattatcccttgaattggcaactaggagtttatatcccagggcccaagcactttcaaatacttgaaatggggccggcacgatggctcacacctgtaatcacagcactctgggaggccgaggtgggtggatcacctgaggtcagaagttcaagaccatcctggccaacatggtaaaaccctgtctctactaaaaataaaaaaaaaaattagctgggtgtggtggtgcactcctgtaatcctagctacttgggaggttgaggcaggagaattgtttgaacccgggaggaggaggttgtggtggggcgagatcgtaccactgtactccatcctggatgacagagcaagactccatctcaagaaaaaagatttgaaatggatgagaaatatgtcttttgtttgtaaagtggcaggagtacagttgtgaaagaggaaatgagaagggagcactaactggcagatctcagctaagccagtttggggaagaagtgcatctagaacttgaggatctgaaaaccgattctccaaaaattatgacttgaactcccaagaaagtttgcaaatagccttaggtacttgaaaccactgttctaagccgtccgtgtcctcatctgtaaaatgcaaataataggagtatctacctccaaagatggctctaaagaagaaagatggctcaaaatgaagtacttggtgaagtctttggtgcacaataagcacacactatgtgttcactattgttattgtcattgccgttataatttgactcctctactggttaacaatgtcatttctcaatggattaagtaatccttgggcccaatgctaacaccttgtttatattttaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtgggtaaggttttcaaccaatgctgcctcatccaagatgactgcatggtcatgtgggcaagatttgaacttctgtacttccagtagcacatattgttagtatgggcttcttaaagccaccataatcatccatgctggccacatggcaggattctaaaagctgcctgaccagtggcaacctgggcaccacacaacagggcaagagctgggtttcccctaacgaaaacagtagtagcacctggggagaagctgcttctataaactttgcactcccttccttatgacaagtaggtccccctcctttattttattttatttatttatttttttattttttgagacagagtctcactctgctgcccaagctggaatgcaatggcaagatctcggctcactgcaacctccatctcccaggttctagcgattcacatgcgtcagcctcctgagtagctgggattataggcctgtgccaccacatgtgcctaatttttgttttttaattttatattgtattacttttattttttattttattttttgagatggagtatcgctctattgcctaggctggagtgcagtggtgccatctcagctcactgcaacctctgcctcctgggtttgagtgattctcgtctcagcctcccgagtagctgggattacaggcatgcaccaccacgcctggctaatttttgtatttttactagagatggggttttgtcatgttgaccaggccggtctcgaactcctgaccctcatgatccgcctgcctcagcttcccaaagtgctgggattacaggtgtgagccaccgtgcccagcctattttttatttttgagacaaggtctcactctgtcacccaggctggagtgcagtggtatgatctcagctcactgcaacctccacctcccaggttcaagcaattctcctgccttagacccccgattagctgggactgcaggcacctgccaacacgcccagctaatttttgtgtttttagttatttttagtagagacagggtttcaccatgttggccacgctggtctcaaactcctgacctcaagtgatctgcccacctaggcctcccaaagtgctgggattacaggcgtgagccactgcactgggcccctctcctttcttttaaaagttagtttcacattaagttacttttttttttttttaaaagatacctcatggatccatcttttcagcaaagtatattttaccattttgttccttaccaaaacattttaaggaaatttataaaaactgatagcatttggtttacttataatgatctttaaataagtgagaaaaacacatgtttctctcttagagaaaaatttgatttctcgttccttgtagatatagcagctgaaatacatttccgacgttccatcccattccaacagggccatgtggctgcagcccatttagcagcagccacaaatagtctgaaatccggtagtaagaccatggaccatcctttccatcttcacaacactgcatttcctaaagcgtccctctgctgaagctcatactcttggagggcacaggtggaagaaagccagatccaaaatgactctctttctatatttcgtgtgagatgaaggagagatattctgaatccaaaaaaaaaaaaaaaaaaggccgggtgcggtggctcacgcctacaatcctagcactttgggaggccgaggcgggcggatcacgaagtcaggagatcgagaccatcctggctaaaacggtgaaaccctgtctcgactaaaaatacaaaaaaaaaaaaaaaaaattagccaggcgtggtggcaggcgcctgtagtcccagctactcgggaggctgaggcaggagaatggtgtgaacccgggaggcggagcttgcagtgagccgagattgcgccactgcactccagcctgggcgacagagagagactccgtctcaaaaaaaaaaaaaaaaatgtctggcaagttcctaacccagcctgtgtttcttgacaacagttttgcaggggctgccgatagtgcagagacagaacaagaggagaacttctggtctcaagcgctggaggatttggaaacctgcggacagtcaggaattctgagagaactggaggtagccttggtcctgctacttacttttattgtttctacattcattttttttggtccttttaagtttgcatttctcacaccagttcatttaaaagctttaaccctttccacaggagaaagctgacaggcgtgtgtctttgagaaacatgactctcttggtagctaccctttatgtttatatttttgcttgtgaagctgccttccctacccccttgccttctggacagcaatttgattttatacaatgcagtcaaaagtatatccccatctccacccctcaagcttactgacttgtggcttctgccattgctccctgctaaccctgattgtatctgtttcctaccaaatcgctaaaaagcgagctaagtctcccagcagcggcgcatcccattctcttagttgctttagaaaggtttctttggcatgttttcatttgtacctggaatagaaattaatgtgatcgttaagaggaacataagaggaaattttattttactttgttttgtccttaaagtagatgacaatgcagctggtgaaaaaggccagtctatttgataagcagcaaaaatattacacagtacattgctgttaattgtaaatcctgattccatctgtattaacttagtgtgaattcaaggaagaacgagatggaatgtaatagctgaactcctggtgagttctttaatcaaagccatgaatttgctgatggtattcacactttagtctaggaagtcctggactgtttccttttatgttcttttaaattttctgagctgtaaaaaataaagtggcaaaagtctcatttttattttgatgtcttatgaggtccccaagtcaccataaggaatgtgaatggcataatggggtgaaactcttgcaattctaaaatgattactcatctttatattattttgcttctcaattgcatgtgtggttattttatgtgattctaatgtttgtgaatctgcaaagagaattataaagaaaactattagtttgaacttgtaaacatcatagtattatctggcatgaattgcagcttcagagcacagttaaaggtcctggacatggataatcctataaaatctaaatgaagtaagatgttagcaatgattcatttttatacaactttcaaaaagagcagaatgctgaagtatcagctggcttatttaaacctgtaccaccttctgcatgtagaatgatgaagaaaagtagcccaaactgagtaacgagcacaattcacaattcttgaacatagccctgcttttgaaagcatgttttggctcatcctgctttttcattgtgcattttgatatttcccttttgaagaaaaaaagttgtttttctaacagcttattttacattaggcaaaaagaaaatgatgtaaaaagtgatacaatcaggttctgttttcacccagaaattgagttatctgatgaaaacaacatccatcagtaagagtagatgttatgttgccacagcctatgaatttgctgtaacatagctccagacagatgtggcccttgacattattaatgcagaaagcaaatgagttgaatttataagccaaagagaaattaaatcctcaactaggatgaatgattggcaaattcataaattagttatatttacacttttatcacaaagaatatttatttattggtttaaatgaaccccattcccttgattggaaatgctattatacaaaaaatattagagctagattcttgcatattaaatttacatccagcattaaaagttaaagcacactataatactaataaatgtagaaggttagctaagatgaaagatgattacaattgaaatggaaatgaaaattaatttactaatcatttcccctattgctagcaataatttaggttcaactttagcaccgaaaaatgtatagttttaacaaaggagagaaatttgaatgagtctttggacaagtttttaacctctcttatcagatatttcttctataaaaatgggaattataatgagctaataattatgtggcacttaagtattcaataaaaattaactattagtatttttgccctttcttgattaatgatcactgctttaactattttttgtttagcataatataagaagaaggtttaactaaatgtcagatagagaactctaggctgccttaggaataatatacaatcatgaattatggcaaatgaaaacaggtaatacatactcttgagaccaaagcaaatcctaggtaattaaaaataattattttttagctttttattttagtttttatatttgttttaccttttatgttccttcttagatgctacctaaagttcattttaaacaaagcaatcaaactttgattactgtacagattcacatacttacctgaaaatgcgaaccaaagaattagtgatagtatcttatttcttccatcagaaccttttctaaatcaatctgtaatttcttctatggcagctaagactcatcaaagcaaaactgtggtctctcagttgtagtgattgttttacttccaacatgtgtcctgtcattctcatgaaaaatgaatattaaaaaatggatgttaacaaagcaaacaactagtctaagtaggtaaaaataataaatggatggtcagcatggcaagaaaacaaccaatgagtgctgtcagatacactagattaaacatagaaatggggcaggtgcggtgcctcaggcctgtaatcccagcactttgggaggctgaggcaggtggatcacctgaggtcaggagtttgagaccagcctggccaatgtggagaaacctcatatctactaaaaatacaaaaattagccaggcgtggtgacgggtacctgtcatcccagctacttgggaggctgaggcaagagaatcgcttgaacccgggaggtggaggttgcagtgagccaagatcacatcactacacttcagcctggcaacagagtgaaactccatttcaaaaaaaataaaataaaaaacatagaaattatatacatgagtaagtgccataaaataaagaatatcccatgacaccaatgaagccagtaaagaaaggtttcaatcaacttaaaaagggtatttatctgaaataaactgttgtataaatagcccacacttgtttttaaatgctaggcatctttctacctactaaaaaggaagttttatatgattcaacctaacatttgactgagaagcaccaagcagtcaagaaaaagagttctggagtcagagtactagagctccatgcccaggctcttgggcaagttgcttaacttgtccacgcatctctttcctttactgaaatgaggatgtatggtaattttaatatctattgtatagggttacttatgtattaaatgatattctacatgcaatctgtatgggacttagcacatgttaatgttcagtgatcagcaagtctttttacagttataattttctttttcaaaattatcagtgagataactgatctagtcaagatatagtctacttgtttcatttctttttcaacaaagttgttagatatatgcacatgtgtgccaacacttggctgttgttcaaagatcttgttagtagtgtgtgtatagctgaacaccaggtgaatttgggaactatgaaatcttagagacgtgacagatgaaaactctactcactttgcagtattccctcatgatcaatagttttataaagtgccctcggctcatttactaccaatgtgaccttgggtgagtcagcctcttcgtgcctcagttcctcacctataagttgggaggaatggccaggcgtggtgacttacacctgtaatcccagcactttgggaggctaagtggggtgggtcacttgaggtcaggagttccagaccagcctggccaacatggtgaaatccatctctactaaaaatacaaaaattagccaagcatggtggcgcatgcctgtagtcccagctacttgggaggctgtggcacgagaattgcttgaacaaagaaggcagaggttgcagtgatccaggatcacaccactgcaccccagcctgggtgacagagtgagagtctatctcaaaaaagaaaataaataaataaataaataaattgagagaagtaacagtgcctaccccatagagttgttgtgaggcttaaatgagtgactacattcaaaagactcaacaagttaagctgcggttacttttagcatcagtattaatataaacaactaaatcacatggcaaatggaacttgttttctgtccccatggtatcaggaagatttaccaatgctagtttacctttatactattatacccaggagtacagaactggctacaggcatattttcagaattttagcattctccaaccatgagaaatgaatatccactacttgatattggtttcaaatcctttttttttttttccagttctgagccttattcatctttggtatctaatcttgtcattgcttgtgaagtattcagggaagaacatatttgaaaccgaacaaacttcccaattcactggtaacatccaattcaagtcctactgcttgtgagcaaaaagttgaatataataacataataaatgattatttttactttctctgaggatcttatacaaagagtatttctaagaaacacttaatctgtatcaaataatatggagacttagctggtctacaaactctggggacaggccacttggccaaaggaaagacaatatacagtctagacgaagcttgggaagaaccccttgcctttatatcagtcatccctttccagcccattgttaactgcagttggagatagaggcagcattgcaagtacaggcagcctggtgtccattgagaagttcttaattcgtttctgtaagatatattcaaggtggcctcatgaatcccatctgttagagcccactgagtggaaagtgaatgcttaaaatgtagtttacagtaagcaaatgttagagcatttcaatttgcctcaaaactgccaggggtggtatttgattaaataaactcaatggcttaagtacttaaattggatttgagatgtgcattataaatgtcacttgcaaagcattttccagactttcatagttcaattagtacatccattttccagcctttggttttgccctgaagagactgtatttttacctcgcagaaggagaaatgtgcttactgttgagcaccaaatcctttccttagtccatggcttaattgtttctaaaaattgtcaatgccacaggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtcagtaagctttctcttctttccctagggtcaaatttggcagccattctgcatagcatgtacgccgagatgtaagcatggcaatggtatcctcctatgggctcagccaagcaaagaagcttaaaaacagatcttcagagactttgttctcaaaatacaatctctgggaggttatcctgaaaagcagggaaaactagctttcaagcaatgtatttatcaaaaatgtatttatggtggctgggtgtggtggcacatgcctataatcccagcactttgggaggccgaggcgggtggatcacttgaggtcaggagttcaacaccagcctggccaacatggtgaaaccctgtctctactaaaaatacaaaaattagccaggcttgatggcagacacctgtaatcccagctacttgggaggttgaggcaggagaatcacttgaacccaggagacagaggttgcagtgagccaagattgtgccactgcactgcagcctcggtgacagagcaacactctgtcccaaaaaaaaaaaaaaaaaattatttatggccataatcttcttacaaaaatttgaggctccaatgtcacacggagcttgcataattagtttattattccaatctcattggaaggggaaaggattttctaaatgtcatacactcatagcttcacagaaaaaggggttcaggttcaatgcagggaggcttaatctttcattacagacttgcagtagatgattatgttgttcaggagacatggagttctctccaagatgtgttagatgtcttgggccaggataaggcaagccctggctatgttctgtctctaattgtcatagttgcctcactttgctacatggaacaaaacccactcttgcacacaaagctgaattcaagatttgctggcagggttagccaaggcatatgtaagtaacagtgtttgtggaaccctgggccaaggagagcaatggaggtctagtttccttttctagggtgagtgctttattttttgttaatataaaaggatgtataaaatggtaacaatctcatgccatctttcttgagaaccaagacattttttgtggttaataatctattagctagacattcgttaccttacccagaagagcaaataaatgtcagattcagaggaggcaataggctagctactcgcttttttcctctaaagacctcaatttccctagccaccttattaaacctagctatttgttttgcaactgacaaggatactgtgagagaaaggatagtatgggaagttgggttctgaactttgtgttccaatcctgggttcattctttcaccactcactcctccattcatttaatacccatactgtgcattaattcactcaaagaacgtattacaactccccagggagtacggagtctaatgaggagactgcctgggaaacagtgggaagataatggcatcagtccaatgacagaggcaagcctgggcagccttgagggtgggccctaacccactatcaggggacagaaaagacttcctagaagtagatgttgactatgcagaggaaggtagaggatgggtgggcattccaagcacagagaaaagcaggtgcaaagggatgtcaaagattgtggtgcactgagggaggggatgcaaatattctaacatgaccagagtctagaattggaagcttgtgtgctaggaggaattacagactaagagaaaaagcaaagacatttctgacatgttaggatgatgacccaggtttaggccccagccacaggttagcttgtttatccagttaccctaaatagatgtgtctgatgggtaagtcacatatcctaatatactaattgacatacaccattaggctgtaagaagtccaatggtgattaaattgcggaaaccacatattcagtcctaagtctgctgtaccaagaagacggctggcacctgcgggttccctcgggtacctgtgaacactgccttcccctcttctgtgcagttctgttccccagagaaacaggagcctgcttgataacccaccttccttcaccccaaagagaatccatatcaacacataatgagtgcctagcaagtgctatgtactttacattctcagccctcacttatacaggatagacaaatagcaagtataaaacagagtcattttttccctctggagtgaaacagttacctccaaggaagaagattattgatagcccaggaatacaaaagacctgttttctcatccctccttcactgaaagcatttagcaaagataatgacaatgaattggacgtgcaagtgttgttatagctgaggtttaaaatggctctgctaaaaaaaaaaaaaaaaaaaaaaaaagatcttgttaaaaagaaaaaaaaagtatcatccacttactggcataatgaatggctgtggatggactggttggaacatctgtgtggcagtgtgtgaactgtaagatcctgagatcacagacacgcatgagccaaattgaccttataagtaggatgcttcttttttccttcacttctgtcattttctctaaatggtgacaatacatacatgtcccatgaagcttcacttttttttctgaattgatccccaacaaaataaggctctaaaaaataagtggtgtcctagacattgtaagccccctaaaatgacctagttaagtgaagatatagctgagatgcctgtggccagatactatggaattattggagtgatttatgctcgcatcttgggtgtctgttcttttttaaggaattcacttactctgatagaccatccaggatgtttgttagtaggcacaccctccaattttgaagtgctggggaggagatatggtcattacaaaagctgcttagagcaaagagtggtaattgtgtgtgtgttgaatgtgggtgtcttttgaacactgaaagactacctaatgtcatgaaaagacaagtgacttgttaaaggaatggagctctcttcccctggggtactactagcctgtattaaacctttgtgaacattagggaaaggtactgttttgcggtggtggcatggataagggagctagggaatgagaaaaacaccttccttaagttgaagataacccaagccacagtgcacagctggttttcagtcccctgagcctccttggtactcttttccaaatggacctagtggaggaattcccaaggggctgaaaagaccagagtggggaagctgggagagatgaatagcacaccgggctaaacatgcttggcgttattttcctggtgctatctttctggtggctctttctcacatggttaggctgtatgcaggagaacaagtggtgcgcctgttcatatctagaccagcacctgttaaaccttattattttcactataagttggatcaagataatatgaacgaatggacaaggatctgtgccattgctgggaggaaaaatagctaaaaacactccagctcctgcaggtgggttactaacatcatctccatacaaaaagaataatgcattggctcaccttccatcttctgaggtctcaacctactctccagagtttgcccctcattttctgcccattccttcctaccacttctcttcctccagacctttggaaggtccccaggtcagaatctaaagggttttcactcacttctcatcatctgctgcatctgaggctccactgggatcttggcaagccttccttcaagttgtccatattcattcctgaagctgaaaagccagttgtcatgcctgacactggagaacaaagaaacacagtcttatatcctctttgtagacatgggagggaagtggagctggagtgatttggaactcagtgtggggatggagaaaatgataaatgggtcacagggaagtgatcttcatgtccctttaggccactgtttctccaactttctcagctgggatgcacagtctgaaatatattgtacctcacaattcactacacgtgtatacccccactcatatatgtgaatgaaactaaaaattgactgcacagtatacactgacatttttctgatttttcttctgtttcttttcaaatgctaatctcactaagctgacttcaagacttactagtaggtctcaaccaatagtctgaggattaaagccttagacagtagtttggagtgtgaacccctgatgaccttttccatggagtgcttgttaaaataagggttcctaagcccagcccagacttactgtgtcagcactttcagggagcatgggccgagaatctacattttagcaaccttttcagtggattcttttgcagaatagaaattgagaatcactcccttaggttttgctaagtggaggtgataactgtttcagtgaaatcataggcaacagctgggtggcagggtacaaaggaaatgaggctgcatctaagtaaggccctggagcttctgcatcttatgcatcttatctttcaaatgaattctggtttgtactacagcttatcacagattctctctctttgcagataaggggcctgtgatctcagctaccgttcattgataacccttctttcccttctgaagcttaaatatcctttggtgtccacttaatctgtttctgaaatgagttctggcctcacttctttgcacaccttaaggcagaacgattttttgtagatggaaagttctccacatgcagagcatttggacttttataaaattcatattgaggctgggcacagtggctcacacctataatcccagtactttgggaggccagtgcaagaggatcgcttgagcccacaagttagaggccagcctgggcaatgtagcaagaccctatctctacaaaaaatgaaaaaattagccgggcgtggtggcttgcacctgtagtctaaactactgaagaggctgaggcgagaggatcacttaagcctggaaggtcaaggcttcagtgaactgtgattgagccagtgcactcaagcctgggtgacagagcaagactccctctctttaaaaaacaaaaacaaaaacaaaaatcatattgacatttccttttgctttgtcattcatgcttttcaataaaattatacttcttaattgtatgcagccatttttatcttcttacagaaatgcttttaaaaaatgttgcagcatctgcttttatttgtggctgctggtggcatgacacttggacatttcagtcactcacaagtaacctctttatttttcacagctgcttttgctaccatcgccttttccccctgccaagttcagtttgcattttgaacatttttgagttttccaagaggggagctttgctctgcttgatatgataaagttgttttgctccttagaaggagtgtcattttcaatgtgtataataccagcttcttttgcaatatctctctgagtcaggaacaggctcagccctcggaggaagtatgaaatggaaatatgtatcttattcttgcacatgcttctttcttcacaaatatttggagtcagctctcaagatcaaatgaatcctcatgccaggcttcaactttctccaaatacctagtgtagaattgtgtactgtggaaatcactggaagctaaaaacaacacattgaatatatgaactttttgtttttgtctaccaccctttgctagatctgcttctctttcttcaggcaaggagtgataaactagagagaacataggcttcctagtcaggcagacctcgcttgccatgcattagccatgccacttccatgagccacagtttcctcacttaccaaagagggagcagggtcacttgttatcagaagagggagacttcacaagatagcatttttttctggtaaagtcaccatcattccatcttgcctcaaccttacagggtcagaaactcacacagtgagacttcttcagcatcccagacttcaacaagatccagatggctgccataaagccaccctagacataaggttgtataccagaatgagaatccattcacaaagagaagtggatgtgtgtctagtgaccagtcacttatcagtttgaccagcaaattctctccctgtagaaccagggacagcaaacagaacattatcaggggaacatagaactgtggaacaaggattggagtttggcttgtatgctttaaataaataatggcatccagccctgaccatcctcaaaatgtatcatttccattagcttcccttctctatgattctgttaagacacaaattttaaatgtaaaaacataatattttttgggagggaggtgagggatgaagtctggctttgttgcccaggctggagtgcagtggcacgatcttggctcactgcaacctccgcctcccaggttcaagcaattctcctgcctcagcctcctgagtagctgggattacaggtacacaccaccatgcccgggtaattttttgtatttttagtagggacagggtttcaccatgttggccaggctggcctcgaactcccaacctcagatgatctgccttccttggcctcccaaagtgctgggattacaggcatgagccaccatgcccaccccaaaaccataatcattaaagttttattttattttaaatagtcacataataattatatacatctatggagtacaaagggatatcttgatacatgtatacattgtagaatctatacatgagtaattagcatattcatgacctctgtaagtcagagaaaatgactgagacaagtctcagtcatttttactttgccaaggttatggacacgccctggggaaaaagggacacataccacaggaaaaatctgtgatctgtgctttttccagagagggtctgtgggcttcaatatttaaaggaaaaagagtaaagaaaaaaagagagggagagggtggataaaagacggaagctgttgcgttcttttgagccttttgattagcttcactgaataaataatggcatccagccctgaccatcctcatttcatttttcatgtgaaaggagtgatccattatatatttatctggagctcagtgaatctgcatttttacataagataaaataattatagagtataggtagggaggagtcagatatgcatttttctcaggtgagcagaaggatgactttgagttctgtcctttgtcccatatttgtgaagataaactgttaatttactttgttggggtgaaattcaactgaactgctttaaagatctcagggcccgccaggaatttccttgtgggcaaaatatgagaaaggtatacagctacctatgtaggaacgaaatgggaaggaggtttgcaggacccagtgcccatcttcactgtttcctttggcttactgagtttgaggtcctgagattttaattttattttcctttcacacctcaaccacttatcatttctttctttctttctttctttctttttttttttttttttttttttttgagatggagtcttgctgtgtcacccaggctggagtgcagtggtgcaatcttggctcacagcaacctccacctcctgggttcaagcgattctcctgcctcagcctcccaagcagctgggattacagatgcatgccaccatgcctggctaatttttgtatttttattggagatgaggtttcatcatgttggccaagctggtctcagactggctggtcttgaattcctgacctcatgatccaccttccttggcctcccaaagtgctgggattataggcatgagccaccatgcccaccacatttaaaattttctcttttagcgattttgaaatatacattattattaactgtagtcaactttcagtttagtggatcaccggaacttattcctgccagctaaccaactttgtacccattgaccaatgtctcctctttaccccagcctctagtaaccaccattctactttttgcttctacgagttcaactttttcagattccacacataagcaagatcatacagtatttctctttctgtgcctggcttatttcatttaacataatgtcctctaggttcatccacatcgtcacaaatgacagaatttcctgaaaaacacaattcttatgtaaatgactggctcatgtcaaaaaatgtttatttaactcattagcaaggaatgataacaggatggcaaaacttgtttaaagaggcataaggagggccaggtgcagtggctcacacctgtaatctcaatactttaggaggccaaggcaggaggatcacttgagcccacaagttaaacaccagcatgggcaacatagtgagacccagtgtctacaaaaaataatttaaaaaaaaaaaaaaagccagatgtggtggcacgcacctgtggtcccagctaaggaggctgaggtgggaagatcacttgagcctgagaggtcaagcctgcagtgagccacaacctcaccactgtaccccagcctgggtgacagagcaagaccctgtctcaaaaaggaaaaaaaaaagagatacagaaactttatatatatatatatatatatatatatatggacacacacacacatatatacatatatgtgtgtgtatatatatgtatatatgtgtgtgtatatgtgtgtgtgtatatatatataaagttagtaggatatatatatgatatgtgatatatcagccagtggggaaaagaaatgttggaataagttttctaagttggaatcaaagctgcccaataacttgtcgggaaataaaatcaaagcctttgaggttatcttttctgaggggagaaatgatttgcatctctaccagacagaattcaatttgtatcttatcacttttctacaagttgccatccacgtttgcagagtctgagctctgagcgagagaagcagtgagaattgccatcccctagactcagacgcctctgcggcaggctcgctagtgtctagtgtgccttatttctcagggcttgatcatacatcttatcgcttctgtcctggacccaccaccacctctcttcagaaatgttaatagcttcccttaagtttgattctggtctgggaccattcatccctccctgatatccttatgcatctctgttgtgatcaaatgtacgtatttctagcatgtaagtttgtgtattatctgtagaatgttcacttacaaatggtgtactttctgaaggtcactccatttccctcatgtccagattcttggagaacagtcctatcgtcctcctcctccactgttgttctgccatatgacttgtcaggcaaggctatagtaaagattaaattgaaggctgggcgcggtgacttgcgcctgtaatcccagcattttgggaggccaaggcgggtggatcatttgaggttaggagttggagaccagcctgaccaacatggagaaaccccatctctactaaaaatacaaaattagccaggcatggtggtgcaggcccgtaatcccagctactcaggaagcagaggcaggagaatcacttgaacccaggaggcggacattgtggtgagccgagatcacaccactgcactccagtttgggcaacaagagtgaaactctgtctcattaaaaaaaaaaaaaaaaaaaaaaaaagattaaattggtaacactctagcccagggcatgtctcttcctctctctcagatggggtacagagagctctttccttgtcccagcctcttcgtaatatcaggcatcggcaatttctacagtggggaaataaaatcaagacagttagccctgagtgcagtgggagtttggttagttgcaacttgtcatcctttctgaatgacagtgtgcctggccttcagtcccacaggccccgagggtgggtggagggtgtgccacccacccagagctgcaggatgttcctgagtcaaggaggcccacatggtcctgagaggaacggaggtcaatctgttgcagagggaattgggaaaagggtaaaagctggagaagggccaggccagagccaagctgggagctagaaagcagaggctgagtcaggaggggtgctgtgagcaggcagcaggcaggcctgagcaaagacacccgcaacagggactccgccacagccagccagcttggtggtggctggggcaagtgcaaaagaccagcaatggagctggcaataactaggggactagctgcttgcttgcagcttggtttgatctcttggagaatttggagaatgatctagctctttcgtttttgttactatgtgaaccagtagatgtgtgaaggtgctctgggatgaatgagaaaggcagcacctaagtctgccacagatcttaaaaactgtgtaacttttttggttgggactcagctccccaagggccagggtagcccctggcttgcttatacttacagccaaaatcccagctactgattctctcattgttgagccctcattttttccagctcttggtgccacactgttgccagaatgaagcaggaggtggcatttggagcagctcttcctttctctcctcagccaagaagactccccagacaggaaggcagcagctgccttctgacccaattcctctcaaaacccctgagtttctagtagtataaactgagattgcttcttcttgggctgtaggcttccagtttagaagactgtattctatttcgttttcttccagcaccataggtagtataggattgtcctcaaaactggcattacttaaattgtcagagttaaaggaatggggctaccccagtggtatctgtcatgagtaaaccaaaatgcctggtgatttatgggaaaactgtttctgagaagtaggtgtcagtttggttctcaaggccattgggacaagggagtgagccatagggagctgtcagagcttgaggactgcttctgggatggctgtcaattgccatgacttgctcaagacagcagatgcaattgcccttaaaatccaagtggggagagttggctctgcagttaaagcctttcacatgtgtcaaaactgaaaacataagcatcgggtttctgatcttggccttgaggatgttcttcaaacatgtcggtagacttgcttagaaatataaaacaaggttgaatgtgaatcatggtgaacccaccctgcctcctgtgaaagcttctgttctcaggagggttagaagcaattgtagcacatgctgacaaatagttaaaattgaactgagctttgtagaactgtatcctagccctgagtgttatgttccgagaagctcactggctcttttagaacagaaaaaccttgcaactgtgttcatggtccaggttctccgggggcatcctctagtcagcacaaaagacagaccctacaagaaaaattttgctttacacaggctagggtagaatgcaaagccaactgacaggttggtgagccataggagcatggagcaggactttatgcagatgttcttggaaagccacaaagggctctgatgagaagaaacccagtgggcatgattaattattcatctttagttggttgggcagttggaaatgaataaaggctgcctgaccagctaggagattacatgtcgaaaaaaaaaaaaatcatgatttggtggaaagaacacagcaaacgaggtcagatattctagtcttgaatcctggtgcttctgcattctaactggacaagtcagtccatcaactttttcaaggttcagtatcctcattcttggaaaggcaatgattttgctgcccagaggtgttgtaagatcaaaagcaatcatatgtaagaaagtaactggataaaagattcatttccaggggtagggggaagtatgaacttaaacctcagaatccttagaattatttttgcacaggaagtaaatccaaggtaaccactaccaatatccaggtaaacaggggtatatggcacaattcattgctactggtttgagaacagccccctgtgctccccatttttgttaattattgatttctagactcttatcttttatgtagttttaaaataattttatttttgttaatttgccattactaggctacttccaggagaaccatatagctggctattgaaattcagtatcctttaaccttgggagatatctctggagaaatagattacttttagatttaaactatttattagcctctcatcctgaagagttttccatcaactcttcaactctgaggctcagaaaaaccaaggctctttgccaataactgtgaccttgaagttaatgagctactctgctaacccactgtggttggcactcatctctaatgctttggttggtgtactaccattgggtggtgttgttagttttaggtgccactcttccttgtgcccctcctgggttctggcctgtggtgcagacacccaagaatcacaggccaatagagtcatgaagaacttcactattattccaggcccacaccaaatgtttcctcaaatgcaaggattctggtttactatgttggaaaacatgcctcagatctaagaccaaagtgagtttcctagctcccattgaaagcttaagatttagcaccctcacatgtgggtgcacctcaaggatatggctaggcctgcagagcagaagctgatgcactttcccaactagccgtaggcacagagtctgcaggactgcacctctgtacctagttgcaagtggaatggagatagcaaggaggatgccccaccctctaggaatggtggcgacggtccctgccccaggtgtgttgcttgccatgtggagaaaacgtggctaagaacaaagacagaaaaggggcaaaaaggcaagagatcccacagataaagccagagtgggacataagcaggaacctcgggcagagagatttcacccactagtaaacagggtctgaagaatgtcaatctattaccaattctaataactactagcctccttctcattttttcccttctctcactatttctcctcttcatccctttgagaaagcagcatggagatagaaggaaaaggactagaataggccaggtgtggtggctcatgcctgtaatctcagcaatttaggaggccatggcaggaggtcaggagctcattttaggttaggagttcaagaccatcctggccaacatggcgaaaccctgtctctgctaaaactacaaaaattagccatgcaggagtggcatgcgcctgtaatcccagctatttgggaggctgaggcaggagaaatcgcctgagcctgggaggtggaggttgcagtgagccgagatcgcgccactgcattccagtcggggtgacagagtgagaccctgtctcaaaaaagaaagaaaaaggactagaatagaatataaatcaacaatattttctccagtgaaggctccttggaggaatagctgattccagatcggggataagaactattcatggtgagtcatattttgtgccggaaagtaaagaagcgaccaaaaccaatggatcctatcaaaaggacacaggagtccacaggaaagacttcctgtggccaaagatgagaacatttgagcatccaaaagaataataatgcaactgattgaaatgcgttgaataggctgggcgtggtggcttacgcctgtaatcccagcacttttggaaggccaaggtgtgcagatcacttgagatcaggagttcaagaccagcctggccaatgtggcaaaaccctatctctactaaaaatataaacattagccgggcgtaggggcaggtgcctgtaatctcagcaactcaggaggccgaggcacgagaattgcttgaacccaggaggtggaggtttcaatgagccgagattgtgccactgcactccagcctggcccacagagtgagactcaatctcaaaacacaaacaaaaaatgcattgaatatatcaaaatttataggttcatattgatcccatcccccaccttccccacacacaaattctcattgggccaccattcgaagtatttagtgaacaaattccctgttttgaaattgaaaggaaagaattagcattcattcattctgcccttcttgtaaaagctgtatttcagagtaacaaagcagcactaattgataaaagagaattctcctttacaaaatcatttaggctaataaatacagaagatgttaataggattagaaaaagattatcgctttgcaacccctaatgaaattttgattcagacagtgatcaataaataaaacctttagattaaagattgatgagaacccttacaatagaggaatgaggctgtcatcacctgaacccacccaaagtaggacagctagacatgatgtgataggaagcactgtgccacctatgaactgttcctgcccccagtccccacctcaaagctaacctcgactgaaatcaagcatctagatttaacttccatttagagaaatgtgggagacagaggaatatactacagagcaaatgacacagtttcagcaatagatcagcagcacagggggaaggacgagaacccaccacaggtaagaggagatttaacagacttaacacagaggtagtgtgtggactttgttgggattctgacttaagcaagccaacttaaaaaaatgtttttgaggccgggcacagtggctcacacctgtaatcccagcactttgggaggccaaggctggcggatcacttgagctcaggagttcaagaccagcctggtcaacatggcgaaaccctgtctctattaaaaatagaaaaattagctagatgtggtggctcatgcctgtaatcccagatactcaggtggctgagataggagaattgcttgaacccaggaggcagtgagccaagttgcagtgagccgaggtcatgccactgcactcctgcctgggtgacagagcaagaccttgtctcaaaaaattaaaaataaaataaaaataaaaaatcatttttgagacaattggggaaattatggactaggaagtggtggctatcacataagaagagttgctgttgccagtgaattaatgatgtggagtttatgaaagaaagtgatcatattttttggaggtgtatactgaagtatgtaggagtgaaatgacatgcggactggtgtttgcttgaaaacactcccccgaagaagagaaggatagctgaaggaaacatggcaagctcttggtggttgttggatctgagtggtgaatagatgggtgttccaacctctctactctagaatatgtatgaaattttcaccaagaatattttcttccagtgacttactcttcctttccttaggaaagaggagcagaaatctcctatctggcctaaggcaaaaacataattgtggaacagcctaaatattcctctctgcaatgagtatttattaaacaactgtgtgctaggcaaggagagagtgtgctatggcaagatctaagctttgcagtcagaagccttgatttgagccgattctctgttgccatcagtttgatcctgggcaagttgctatttctctttgagctttcatttccctgtctgtatatgatctgctccacaagctggtagagacagtaatatctctttgctttctaaactgctcactcaacatccacaggccttactagcaagaagtctagcatcccccattggaggaccctccccctaccttcctcactgtccgggaatctgggtctcctcagcccacagataggccggcctggccctggtaccagaagtgccctccctctcgtgtccacacagtgtcgaccttggagctttgtcttgcctggccactttgtcatgggacagccttcctgattcccagcatggccttgggtgaggggtgagggggatggctggaactccagaattaaatctctcttagttcacactctctttctctgcaatgattcataaaggcacaggacatcatggttgatcctcagcctcataaggtgcaggacaagccctttctgtccgtcaaaatactaaccccactatgtgacaggtgctgccttaggggcttgagatatatccatgagcaaaaaggacccctactcccctcaaggagctggggagtggggatctgccacaaacctaagcccaggccaccagcaaagtcttcccctctccccctggtgagtattgctttggaaggtaggggtgctctcaaccacacagtgtgaacctaaccacttctccctaagcatcaccagtgagcatgttagatgggcggtgggtggtggggccggtgtgggggtgctggtgtcactaggctacacacacacataaccccacacaccctttatgtagtaaagtggggcttactactctatccctgtataagtgagggcagactgagaaaactttatatctgtcacctcttaaaatgaagactcttacccatcttacggaatcgttataaggattaaatcagatttcttcactgggctgtcctcataaaggttgtgttttgctcactgctctactttttttatcactctatcctgtgaaaaatatcctcagtccctaaaacagtccctgacgcatagtagtgtccagtgtgtgtgcacacacacacacacatgcacacacaatgatggaatgagcgtgtgaagagggtcgtctcagggaacattagttctgcagattctcagtcggtctggggtgggtctgagactgcattttcaccggctcctgagggtggctcctgtccaggaggacactgaaagtggtgaggccgagaggtgcatgtttagtggcaggagaatagaaccattaggcacttggtgtctggagtctcacagacacgtccccaccattcttacctttgtggccttgagcgggtacataaccccagtgaaattgaatttcctcacctctaatatggcaataaccactgggactggttggtgaatagtgttgacccagtcagcttgatattttagctgtctgtccagtaaaataaaaacccacacactgaccactttcatattgccttcagaatgccatagccctctgaagtaaaatcactggatataaacaaagatacttgctataagagttttaaccttcacattttgccctgcatagctctgattttgtttttgtttttgttttgactattttacaagaatgtattcatgcattagttgtgtaaaaacaaatatatatatataattacagtagaaaattaagcctgaccattgcttgaagtctttgtggagggcatctggcacaacttggtaaaacccgtggccccctcaaacgttaactgagcatcaagcgctgagtgtgctgctgggcgcagtgcccagtgcggtgagagcttggggactgctacatattcatgtgtgtgcctctggaaggcaggcttttcttcctcttgttcactgctgtttctagcaccccatgctgtgcttacaatatggtaggaactcaataaatatttgatgaatatacaaatgattattttagcctcagatgaacactcgcaggtggtcaggtgaaggagtgagggctggtggaggagtgaggctttagccagctgtggttggccttagatgcagagagacccggggtggggggcaggccgcagcactcagggtagatgccttcagttaccaaatcaaaccctagacaaatgctgagggagcgagttaagccgaggtgcagagcaaggtgttgtcatagagacacattcaggtcttttacatagtgttctgtgatggtgctcattgggggttccagagcaaataaaaggatgaacttcatggtacttgcccaaagagaggatacgccgagcactgtgcttagcagagcaccaggcaggagtggggaggaaggaaaggcctttggcttattccccaacatctcagcagttgtaaagggctgctgcgggcagctcctctgaccagaggttgccccaggaaaatagtagaagtcaacttgccttgaggaagttctctcctatatccccctgatgacgactgaaaaggagggagggaggacccagacgttccagttctcctcctttttcagctttggttgggaattcataaagtccaaagatattcttggagtgggaaaaaaaggctgcaggattggtgcagggagctgactgatgctgatattacaaatcatgatgtgactaaattcgtgtgaaaagattgttcatcaagaagttgcagaaggaaaagtctccaccccagctaaatattcacatcccattttctctcttcaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtaagacctcaggtggaattttaattccttgcaagtaatttctcactgggagcttcctccacatcctcctgcatatttggggccctttgctcttttccctttcagcctttgtcatcaagattatggaatcagtagaagcaaacagctgaataaagaattttcagctctagtaaattctaacccagaccccaaagttctgtggtttcttaccagtttttttcggcactgagctcagagccatctttcccaatctcacagatttcacccaaccacggtcatctcccaccatcgcacagtagtcccataaatatgacgtagttatccgactccaggcaccaccagtctagtccttcctaccacttgtcttctacatgacctacaaggccccagggatttggcctctccttaccttgccagcatcttgtcttgcctcttcattcattcattcattcatttttgagacagagtctcgctctgtcactggagtggagtggcgtgatcttggttcactgcaaccgccaccttgcaggttcaagagattctcctgcctcggcctcccaagtagctgggattacaggtgccttccaccacacccagccagaatgcaatttgctaactaattggagggttgatgacggaccttttgaagttgatggaaagttagttagaatcttttttccttttttttttttttttgagacagagtctcaggctggagtgcagtggcacgatcttaactcactgcaacctctgcctcctgcattcaagtgattctcctgcctcagcctcccgagtagctgggattacaggtgcacaccaccatgcgtggctaatttttgtatttttagtagagaccgtgtttcaccaggttggccaggctggtctcatactcctgacctcaagtgatccacccacctcggcctcccaaagtgctgggattataggtgtgagccactgtgcgcaacctcttcgtatactctctagcttcagctggatttgtttcaggaatggtgtatgctgccacctcctggcctttgcacctgctgtgccctgagcttgtggcgcttctctgctaaacatgcacaggctctttccctgctccttcctctacttcaggtccctgctcacatgctgcgacttaaaccactccgtctaaaagggcctttcctgcctctccattcttcacccttctttcttggttcgcagtacaaccacagatgatgctagttatttgcttattctgtgttgcccactagaatgtaactccatgagggcagcgattttattctccactctattctcagttccaagaacaatgctgtcacataaaagtgctcagtactgcacagcagaatagaagcgcattggctctgagccttatatactctttcctttctctgaatgctcttctaatccctaggccttacctgcctcattccgactcaactttttggtctcacatagatcagcgattctcaaccttgattgaaaaaatggaatcacctagagaatgtatcccaatgttcaatcaaatgccagaccaattaaaccagcgactctaggagacagatacggcatcggtgtgtttttacacctcccccagtgattccagtgagcagccaaattgaaaaccactagtttagaggactccccttcaaagcctaacttcaccagacaccacccaacctcctttacctcaagtctggactaggggcccctcctatatcgaacagcagcttttgcttttggtagaatttacattattaaaactgcctgttcagaggttgcagtgagccgagatcatgccactgtactccagcctgggtgcagagtgagtttccaaaaaaaaaaaaaaaaaaaccaccttcctgtttccctgcatatactccccagcagattgtaaactttttgagagcagggatagtaccttattctctcatttcccattatgtggtatttgatatctcagtatctctcacaatatctgaaaccaaaaagctgaaccttgcttactttaaatatagtaacattgaggtcaggtatagttttatttaggaaagcagatttctgatcttatgtacagtttttgggaagagcattttgcaggaaaatggagtgggttgaagtcagtcttagcagtgtactcacctggaaacagtttgtcaccaaacagctgactttcaaagcaggaggctgccactcattggttggctttcagggatgtgttcgctgaagcaagttgtcactgatcaatttgatagttttggaatcaattctggtgatgatttttactatggcaatagaacaattagtcttatcctaggagtttggggacacttagttttccgcagacatgctaatatttgctgaatgaataactatggacaagttacttaccttctatgagtgtcttcctaatccataaatagagctagctctactctcatcgcagttgaggctgtaaaagtagactacattcagattataaagggccttgaatgtgatggtaaagctcttgaactttatgctggaggcatattagtttcttaagcaggataatgatataattggtaacatagaaaggcaatacaatattattatgggtttatcgaaggtgggttggggaggagaagatcacaggcaaggagtccaggtaggggtaggtaagataagacagctctttcagaactaatgagtctttaatattttcagcacattgtgatagagcagtctgggaagcatttggtggtttggatctgttggtgaggagagatattagagccagagttaaagatttaggatactgaagggtggggtttaggacaagttgcccttggtggccttataacaaagaagagaacagaaccaaggatggattctaacagtaacaaaatgtatctatgtatttatttatttcagacagagtttctctcttgtcatccaggctggagtgcagtggcgtgatcttggctcactgcaacctatgcctcccaggttcaagcgattctcctgcctcagccagctcccaagtagctgggattacaggcgcccaccaccatgcccggctaattttgtatttctagtagagatggagtttcaccattttgggcaggctggtctcgaactcctgacctcaggggatccacccacctcagcctcccaaagtactgcgataacaggtgtgagccactgcacctggccacaataaccaaatgtaaaggacaggaagaaataaaggcaggaaaggactgaaagcgagcagttaaaatggtaaaaggatcaaaacgaagtggggttgtagaactaaggaaggagagttttaagggtgaggaggtgtcacgagcggcaaatgctaaacgccaaggaggatgcaaactccagaacattcctggatttgacaagtagggtcattttccagcagtgcaatgtgtcagggaggacctgaaaaaactgaggagagaatggaagatcaaggagtagaaccggcatgtgggtgattttaaaaacttgtgttggtgaagaaggagaaatggaagaagatgggtgcatgtataagctgaagaggggataagctcatttttttaaaaaaattttcttagtagagacagggtctcactatgttgcccaggctggtctcaaactcctggcatcaagcgatcctcccatcttgttctcctcaagtgccacaatgacaggtgtgagccactgcacctggtggagctcgcttgtgggagaggtagttcagcatcgtgattcagagcacaggctttgagatcagccagttggcctgggattacatcctatgacccttaccaactactgatctaaggcaaagctcttaacctctttgtggcttgcttttctcatctgtaaattagggataatattcagcacttgcagcacccccactgtgggtggagccacctccttggcatgaggataggtaggatgtgtatgtcttccttgccctcgagagtcttacaatttactagcagacaatggcaattgagccagtagccatgtcacagcatagtcacaaggatagacctcatggcgctcattttagcaccttcatgacttcaaacaacttgttgcacctgaaatgttactccgggttttgggaattatggttacaacgataattcaaaatggctgttcttgacctttcaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaactctacaattaacatcagaggaaattttttacaagttcatcttactatcactttttaaaaagagaaacatctgtttgaaaatattctctgtgatgatttccttaattcactttgaaatcagtttcttactatgaagtcattaatgtaagaacttggccaacaaagcttttcttctcataggctggctctactaggggaactagtgtttggtaaactgctgggactaccacaatgggaggggtacaggtataaaattaagttatcttaaaatgtttcagcaatgatgcacgtaggagaccataataggtggtggtaaatgttttgcccacgtataggaatgattttaactaagatgtatgctattccctatgcaacaaattatcaaacaggatatgtcttgtgacctgttttttttttaaggacacatttttaatagctgaaaatctctgataatgaattagagtgtgtagtaaacatgagaattagttatattatcttatttttaaaattcaagactaagaacttcagagaatgaagagtctattaaaatgaggttcatcttaatgataggcaaaccaaactcatactgcttgacatgttttgaaaactggtaatattgagggtgtacagcacatgtacttaaaaatgacactggactatcttttgctctgagccatgccacttaccgaaattgtaaatacatttttcacaaatgcattgccaattattaccatccctcaaagcaataaattgtgacagttgctttaaatgtttgtcagcaactgttttcatttgttcagatattttgaatagctacactaataactgttattatttggtgaacataaaaaaataaatagatctgtatattgatggtagactctccatattgaaatgattattttccaaacattttcattttggtcaataattcaaactaccacttaggcaaagtattcgaacactgtgtcctttgtttaaggaaatataaaaaaaaaatcacctttctttttgtgcaaaaaaaatattatttcaatcacatttcagaaccgccagggcaagaaagtataaagcaggatcatgttaagaaaaaagaaaaaaagatcatgagtcacttaaatatgtatttttatttgtaacaaacaagtattaaactgtaaagtatttttgtacaaatttaatactttaatagcatggtatttatcgtctatgtatggttttggggaattcaaaattgttcaaatatttgtatggaaaaaaataaaaccctctaccaaatggaataaacagtgattttaaaaagccaaataaagaggatatgcatta

SEQ ID NO: 613 - DNA, 38377 bp, Homo sapiens
gaggacaatcagaggcgatgtggaaacttctgtcttgtaatcacaggagtgaaggtgtggcctgtatgctgcctagtcttgcctagaaattgctgcacctgctgttcttttgcttatgccttaacccttggttaccctaattccctattctcttgcctcattaggtctttaccctgactaaaaatgcactcatctagctgggacaaatcctacactgcatttgtcccatctagatgagtattctagcagagtacatggcacatgagtaggcattcaaaaattcaacatacagtacattttgttacctatgtgccaggtgtcgggcaggctgagttaacagctgaacagaaacctacctacccaacgtgctaacttctatacagcatggtcgtgcatccaaatcaaatggaaagcggtatgggagatctggaaaggcctcctgtgggtggcatctgactacctaaattcccatcccagtttcacttactgactttgacacttggaacaagcagcctctcagtgcctgttttcccactggcaggtaaatgggctaatgacggtatttctggcactagacttcgttaattaatgaaaagcacatagaagaaaacagcctggctctctaagtgggcagtgcgattcccaaggacggcacttcgcctgatagtcttcctctaggctgagaagccagagtaaatccatttgattttcctaccacacagtgccttctccccagatgagttcaaagctttaagtctatccagttctgtccagacgcgtctgttcatctccaacaggcccactagagaggcgggttttccaaagcctggcacggcccactgcaggtgacgccctctgccctccagcgccctcaggcctctggggtccacccttcctccccacccgactccggaacctcttcccgcgccctgcccgggcgcctggctgcttggggtagaggccttccgccacacgcgcggccccgccccggccttcacgtgacctggcgtgcggagcgcgcacgcgggaacccgcgctggaggcgggcgagggccgaggggcagctagggagcgcggcttgaggagggcggggccgccccgcaggcccgccagtgtcctcagctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcggtaaggagcctccggaaatgtgggacgcaaggctggggtgtcgcggcagtggctgaagcttcccttcgccgcatctctctgcagcaactcggtgagggctttccctccagcctggcggtgtggacgcggcctcggcttcctttcccacccagagcatccttcccttacctcccgctccacggggtgactgcggtccccggggtcagactgggcgccaggcctgcggtctctgtgaggcgcgctttgaacctctgctccctctttgttgggaactcgcaaagggaagcgggggaagggtattagatttcttgaggtgtaacttacattaaattcaccctttttaggtgtactcttctatgaggtttgacaaacattatgccttttgctatcaccatgatcgagatacagaacattttcatcaccttagaaagttcctacctgctcctttgtattcagccccctccacccttcctattccctggcacccactgatttgatttctatccctgcaagtgttgccttttccagaatgccatataaatggaatcataggctatatcgccttttgtgtctggcgtctttcatttagcataatgcttttgaaattcattcatgttacttgtgtctgtagtttgtttctttttattgctgagtagtattccattgcatggatgtaccatcgtttatccattttctagttgtggacctcagggttgtttacagttttttagctatattattagcgaagcattgttttagctatattattaacgaaactcgaaacattcgagtacaagcaaagaggtctttaatgatcttaatagcatggagttcctcaccccttactccacatccaagtaaacattggattatgattcaaagaccactaacgtttctgttaactcagatggggggcagactaggccatgcctgtcactttgcaagatacacaccaacgtccgattcttctgtatctccaaccacaggaaacctacccctgaaacttcctgttttgatagatttaaaaaaaaatttttttagctccaggttgggtgctggtcattcatgcatacagcaaattttttaaaattcttaccacattcaaagcactgtaccttcttgaaaaaggccaggcaagcagatgctttaagcattcaaatgaatagaaaaactgcattctcaaagaggacttcttatttcattgctccagaattaaagcaccagtagaaagaccatatgatataattagcaatgtaagttatttgagggtgcatgtttactagtatggaatctctgacagctgcttactgaataaagaagaccatatataaagacaggagaaagtggctgaacaaagccatctgaaaagtaaatttgaggcagggcatggaggctcatacttgtaatcccaggatttggggaggcttaggcaagaggatcacttgagtccaggagttccagatcagcctgggcaacatagtgagaactcatctccacaaaaaaattaaaaaattagttgcatgtgttggtgtgcctccagctactcaggaggctgaggcaggaggattgcttgagcccaaagatcaaggccacagtgagccatgatcacactactgcactctagcctgggtgacagagcaagactctgttaaaaacacagaaacaaaacagtaaagttgaatgaataacccctcggatcaataccacaatacattcatcccctttccctctctccaatccagttaggtagcatcatatttagaaatatttcctcaaagcatctttaatcttttcagcagctgaaataatttcctaatatatcatcccatctccagtttctcttaactacttctgcaacggtctttttgtatgcaaatgtcatgtgttatcccctgcttaaaattcttcactgattttgcctttacctacactgaaagtagttgtgaactgatagcctgcaattgcacaatattggcctgcacaggttgaaaaaaaattttactggccagtggctcaagcttgtaatcccagtgctttgggaggctgaggcaggaggattgcttgaggccaggagtttgagactagcatggcaacatagtgagaactagtctctaagaaaaataaaaataaaattaggccaggcacagtggatcacgcctgtagctccaactactcaggcggctgatgctgatgtgggaggatcacttgaatgtgggaggcagaagttgcagtgagctgagatggcaccactgcaccccagcctgggtgacagagtctcaaaaaaaaaaaaaaagccagttgtgttagcatgcacgtttagtcctagctactcaggaggctgaggtggagatctttgagacctatagtttgaggctgccgtgagctgtggttgtgccactgccctacagcctgggctacagagtgagaccctgtgtctaaagaaaaaaaaattaaatttgttgctaactcgaaaacgttttgagatttcccataaacaattagattcttggcttcttttgaaaaatctgaagatctgttaacaccgggcctgcatttctgtatgacaacaattggtgtttagatggagcatgttccttgccatttttcgtctccctgacactgagactttgttagttactgttcattattggtcttgcacttttgttcatgtctccttcaccttatttgccagatccaaataagctgtaaatgcacaaattgttaagctgtgcgtaaactattttgcaattcctctatttttcctagaatttgaactttacttggtcgttttagttttatatttatataacccatcttcttatgttctgtgttactcaaatgttcccttatgttagattgatggaggacttacctgcttctcatcttaatagtctgttcagaatgactttcagcattataatgcctgcttggcattaggaattctgttagtttccatgactttttaaagtattaacatcagtgtctttggttcttgttctcctttgccttcatagaaaattaatttattaattagcttattttctagctcccactttgccccaataagttaaggaactagatgtgttagtgtgattgggaactctagctgttattactctgcttgaactaaatgtaactgttattactcttagactttttaagtatgaccatatgaatttttctgcttgtaagcagtgtcagaagaaagttgaatgctgtagccttaagtgctttcagactctggtggatgcctaatttttttatttgttccttgggtgctatttctgaacatcatgttctcctttccctcttccatctagctcagtgaatgtggggtgttctttctatatgctttcacttccacttaacattcttctaaatgctgtacagtccctaagcttacactctccatactaaattttggtggccagtgtttttaccatgattaaatctcactgttatccagtttatcgttaaaagtttttctcctctcctctggatacagtttactttgtgtttttcttctaaactgtctacctgtgtcaccttctttactgcctcgctcctgttttttctctgtgtgtaattctttaaagttcttccaggtttttcttcttttctattgccctgtctaatgtcctagatttaaatatagttctgcaagtcaaaggtaagttctttctactccccatggatctaatttataaggaagaggaagctttgcttgtaagtatattgaagttatttatatgttcatctgtgtgtgtgtgcacgcacacacagggaaagagagagaacattatgctaaccagagatgtctaatacaaccacatttggtgacttcagatataaagggtgtggtggccattaggagtattacttctaggtcaagactgtccctactattaaatataatatattgttaaactaaacgtaataaaaaacaaatgtgcttaatgaaattgggcagggagccttttcattttcttctaaagaaatatgaagagaaagtttagaaagttgaatgttttgggctttttatgttgcttgctattgtaaatcttgcaaaagctaatgactacttgacatctttttttcctgacaacttttcttcctcaattttatctttcctcacaacagctgcagggaagtcaacatttgtgaatatccttaaacaattgtgtgaagattgggaagtggttcctgaacctgttgccagatggtgcaatgttcaaagtactcaagatgaatttgaggtatgaaaataaaatttaagtagataaaagcctcttggtttagaggagcagtagtacttaatctctttttctttttctttttcaataaaactttcaaatctcgctttaggtatatatcttcatctaggtggtggttacatggatatatatacagttggctctccatatcaatgggtttcagattgatatggattcaaccaatcatgaatagaaaatattcagaaagaaataatacaaaaaaatacaaataataaaggattactgttcatatagcatttacattgtattaagtattataagtaatctagagatgatttatactatttgggaggatatatgcagatactacaccattttacataaaggacttgagtatatgtggatgttggtatctgtgtggaacctggaatcaattcttgaggttactgaggggtgactatatgtttaaacatgcattgaggccggggttggtggctcacgcttgtaatcccagcactttgggaggctgaggcgggcggatcacttgaggtgaggagttcaagaccagcctcgttaacatggtgaaatgccgtctctactaaaaatacaaaacttagctgaacgtggtggtgggcacctgaattccacctgcttgtaaagccgaggtaggagaatttcttgaacccaggcagcggaggttgcagtgagctgagatggcgccactgtgctccagcctgggtgacagaatgagacactgtctcaacaaaaaaaaaaaaaggaaagtaaaatttatcaaactatgcattcaagatttatgcactttaagtaaagtataaaagttttctttttcataaaaatttctttttttgttgttatcctttaagttctgggatacatgtgcagaacgtgcaggtttgttatgtagatatacacatgccatggtggtttgctgcacccgtcaacccgtcatctacattaggtatttctcctaatgctaacccttcccttgcctcctaccccaccgacaggccctggtgtgtgatgttcccctccctgtgcccatgtgttctcattgttcaactcccacttacaagttagaacatgcggtgtttggtttcctgttcctgtgttagcttgctgagattgatggtttccagcttcatccatgtccctgcaaaggttatgaactcattcttttattatggctgcatagtattctttggtgtatatgtgccacattttgtttatccagtctatcattgatgggcatttgggttggttccaagtctttgctattgtgaatagcgctggagtaaacatacatatgcatgtgtctttatggtagaataatttataatcctttgggtatatacccagtaatgggatggctgggtcaaatggtatttctggttctagatccttgaggaatcgccacactatcttccacagtggttgaactaatttacactcccactaacagtgtaaaagcattcctatttctccacatcctctccagcatctgttgtttcctgactttttaatgatcaccattctaactggtgtgagatggtatctcattgtgggtttggtttgcatttctctaatgactggtgatgatgagctttttttcatgtttgttggctgcataaatgtcttcttttgaaaagtgtctgttcatatcatttgcccactttctgattgggttgtttgtttttttttcttgtaaatttgtttaagttccttgtagattttggatattagccctttgtctgatgggtagattgcaaaaattttctcccattttgtaggttgcctgtttacttggatgatagtttcttttactgtgcagaagctccttagtttaattagatcccatttgtcagttttggcttttgttaacactgcttttggtgttttagtcatgaagtctttgctcatgcctatgtcctgaatggtattgcctatgttttcttcagagtttttatgattttaggtcttatgtttaaatctttaatccatcttgaattaatttttgtataaggtgtaaggaaggggtccagtttccgttttctgcatatggctagccagttttcccagcaccatttattaaatagggaatcctttccccattgcttgtttttgtcaggtttgtcaaagatcagatggttgtagacgtgtggtattatttctgagggctctgttctgttccattggtctatagctctgttttggtacaataccatgccgttttggttactgtagccttgtagtatagtttgaagtcaggtagcatgaggcctcaagccttgttctttttgcttaggattgtcttggctatacgggctcttttttggttccatatgaaatttaaggtagttttttctaattctgtgaagaaagtcaatggtagcttgatgggaatagcattgaatctgtaaattactttgggcagtatggccattttcacaatattgatttttcctatctatgagcatggaatgttttaccatttgtttgtgtcctctcttctttccttgagcagtggtttgtagttctccttgaagaggtccttcacatccgttgtaagttgtattcctaggtattttattctctttgtagcaattgtgaatgggaattcactcatgatttggttctctgtctgttagtggtgtataggaatgcttgtgatttttgcccattgattttgtatcctgagactttactgaagttgcttgtcaccataagggattatgggctgagatgatggggttttctaaatatacagtcatcatctgcaaacagagataatttgacttcccctcttcctatctgaatcccctttatttctttctcttgcctgattgccctggccagaccttccaatactatgttgaataggagaggtgagagagggcatccttatcctgtgccgatttttgaagggaatggtatcggctgtgggtttgtcataaatagctcttattttgagatacatttcatcaatacctagtttattgagagtttttagcatgaagggatgttgaattttattgaaggccttttttgcatctattgagataatcatgcggtttttgtcattggttctgtttatgtgatagattatgttttattgatttgagtatgttgaaccagccctgcatcccagggatgaagccgacttgatcgtggtagatgagctttttaatgtgctactggattcggtttgccagtattttattgaggattttcgcatcgatgttcatcagggatattggcctgacattttcttttttttgttgtgtctctgccaggtttttgtattagggtgatgctggcctcaaaaaatgagttagggaggagtccctctttttctattgtttggaagtttcagaaggaatagtaccagttcctctttctacctgtggtagaattcagctgtgaatccatctggtcctgggcttttttttggttggtaggatattattgcctcaatttcagaactttttattggtctgttcattaaaccagagttcttcctggtttaatcttgggagggcgtatgtgtccaggagtttatccatttcttccagattttctagtttatttgcgtggaggtgtttatagtgttctctgatggtagtttgtatttctgtgggatcagtggtgatcctttattgtgtctatttgattcttcccgcttttcttctttattattctggctagtggtctatctattttgttaatcttttcgaagaaccagcttctggattcattgattttttgaagagtttttcgtgtctctatctccttcagttctgctctgatcttagttatttcttgtgttctgctagcttttgaatttgtttgctcttgcttctctagttcttttaattgtgatgttagggtgtcgattttagatctttcctgctttctcatgtgggcacttagtgctataaatttccctctaaacactactttagctgtgtcccagagattgtggtacgttatgtctttgttctcattggttgcaaagaacttatttatttctgccctaatttcgttatttacccggtagtcattcaggagttgttcagtttccatgtagttgtgcagttttgagtgagtttcttaatcctgagttctaatttgattgcactgtggtctgacagactgttatgatttccattcttttgcatttgctgaggaatgttttacttccaattatgtggtcaattttagagtaagtgcactgtggtactgagaataatgtatattctgttgatttggggtggagagttctctagatgtctttcaggtctgcttggtccagagctgagttcaagtcctgaatatccttgttaattttctgtcttgttgatctaatattgacagtggggtgttaaagtctcccactgttattatgtgggagtctaggtctctttgtgggtttctaagaacttgcattttgaatctgggtgctcctgtattgggtgcatatctatttaggatagttagctcttgttgttgcattgaaccctttaccattatgtaatgccctttgtctttttttcatgcttattgatttaaagtctgttttatctgagactaggattgcaacccctgccttttttttgctttccatttgcttggtaaatcttcctccatccctttattttgagcctttgtgtgtctttgcatgtgagatgcgactcctgaataccgcacactgatgggtcttaactctgtctaatttgccactctgtgtctttcaactggggcatttagcccatttacatttaaggttaatattgttatgtgtgaatttgatcctgttattatgatgctagctggttattttgcctgttagttgatgcagtttcttcatagtgtcgatggtctttacattttggtatgtttttgcagtggctggtaccggtttttcctttccatatttaatgcttccttcaggagctcttgtaaggcaggccttgtggtgataaaatccctctacatttgcctgtctgtaaaggattttatttctccttcacttatgaagcttagtttgactggttatgaaattctgggttgaaaattcttttctttaagaatgttgaatgttagtccccactctcttctggcttgtagggtttctgccgagagatctgctgttagtctgatgggcttccctttgtgggtaacccgacctttctctctggctgcgcttaacattttttccctcattttaaccttggtgaatctgacgattatgtgtcttggcgttgctcttctcaagggcatctttgtgatgttttctgtatttcctggatttgaatgttggcctgtcttgctaggttggggaagttctcctggataataatcctgaaatgtgttttccaacttggttccattcgtcagtttcaggtataccagtcaaacgtaggtttggtcttttcacatagtcccatatttcttgggaggctttgtttgttccttttcattctgttttctctaatcttatcttcacgctttatttttattaagtttttcttcaatctctgatatcctttcttccacttaatcgattcggctattgatacttgtgtatgcttcaccaagttctcatgctgtgtttttcagctccatcaggtcatttatgttcttctgtaaactggttattctagttagcagttcctgtaaccgtttatcaaggttcttagttccttgcattgggttagaacgtgctgctttagctcagtggagtttgttattaacccaccttctgaggcctacttctgtcaattcgtcacacttattctccatccagctttgttctcttgctggcgaggagttgtggtcctttggaggagaaaagacattctggtttttggaatttttagcttttttgcactggcttttcttcatctttgtggatttatctacctttggtctttgatgttggtgaacttcagatggggtttttgcgtggttgtcctttttgttgatgttgatgctattgctttttgtttgttagtttccttctaacagtcaggcccctctgctgcaagtctgctggagtttgctggaggtccactgcagatcctgtttgcctgggtatcaccagcggaggctgcagaacagcaaagattgctgcctgctccttcctcaggaagctttgtcccagaggggcacctgccagaggctagccagagctctcttatatgaggtgtctgccgacccctgctgggagctgtgtcctagtcaggaggcatgggggtcatggacccacttgaggatgctgcctgtcctttagcagagcttgagcgctgcgctgggagttccactgctctcttcagagccagcaggcaggattgtttaagtctgctgaggctgcactcacagccacgccttcccccagatgctctgtcccagggagatgggagtttgatctgtaagtccctgacgggggctgctgcctttctttcagagatgccctgcccagagaggaggaatctagagaggcagtctagcttcaggggtttgccaagctgtggtgggctctgcccagcttgaacttccaggtggttttgtttacactgtgaggggaaaaccacctactgaagtctcagtaatggcgggcacccctccccccaccaagcttcagtgtctcaggttgacttcagactgctgtgctggcagtgagaatttcaagccagtggatcttagcttgctgggctccgtgggggtgggatctgctgagcaagaccacttggctccctggcttcagcccccttggctccctggcttcagccccctttctaggggagtgaacggttctgtctcgctggcattccaggcaccactggggtatgaaaaaaaactcctgcagctaactccgtgtctgcccaaatggctgtccagttttgtgcttgaaacccagggcccttgtgtaggcacccgagggaatctcctggtctgcgggttgtgaagactgtgggaaaaagcctagtatctgggctggatagcaccatccctcaaggcttcccttggctaggggagggagttcccccacccctttcaccttccaggtgaggcgatgccccaccctgcttctgcttggcctctgtgggctgcacccactgtataaccagtcccaatgagatgaattgggtacttcagtcggaaatgcagaaatcacccgtcttctgcattggtctcactgggagctgcagaccagagctgttcctatttggccatcttgcctgggaatctaaaagtttttaaaaagttaaataataaaagttttaaaaaatctaacagcaaattaaattccttcattgtcttttctaatttttttttttttttgagatggagtttcgcttttgttgcccaggctggagtgcaatggctcgatcttggctcaccacaacctccgcctcccgggttcaagcgattctcctgcctcagcctcccaagtagctgggattacaagcatgggccaccatgcctggctaattttttttactagagatggggtttctccatgttggtcaggctgggcccaaactcctgacctcaggtgatccgcctgcctcagcctcccaaaatgtttggattacaggcctgagccactatgcccaacccttcagtgtcttttcacattttgtttaaaaacaagcaaataaggccgggtgcggtggctcacacctgtaatcccagccctttgggaggccgaggcaggtggatcgcctgaggtcaggagttcgagaccagcctggccaacatggtgaaaccctgtctccactaaacatacaaaaattagctgggcgtggtggtgggcgcctgtaatcccagctactcaggaggctgaggcgggagaattgcttgaacccgggaggtggaggttgcagtgagccgagatcgcgccattgcactccatctcaaaaaaaaaaaaaacagaaaaaacaaaaacaccaaaaaaaaaaaaaaaaaagcaaataagaaaaagaaaaactactattcagtaactgaattttacctttcaagccttttgtcatttactctcatttctttttactttcattcttgccagactttcactctgggcagaagttgtaattttgcagcattttaccgttctgcactgcaaatgaggaagaaagagaatgacagagttcagtgtcatttttttaaataccaaaatgtatggttgtatgtgtgagagagacgttgctaagattttcgtttctggagaaatgagaattgaaattgaaagcaaggccaggtgtggtggtttatgcatgtaatcctggaatttttttttttttaagtgacagcaagtttattaggaaagtaaagcaataaagaatggctactccataggcagagcagccaatcccagcacttcgggaggctgaggccagaggatcgcttgagcccaggagttcaagaccagcctgggcaacatagggtgaccccgtctctacaaaaaatttaaaaattagctaggtgtggtagcctgcacttggggttacagctacttggaaggctgaggttggaggactgcttgagcccaagaaattgagactgtagtgagccatgctcatgccactgtactctagcctgagtgacagcaagaccctgtctaaaagaaaaaaagaaattgaaagcagtaaggcagaaaccttaaaaatggaaatgtatgctaacaacttactttgatctgaggagtacagaaaattgaaaaaaaagtatctaaaaaaatttagctgttggtataaggaattctgggaataataattgaatatttaaaatgtaaatcacatatgcaaagaggaatcactagcaagatattccatggactttgagaatatatggttttgaataaccaaaaatactttttcatacaccttctatttgccaggcatagctaactttagacctagggcctaattcagtacaccccaatccttaggatatccaggactaaatcttaaaggggctttcttcccatatagacctcattatcttaagaaattgatgttttatatctgatttttggggaaaggcaaggttagtctacagtagaattttaaagtgggtaaatttgtttatttgattctttttaaaaacatttttgacatgatatatctgtagaaaagtaggtaaaagctaatgtacagtttgaagaacagttttaaagttgacatctttataaccattatccaggtcaagaaatacgacatcatcattccagaaatccctgttcgccttctccaatcactatatcttctttcctacgttactactccgctaggggtaattactcccattcttttgtgataataattttcctgcttcctaaaaattgtttgagcatacatgaacatacctctaagtataatttagttttgtctatttttgaatgttatataagtggaattacattgtttgccttttttcctctcgcttcttttacttaatacatttatgaaatttgtccatattatatgcagctgtagcttattttcagctatatagtattgaattttgttttttaaaaatattcttttttttgagacaggatttcactctgttgcccaggtaaagtgcagtggcgcagccatggttcactgcagcctcaacctcccttggctcaggtgatcctctctcctcagcctcctgagtatctaggaccataggccaccacgcctgtgtgccaccaggcttggctaatttttgtattttttatagagacggggttttgccatgttacccaggctggtttcaaactcctgggctcaagcgatctgcccatctcagcctcccagagtgttgggattacaggcttgagccactatgtggggcctatagtatttaattttattcgtctatcactgtttgtccattttatacctttaattgatttttgagtgatttccaatttagttgcttatgtaaacagcattgctgtgaacataaattcacccgcatacatgcaaaagtttctgtaggaataagaagtaaaattactgggaatgcttatgatgcctgttttccaaactggctttccaattttctctccccccagtgtaatcaagctctcattaatctatgtctttgccagcatttagtagtgtctggctttctcatttttgtcattctgctgagtgtttactatttttttgtttaatttgtatttccccgctggctaatgaggctgtgttccttttcatatgtttattagtcattttgatttttgcaaagtgcccacttgggtccttttgcccattttcctctgagccatctgtcttctctcactgcatttttaatgtagcttttcgctgaagtacctactcaagtttgcttagcttttgaaggagagactggagttctaaaagcaactctttttccttttatttctggggtcagctgtcagtgcagttatcctcaggtagtagacagaaactaaccagattaaaccaatgttggaaaatagagggtattcttaaacagggtattggactaggtgacctccatttaaggtccgttgacatatttgtcatttgactctcagcatgcctcacattaaccaagggcacagaaactgacatataaaaccaaaatgccaaaaattttaatttgcagaaagaaatgtaatcattaaggtaattgaatttagatcagtttattctttatttggttcgtaattctcaaccagtggaaggaagtcataagaatgtctgagagctaaacagtttgaacacatggagatagagtgtggaaaaatagataacaataactgggaagggtaggaggaggggaagatgaagaggagtgagttaaagtgtacagatatacaggaagcttgaagaaataattcagtgttttatagcaaggtagaatggaaaaatacattgtactcaggtgatggacaccctgaatgattcgattactgcatattatatacatgtacaaaatttctcatgtattccataatttgtacacacaagaaagaatctcaaggattcgggtgctttttaaaataacaatcccttggaggttcaaatatgtgggatgcctcatagttaaaagtcatcaccctagtgaatcactgttaactgttgggagtatactgaactctttagttaggttgcagagaagttgaaaaacattgctttcgtatataagacaagacaatttataataaggttgtctgttgagcttggaatcagagcccagagggattagttaaatcatgttaatcagactgtgtcatcagactgtgatgcattaatacatttgtcttcattttaagacttaatggctttctgaatctgatatccatgtttatgggatgggacattttctttccatatacttgattcagaatgccaaactggccattctttataactagcatgcaggtgatcctattattattaacatattcttttatcaggccgtttattgtaatctggtcatgtcttcatgatgttacaatttgattacctttgttagagtttggtgcacattcttggaaggtagcttcagcttttttgtgtgtattggggactgctccgttgttaattctctgtacttctgtacagagggggtagtatttttgagatatagttgtggaatatgaggatggttgggtgggtggcttccctgtatctttggatattttcttccactaaactcaagaagtgagattttatttcttcatccagtagtccttcttccccagactcatccttgatctattccttgaggttatagtatgaatcacccactattcaaatgtcaatttttcttagaatgctgttagtgatgagaagtgactgttttcagacctaaccttggcaaggtcagtcctactttgatgttcttgtttcatcacacttcttggcatttgtagatttggaagaattgggcctttggtacctctgatctcttcgtttagcaacttactgtgcacccatatgcttagcttttgctgttttagctttttttttttttttttaacctgccacctagtggccgaaatgttgctatactattgataaggtactcctaattttggcaaaatagtaagaggcaaagcaccaaagattatgttctctcccttctccaaatctctcttggtgagaatgatctttaaaacataccactcagattattagcaatcttggtatggaacgtttttaaaaataataataatgtactttatgtggtgatttatgttattatttaggcccaaagttttgatttaattgtttccttttagcttatttttgagatatgcagtctgttaggaagctgtctctgtcttgttttttcattgagctgaattcttttggaggatcactattattgtgaagtactattttacttttaattaaaaaaattaagatatttttatttttaatttacagataaaaattatatttaattttatattatatttatatataaatcatatgtaatgtaaattatatacataagttatatataatataaaaattatatacataatataaattatatataatataaaaattatatttatggtatgcaacatgatgttttaaaatatgtctacattgtggaatggttaaaccaagctaattaacatacgcattacccgtactattttacttttatccaatacttcttaccactaataagccactgaaaaactagtaattgtgataaagaaggtgtaaaccatacttatttatgacagaacagcatattttttacttttaataagtcattctttttttttttttttgagacggagtctcgttctgtcgctcaggctgaagtgcagtggtgtgatgttggctcactgcaacctctgcctcccaggttcaagcgattttcctgccttagccttccaagtagctggagctgggattacaggcatgtgccaccacgcctggctaatttttgtaattttagtagagatggggtttcaccatgttggccaggctggtcttgaactcctgacctcaagtgatccacccatctcagcctcccaaagggctgggattacaggtgtgaggtctcttttttttttttttttttttttttaagacggagtcttgctctgtcccttagtaagtcattcttgaaaattagttaagaatgcttgataaagcacttccacttgtaccttttgaatagatgtgataacttttgttggcttgtatttttttgagtcttgctttattgcccaggctggagtgcaatggtgaacctcagcccactgcagcctccgcctcctgggctcaagtgatcctcccacctcagcctcctcagtagctgggactacaggcccacaccaacatgcccggctaatttttgtattttttatagcgataggattttgccaatgttgtctggatttgtctcaaactcctgggatcaagcaatccgcctgcctcggcctcccaaagtgctagaattaggcatatgagtcaccatgcctggcctgttggctattttataattatcttgtttggtagactctgatcttttacagttgaacttaattcaactcttttgcaatgtttacaaagattagacctagaattaaaagataaatgattttatagctgaccttgatatttctatttttcacttaccttgacaataatctgtacttcctataacaatgaagtattctttcataaagtgaaaatggacatatattatagagaacagaataaatgttattcataatcctaccactctgtatgtatcttttacatagttgaattaataatgtaatatattaaattttggtggaggtgatatgtaatttaaaaaatattataaagtaatacctgtttactgtttgaagttaaggaaatattagaaattatcaaaagaggggactaaaacttacctataaccttattatccagagataaccatagatcttacttgaaagaacagtatacagttttgtattttgtttcttccccaccccccacaatatttatatgtcaagagtctgagatccaactgcaaggcggcagtgaggctgggggaggggcgcccaccattgctgaggcttgggtaggtaaacaaagtgggctggaagctggaactgggtggagcccaccgctgctcaaggaggcctgcctgcctctgtagactccacctctgggggcagggcatagctgaacaaaaggcagtagaaacctctacggacttaaatgtccctgtctgacagctttgaagagagtagtggttctctcagcacggagtttgagatctgagaacggacagactgcctctgcaagtgggtccctgacccccgaatagcctaactgagaggcaccccccagtagggggagactgacacctcatacggctgggtacccctctgagacgaagcttccagaggaacgatcaggcagcaacaattgctgttcagcagtattcgctgttctgcagcctccgctgctgatacccaggcaaacagggtctggagtggacctccagcaaactccaacagaccagcagctgagggtcctggctgttagaaggaaaactaacaaacagaaaggacatccacaccaaaaccccatctgtacgtcaccatcatcaaagaccaaaggtagataaaaccacaaagatagggaaaaacagagcagaaaagctgaaaattctaaaaatcagagcgcctctcacctccaaaggaacacagctcctcgccagcaacggaacaaagctggacggagaatgactttgacgaattgagagaagaaggcttcagataatcaaacttctccgagctaaaggaggaagttcgaacccatggcaaagaagctaaaaaccttgaaaaaagacgaatggctaactagaataaccagtgtagagaagtccttaagtgacctgatggagctgaaaaccatggcacgagaactacatgacgaatgcacaagcttcagtagccgattcaatcaactggaagaaagggtatcagtgattgaagatcaaatgaatgaaatgaagtgagaagagaagtttagagaaaaaagagtaaaaagaaatgaacaaaacctccaagaaatatgggactatgtgaaaagaccaaatctgcgtctgattggtgtacctgaaagtgatggggagaatggaaccaagttggaaaacacacttcaggatattatccaggagaacttccccaatctagcaaggcaggccaacattcaaattcaggaaatacagagaacaccacaaagatactcctcgagaagagcaactccaagacacataattgtcagattcaccaaagttgaaatgaagggaaaaatgttaatggcagccagagagaaaggtcgggttacccacaaagggaagcccatcagactaacagtggatctcgcggcagaaacgctacaagccaggagagagtgggggccaatattcaacattcttaaagaaacgaatttgcaacccagaatatcatatccagccaaactaaacttcataagtgaaggagaaataaaatcctttacagacaagcaaatgctgagagattttatcaccaccaggcctgccctacaagagctccggaaggaagcactaaacatagaaaggaacaagcggtaccagccactgcaaaaacatgccaaattgtaaagaccatcgaggctaggaggaaactgcatcaactaatgagcaaaataaccagctaacatcataatgacaggatcaaattcacacataacaatattaaccttaaatgtaaatgggctaaatactccaattgaaagacacagactggaaaattggataattggataaagactcaagacccatcagtgtgctgtattcaggagacccatctcatgtgcagagacatacataggctcaaaataaagggatgtatgaagatctaccaagcaaatggaaaacaaaaaaaaggcaggtgttgtaatcctagtctctgataaaacagtctttaaaccaacaaagatcaaaagagacaaagaaggccattacataatggtaaagggatcaatacaacaacaagagctaactatcctaaatatatatgcacccaatacaggagcacccagattcataaagcaagtccttagagacctacaaagagacttagactcccacacaataataatgggagactttaacaccccactgtcgacattagacagatgaacgagacagaaagttaacaaggatatccaggaattgagctcagctctgtaccaagcggacctaaaagacatctacagaactctccaccccaaatcaacagaatatacattcttctcagcaccacatcgcacttattccaaaattgaccacatagttggaagtaaagcactcttcagaaaatgtaaaagaacagaaattataaaaaactgtctctcagaccacagtgcaatcgaacctagaactcaggattaagaaacttactcaaaaccgctcaactacatggaagctgaataacctgctcctgaatgactactgggtacataacgaaatgaaggcagaaataaagatgttctttgaaaccaatgagaacaaagacacaacataccagaatctctgggacacatttaaagcagtgtgtagagggaaatttatagcactaaatgcccacaagataaagcaggagagatctaaaattgacaccctaacatcacaattaaaagaactagagaagcaagagtaaacacattccaaagctagcagaaggcaagaaataactaagatcagagcagaacggaaggaaatagagacacaaaaaacccttcaaaaaatcaatgaatccaggagctggttttttgaaaagatcaacaaaattgatagaccgctagcaagactaataaagaagaaaacagagaagaatcaaatagactcaataaaaaatgacaaagggagtatcaccactgatcccacagaaatacaaactaccatcacagaatactataaacacctctacaaacacctctacgcaaataaactagaaaatctagaagaaatggataaattcctggacacatacactgtcacaagactaaaccaggaagaagttgaatccctgattaaacccataacaagctctggaattgaggcaatagttaagagcctgccatccaaaaaaagtccaggaccagatggattcacagccgaattctaccagcagtacaaggaggagctggtaccattccttctgaaactattccaatcaatagaaaaagagggaatcctccctaactcattttatgaggccagtatcattctgataccaaagcctggcagagacacaacaaaaaaagagaattttagaccaatatccctgatgaacatcgatgcaaaaatcctcagtagaatactggcaaactgaatccagcagcacatcaaaaagcttatccaccatgatcaattgtgcttcatccctgggatgcaaggctggttcagcatacgcaaatcaataaacataatccagcatataaacagaaccaaagacaaaaaccacatgattatctcaatagatgcagaaaaggcctttgacaaaactcaacaacccttatgctaaaaactctcaataaattaggtattggtgggatgtatctcaaaataataggagctatttatgacaaacccacagccaatatcacactgaatgggcaaaaactggaaacattccctttgaaaactggcacaagacacggatgccctctctcaccactcctattcaacatagtgttggaagttctggccagggtaatcaggtagtagaaggaaataaagggtattcaattaggaaaagaggaagtcaaattgtccctgtttgcagatgacatgattgtatatttagaaaaccccatcgtctcagcccaaaatctccttaagctgataagcaacttcagcaaagtttcaggatacaaagtcaatgtgcaaaaatcacaagcattcttatacaccaataacagacaaacagagagccaaatcatgagtgaactcccattcacagttgcttcaaagagaataaaatacctaggaatccaacttacaagggatgtgaaggacctcttcaaggagaactacaaaccactgctcaatgaaacaaaagaggacacaaacaaatggaagaacatttcatgctcgtggataggaagaatcaatatcgtgaaaatggccatactgcccaaggtaatttatagattcaatgccatccccatcaagctaccaatgactttcttcacagaattggaaaaaactactttaaagttcataaggaaccaaaaaagagcccgcattgccaggtaaatcctaagccaaaagaacaaagctggaggcatcacgctacctgacttcaaactatactacaaggctacagtaaccaaaacagcatggtactggtaccaaaacagagatatagaccaatggaacagaccagagccctcagaaataataccacacatctacaaccatctgatctttgacaaacctgagaaaaacaagaaatggggaaaggattccctatttaataaacggtgctggaaaaatggctagccatatgtagaaagctgaaactggatcccttccttacaccttatacaaaaattaattcaagatggattaaagacttaaatgttagacctaaaaccataaaaaccctagaagaaaacctaggcaatactatttgggacataggcatgggcaaggacttcatgtctaaaacaccaaaagcaatggcaacaaaagccaacattgacaaatgggatctaattaaactcaagagcttctgcacagcaaaagaaactaccatcagagtgaacaggcaacctacagaatgggagaaaatttttgcaatctactcatctgacaaagggctaatatctagaatctacaatgaactcaaacaaatttacaagaaaaaaacaaccccatcaaaaagtgggcaaaggatatgaacagacacttttcaaaagaagacatttatgcagccaacagacacatgaaaaaatgctcatcatcactggccatcagagaaatgcaaatcaaaaccacaatgagataccctctcacaccagttagaatggtgatcattaaaaagtcaggagacaacaggtgctgcagaggatgtggagaaatgggaacacttttccactgttggtgggactgtaaactagttcaaccatgtgtaagacagtgtggtgattcctcaaggatctagaactagaaataccatttgacccagccatcccattagtgggtatatacccaaaggattataaatcatgctgctatacagacacatgcacacatatgtttattgcggcactgttcacaatagcaaagacttggaaccaacccagatgtccatcagtaatagactggattaagaaaatgtggcacatatacaccatggaatactatgcagccataaaaaaggatgagttaatgtcctttgtagggacatagatgaagctggaaaccatcattctcagcaaactgtcgcagggaaaaaaaacaaaacactgcatgttctcactcataggtgggaattgaacaatgagaactcttggacacaggaatgtgaacatcacacactggggcctgttgtggggtggggggaggggggagggatagcattaggagaaatacctaatgtaaatggcgagttaatgggtgcagtacaccaacatggcacatgtatacatatgtaacaaacctgcacgttgtgcacatgtacccaagaacttaaagtataaaaaaaaaatttatatatcagggcaattaaaatcgttgttaaaaatttactgtaaatgatttttaacagcagcctaatttattgtatgcatgtactattatttacttaatataaatgcctaataatagtggaatgataacctattcgcttagccttgtgataaatacctttgtggttaaatttgtattctagattatttcttttttttttttttttttgagacggagtctcgctctgtctcccaggctggagtgcagtggcgccatctcaacttgctgcaagctccgcctcccaggttcacatcattcttgtgcctcagcctcccgagtagctgagactacaggcgcctgccaccatgccccgctattttttttggtatttttagtagagacagggtttcaccgtgttagccaggatggtctcgatctcctgaccttgtgatccacccgccttggcctcccaaagtgctaggatcacaggcgtgagccactgcgcccggcctagattatttctttaaagtaaattttcaacagtggaattaattgggccaaaaggtacaggttttttttttcccacaaatgtagctaaactgctttctatctaaccatgttctaccaatttgtatttaatgtagtttcactctgacacattcatattttttatctggatagtttgcagaggggagaacttgataaaattaacattcagtttggtaaagatgatgcacagtattttttagattttttttttttttttttttttgagacaagagtcttgctctgttacccaggctggagtgcagtggcacaatcttggctcactgcagcctccacctcccaggcataagcaattctcccacctcaacctccggagtagctgggattacaggtgcacgccaccatacctggctaatttttgtattttttgtagagacagggtttcgccatgttgcccaggctggtctggaactcctgagcttaagtgatccgcctgcctcggactcccaaagtgctgggattacaggcctgagctgcctcacctggctggataaatttttaatattcttaacatttataattgcatacaaaaaaccctagcaatttgtctcaaatttcatgcataggatcaaaagaaaatgttttatatgactcataagttatcctgaggaaccagataatgataccctggcttactgttaattttctaatttgttacactattaaactaagagacaataacatcttcatagctgaaaattctatttcagatttttgattcagtttgaatttacatatttgtatttttagaactagtttattatttttttgttaggtgatgaatcaagattggttctctaagttattttaatatagtaaactttgaaattgctttgggcaagagagattatatttattgagaaattaaaataaaaggaggtatgtggtcttttttagttaatttttttgttgtggcaaaaatataaaatttatcatctgaaccatttttaagtatacagctcagtagtattataagcatatttaggtcattatgaacagatctccagaactttagcctcctgaaaagatccagagacccctggagcttctcctactatactttgaagaacctctatcttagagaatatattacttcatctggaaaagacagactcacagagaactctagaaatatagtcttttaaaacatatcatctaaaagattaataattctttttatcatcttatccggtctgtgttcatatttccccattgtctaataatgttttcgtaattttttgaaattaggagccaaaccaggttcacacacgttacatttggtggttgatataccttttatttttttttaaatttatttttctgagatgaagtcttgctctgtcacccaggctgaagtacagtgcatgatctcagctcacggcaacttctgcctccccagttcaagtgattctcctgtctcagcctcccgagtagctaggattacaggcgcgtgccaccacgcctggctaattttttatatttttggtagagacagggtttcaccatgttggccaagctggtcttgaactcctgatctcaggtgatctgcctgcctcggcctcccaaagtgttgggattacaggcgtgaaccactgggcctgcccttgatatgccttttaaattttaatctattgattgtctctttgtttataatttatttgttgaagaaacagggtcatttgttctacataattttcctcattctggttttggctgagtgtatctctggtaaaatttaacatgtttttcagttctctgtatttccagtaaatttataggtagagacaggcttgattagatttactttcaattcttttttggcaagattcctagttggtgatgtgtatttctttacatcaagaagatgtgttttgtgatgttaaaatcaaacagtttagctgttgtcagattgattcatccgttgtaaaattcccaattaacttttctctaatgatagcatctattgctaattgttgcctcattgcagtatattagtaggtgttgtaaaaggtgatattccttctccagccttctgaatttattggctgggattcttcaggaaagaagacctcttcctcatataccactttattaccctgaaagtatttatacaggaaaggccaaaataaaatgggactttttttttctttttacctacatattcccagaataattaatttgtgccttaggagcctcaaaacatgactagagttttgtttgtttgtttagaattataaactcatggatttttgcctcccattcattttcgatgttcaaattattctttctttgaccagtggcagcttatttatgttggctcctttgtccttggcacaatcccagtggtctgtagtagtttcctaaaatatacaagatgaagctcatcttgtatattttcttccccagatttagaatcagaattctaattcctttcagtgggaaatggtatttagagattataatctgggtgatatttttgtatattcctacaatgttgtcattgtttataggccttttgatggacagaactaggaaaactttatagaaagagaaaaataattcatgtgttccagatgctatttcttttttttttttttttttttgagacggagtctcgctctgtcgcccaggctggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgctatttctaactcagataaaagatgataagagtttttacttcattttaaaatttacatttgtatttttcctcaacatgtaaaatgtggttctaacaataagattattgaattgcaaaatctggggcaggaactattgtattatattagaagattggagggttacaaatacaaatgcctaaaggggccagacagccaaatgaatatatcaggcctgttatgaaaatcatccgggaatggtggggattaataagccagagagcatatatcccatctaaaggaggcatctgtgacttgattctagctgatttttgccaagagggaatatgggcatggtactgcttggttttttcatttttaaaaagaagacgtaatccctgcactttgggaggccaaggcaggcagatcatgaggtcaggagatggagaccatcctggctaacacggtgaaaccccgtctctactaaaaatgtaaaaaattagttgggcatggtggcacgcgcctgtagtcccagctacttgggaggctgaggcgggagaattgcttgaacctggtaggtggaggttgcagtgagctgaaatcgtgccactgcactccagctggggcaacagagcaagactccatctcaaaaaagaaaaaaaagaagatgtaaatccaaatattttatgtgaaattatttagcttttaaatattgacaatactattgacaaactaagtcaaagttttaaaaaggacttttggaccaaacaatgatttcttccataggttattagtttgtaacctcttgtgagaaagatctaaggattttccagacctcagacaatctgaaaaatatattgggaaagagtatgagaaagggaacttaatcatcttggttttgctgatcatgattacatttatttatctgacttttattttttagccttaaaaattaaaatagccctattgaccattaattttgctttttatttctttttgcacattcaaaataggaacttacaatgtctcagaaaaatggtgggaatgttcttcagatgatgtatgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatgtataaatggcttgtacgtggccatttgaagtttttatcttagaactggactttttttttttttttaatgtttcctgggaattagtaataatgaatggctgagctggggatttaagatggaaaatgacatttaaatccctcagcagtctggtactaatggcattagggaagttattgcatttataatcctcagcttccatagaaactgttgggaatatggtggtgcccatttcatttaaatttgcagagaagttgtttttccctctaacccttttaaaattctcatctgctctggttaaatctggatctatatcctagactcttacctggatcaagaagataaaagtctctaaggggccttagaattgccctacttatgctaggattcttttgacctccaaagttagctcagaacagaggttctcaaacatttgatctcagggcccttttcaattcttaataactatcgaggtgtccaaagagcatgtcctattgatacttaacattactagaaattaagatgcacaaaaatgatttaaaattagcaataataaattcattacatattaatataaatacatttgacaaaaagttatattttctaaaataaaaagtagctagaagaatatcattgctttacatttttgcagatatctttaatgcctcacttattaaaagacagctggatttttatttatgcttctgtatttaatctgttatggtatgtttgtttgtttgaagtatattggtatatgaagtaatctggcctctcacagaaccccttagaagatcttggggacttaatggggtcctcactccgtattttgagaaccattggccaaaaacatgatggaaagactcttgtctttttctgctttccacggcactatgtgccactggatttaggagaatgtttcatgttcctgttctcttttttatttctttgttgtttttttttgaaatgatacatgtgttgatgaagactctcttttaggtatatttttgcatctaatttgtatgaatctgaatgcatgaatgagacagagtggacaatttatcaagactggcatgactggatgaataaccaatttggccaaagccttgaattggatggaatcatttatcttcaagccactccagaggtaaaacccaataaaaatgtgtttcactgaaaatttaaagaaatatttagaactcttttcagtggtatataatgagggcaatttagtttaactccagcctcccaacctcccactccccacctctaaattagaaacttgtaactgtgtagatagaagcattcttttttctcagcaaactggaatcccagactgggcaagttgctgttttaggctctttgtgcttcctcaattcttttttattttactcattatttctttctaacatttgcagactcttctcattcatcacagttaaagtaatgaatgtggtcaagcaactcctagaatataggcttcatgaggtgggaccttgggcattttgattactattgaatttccattgcctagaacacccagtgctgggcactgttggagcatatagtaggagctcagtaaatatttactgaatgaatggcaatgttgatggaggtccatatcaagaaatattttattatggttgtttgtgccttggaatgagtggataatggcagctatcgttgggaaaagacttagaggacccttgccattttccattaagggagctcacttgaaaaggtgctttttgtgataggttgtaacatagctattctagttacatatgatgttatataatgaatacaggatgaccaaatagatgcctttcataaaactaacctaaatattaagatcttacatttaatcagaagctttctggttttggtgcgtgcatttctattgtttctgttttttaattctcattttttccttaagtcacagggtaggcactgatgaatgtaaatgttatgacttctggcctaaaattagaatactgtgttgctgtcgaagctgggttttcaaagaaattaggtttcctattccaacggatgattttgttcttcattaagtaaagattttgttcttcattaagcaaggatttagcaattttttagcaatttcaaaagtgaattttgaaattcacttttatttttgaatttttttgtttttaattacaaaaatagtaaataaaaatgtgaaaaagaacataaggaatatgaataatttcattttgcttgaaacatttatagtcactattaagctagaatttagcaaatataataattttgaaattcacttttatttttgaaaaggtttcttaaagttatgaaaatagtacaaacaccaaaaacataaataatactaataatttcattttgatactgataatttcatcagtattgtttctgatatctttggatgaaaggattgtttaattattgaaaagagaatttagagtagagtttgaaacacagtttgtatgctgccatggtcttatgcatgtcatttaggttggaggcttttatttcttggaatgcatgaagagtttctcatggtatatgagcccccacaaattatacgaaattttttatgtatgtgtgcttttgggggaccgttatctagagctgcactgtccaatgtggctatttaaatttagggttattaaaattaaataaaatttagatatttagttccttggtcaccacactagccatatttcaagtgcttaaaaaccacaggtggctggtggctaccttatttgataatgcagatataggacaggcataaaacattccaaagttgttttggttgtgctgatatagagttttcatcacattaagaaccactgtctttagtggttttatgtgaactgaacatagatattttgtaatcaaggttggttaacagcaaagtaagattatgtttatagattggcataccttttagctgttgtctctgaacattttaagtagatgtttaatttttttctcctttttatcaaacttagtatatttcatgtgtggatggataccaaaaatttataggcttatttttgaaagtactgcttggcttagagccaccaagtggctgaaaagctcatggagggaaaaatgaattatttcagcttttaagaagtaataagtagagattttggctagcgtgagtagagagacacagaaaagaaaattttgatggcagcagacaagaataattgttccctgcctttttcttccatctcttattacttgcttttagacatgcttacatagaatatatttacggggaagaaatgaagagcaaggcattcctcttgaatatttagagaagcttcattataaacatgaaagctggctcctgcataggacactgaagtaagacttatttttatttactattcattttaaatacctttgttacctttgttaaattttaatctaaaatttggaagatatgactagcaatatgtaaaatttccagtcgttttgcttattggtatcttccagaactaggtatagattttcattctcttgattgcaatgagatcctatttacttaaagtttttataactagtatcccttggtggtattgatagcgtaatatgtgaaatttcactttaagtgataaagtaggaatatatctgaacattatttaggtactctttcagaaagaattttgacttgggagattgtatagcgtggttgttgagaggatagactttgttattagtcagatcttggctcaagtccagtcttactggtgtgtgaccttggatagcctctgagcttcagaatgacaattctgagctttagttttctcatctttaaaaatgcagaaattcctactttattgactgctatttgtttttgaagagaatcatatgttacagtacccagctgtatatattttgtacctaagtttttgggctccatatggtaaatctagatgagaaagaaggggctgccagatgaagtactgcaaagtaactttagtgtaaatgattgacaacattttgattttccaaggacatacgaatgaatttttaatgtttctctcttttttttgttgaatttctgattattttattaatctctctttttaaacagaaccaacttcgattatcttcaagaggtgcctatcttaacactggatgttaatgaagactttaaagacaaatatgaaagtctggttgaaaaggtagatttagacagactacaaacaaatatttgttttttctaaaaaagtgtactgagtggtgagaaaacaattttctaacagaaaagcttccataaagttacattaagaaacagttaagagctttagaagattttggactgtttaagattccagtcctgactaaattctagctttgtggcctgagctaaaataaagatccttcggaatctcagaatctgacagatcttagaaaaaaattaaataaataaaaataaaataaggatttttttttatcctttagtgcctctatctgtaggataggtaaaattataataacaaaaattctttctcaccccctttttctctgctttgtccccatttcttcctctcttccctacaccaccaatctttagatactttaataataaactgcttgtgaaattaaatttatctttttcaactaaattcaatatggaggatatttaaagttacaggatatggatctcatctatttttatgttggccaaagtcttgagattaagggattttagttttgagtttcatttgggatcatgtcaaggattaattgacattacttaatcattgagtcattgtcttaatcacagttcatttattgcccaaatcactgggagttgactatattctgttaagtgagtggtgcccatattgataaagggaatgggtgagaatttattgatgaatatttgagagagaatagtaagggaattggtataacaaatatccctatacccatgttgataactgagtgattaagctataaagaagaaagcacaatttggtttagttttgagaaaaatttgatttttcctttcttttgtggcataatgtctgctgtttaatagagacttgacattcataagggatatatcaaggattttgaaaatcttgacattttatgtaactactgtagcgtatacatgtagttgtttttcccatggtatgaactaaagcttatctggaaaattccaatgacctcttcatactactaatgatgttaaaaatataggataaattcacttacaatactattaaatgaaaagtcagcattaagtattaacagccaaccatcaatttaactgactttgtaaatcactttttaattttatctaacacttctttgttttgactaagaatcatttcacattattatatttacttttattaataatgctagcagttgactttcttattaaggtatttttacaaggcaataatttttgtttcttgagaattattgagtagcctagaatatgtagagaacaagcatattcttacattatggtcagtaggctaggttcattgactccttacatgattttctgcacacactgacattgcaaagtatgtgattcacatatgtgcttcagaaacatgacaaatctactacatgtttgattttcaaagttgcttgaactattgtgcttattaatgttatcagtgttaaagctgcatatgtcagtggtctatgatatttaaatgaagagattataaaattggtgttacagctattttagaactatatctatcttagattgatagatgcagtggctcacacctgtaatcccagcactttgggaggctgaggtgggaagactgcttgagcccaggagttcctgaccagcttgggcaacatagtgagacctcatctctataaaaaacaaacaaaaactagccagacatgatggtgtgcacctagccaggagttcaaggctgcagtgagctttgattgcaccactgtactcagcctgggtgacagagcaataaataactcctaaaatgaccttttaggtcattcatcttttactactgaagtatttaacaatatttcttttttttctcgagacagtcttgctccgtcgcccaggctggagtgcaatggcacaatcttggctcactgccatctccacctcccaggttcaaccagttctgcctcagcctcctaagtaggtgggattacaagtgcacgcctccatgcctagctaatttttttttttttttgagacggagttttgctcttgttgcccaggctggagtgcgatggcgcgatctcagctcaccacaacctctgcctcccaggttcaagcgattcttctgccttggcctccctagtagctgggattacaggcatgtgccactatgcccggctaattttgtatttttagtagagaaggggtttctccatgttggtcaggcaggtctcgaactcctgaccgcaggtgatctgcccgcctcggcctcccaaagtgctgggattataggcatgagccactgcgcctggcctatttttgtgtttttagtagagatggggggtttcaccatgttggccaggctggtctgaaactcctgaccttaagtgatccacccatctcggcctcccaaaatgctagaattacaggcatgagccgctgcgcccggccttaacaatatttctttggaaagtaaatgcaatggcattgtggtagttacttatacagctggggtcttcaactattatatacttttaaatgaagatgaatattagatacctcaaattagtcaaggaattatactgatttttttttcttcctttcctcaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgaccagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattatttatttgtcatgactcaaaa

SEQ ID NO: 614 - DNA, 110186 bp, Homo sapiens
acctgaaagcgataaaggaaggcttcgggccagaggaagaggtaggccgggctgatgaggccgagtttgccgaccaagggcacggcgacggtggcggcgaaccaatagcgcgtgatcgccgggatgctcctgaaccagtctccgatgtccgacatcttcgacccacaggtagccaagatgcacaagaccgcccgactccccgtgccgaccccctcacgacgcggccggctccgcgactgttaggtgtctaggtggaagccgccgaagccgcgatgcagaaggcggagacgggcggacgtggcgccaccgaattcggaccagcgaggcagccttctgaggcgaaacttccccttccggcgaccgcggacgacgtgaccagaagtcccgccgcttaaagggtaagcgccgattttaccgcccggccgaggctcggcgtcctggggggcggagccaggtagagcgactacacgactggtgggaaaacagtggttgcctggatcaacggcaaacgctccggccagtggcgaggccaaatgccattcacctagttctcagagttttaatgcggctgggtccacctggagggtatttaaaggggacgaaggcaaacgaagtgtctagttcctcgtctgcttactcattccacaagtgtttgttgggcacagttctagacactgggcagctgcggctgtcagcgctgtcgtggtaccctctctcctgatcttaacatcctcattgggataatttataaacaaatagataatgaagtaagataatctcagagagtgattagaaaaataggaaaatgaaatgagatgatgaggtggagtgacggggtgggggtgcggcagtgtgaggacagatggctaccttaggtatgaactgggccagccaggcaagagatctgggggaagaattttccatgcacagagaaaagccgctctaactaggttggaatgttggaggaactaaaagccaaaatgatccatcttgtctaattcaacttgtataagaaggaatctttaagaaaagatactggccaggcgcggtggctcacgcctgtaatcccagcactttgggaggccgaggcgggcggatcacgaggtcaggagttcgagaccagcctggccaacatgatgaaaccccgtctctactaaaaatacaaaaattagccgggcatggtggagggcgcctgtagtcccagctacttgggaggctgaggcaggagaatcgcttgaacccgggaggtggaggttacagcgagccgagattgcaccattgcactccagcctgggggacaagagccagactccatctcaaaaaaaagaaaaaaagaaaagatactgagtagagtttcccgttgttttgggatttggggccagcagtttaagattgctaaagtcttccaataaagagcaccaggaacaaacctgtagtcaacaaagttagatttattaacttgctgcagcaagggagactgcactccagaggaacctcaatgcctctcatcaaacggaagtgtcattattgggttatgggaatggggggattttttggtaagaattaactggagcagtgtttgatagactcgaagcaaagcagagctgtgtgcagcatcaggttaacatcagacctgagtaggaagcaggctctttccttggaaatctcaaaattacgacaaatgtgaaacgttgggtctgaaaactctatctaaagctttgtacctgtattgaaaatcctgtgtcaaagtgacctgtatggctcagatgctctggacaagaatgggatgttccattcacacggaaaggatgtcagacagcagagtttccaacattccataattttagagaatatttgtcagcaccatatccttgatgttaattaataaaaacagttttttcataacaaaaaggcattaaatattccacagtgtaatgagagtatacaacatttgggaaccaatggatagcaaatctacgaagaacacagctggtgggaatataaattgatacagccttacaaaaagataattttgatataaaagctagatatttatataaataacagataatacttgacgatattgcctgaggtttattctgtttatttccctctactaccaccaccattgttttgtacccactactcataaccaaggtacagtgaaagaaaacaggggttatctggcttaggtggagggctaaggaaagtttctctgataaacttaaaagtacacgtgcatgagaaaagacaagaacaagaaaaatgtacacccaatatctggcagtgtttatttcttttttttttttttttttgagacggagtcttgctctgtcgcccaggctggagtgcagtggcgggatctcggctcactgcaagctccgcctcccgggttcaagcgattctgctgccacagcctcccgagtagctgagactacaggcgtccgccagcacgcccggctaattttttgtatttttagtagagacggggtttcaccgtgttagccaagatggtctcaatctcctgacctcatgatctgcccgcctcggcctcacaaagtgctgggattacaggcgtgagccaccgcgcccggcctggcagtgtttatttctaagttgtgctctagaattcatagtgaatgctctggaattcaacttcggcctttagaaacactgaagtttaaatcagagcaacggtaggccaggtatgtctggtcttttcttgtaactttacattcaaaggctttctggctggtccgatggtagtgatttatcagaacttattaacattagtgtcactaaagttggtatacaaccccccactgctaaatttgactggcttttaaaaatatttattatttttaaataatattgaatatttattaaatttattattaatttattaataatattatttaaataattattttttaaaggctttctctttctacaaagtcttaataatcattttaatgactaatattctactagtgatgtggcagaatcttttgaccattttcctatttctgatacctgtttttaaatactatatatagttctataatgaatacctttatgcatatacattttatactaatagctaacttttttatttactaatatctaacatttgctgagtgtctacagtttgattggcactcagctatgccctttatgggcatggttttaattagtctttacaacaatgcttcaaccctatgaagtacttttatttccatttacaaatgaagaaacagccttagagaagttaagtaacttggcacttgccggcaggtgcatatataaaacttcaacccagatctatttaaagccaaaggtggtgcttttttttttctttttttttcttgagacagcgtctccctctcgcttctgtcacccaggctggagtgccagtggcgcaatctcggctcactgcaaactccgcctcctgggttcaagcaatcctcctgcctcagcctgccaagtagccagaattacaggtgtccaccaccatgcctggctacttttttgtatttttagtagagacagggtttcgctatgttggccaggctggttccaaacccctggcctcaagtgatccacacacctcggcctcccaaagcgctgggactacaggcatgagccaccacgcccagcccaaaggtggtgctctttcattcatttattcagcaatgcttttgtccagtgcttgttatataccaataacagttctaaacagtgaactaaactgacaattatctccaccctcttggaacttacattctagaggaggcagaaagacaacagaaagagataaaagtaagatgtacaggctgggcgcggtggctcacgcctgtgatcccagcacttttgggaggccaaggtgggcagatcacctgaggtcaggagttcgagaccagcctggccaacatggggaaaccccgtctctactgaaaatacaaaaattaaccgggcatggtggcatgcgcctgtaatcccagctactcaggaggctgaggcaggagaatcacttgaactcgggaggtgaagtttgcagtgagctgagattgcgccattgcactccagcctgggcaacaagagcgaaactcctctcaaaaaaaaaaaaaaaaaaagtaacatgtacagtaggtaaactggcaataggaataggaaaagaaaaaagaagaaaaggagatttgggctggtgagggaaggcctcactgcaaactcagaagatattgagtacacgtctcagggtggtgaaagagcaagcagtgtggagatctggaggaagaacagttcagatagaaggaatggcaaagaccttgaggtgggaatgtggctggcatggagaccttaaacacgaagacccatgtggctgagtggagcgagagtggggatggagggtcaagagacaaaggaaggagagagtcactggaatcatggaggacactgtaggttatggaaaggaccttgtattttactgttcttacccactaggccacactgcctctcgatccttttgttgaactgatttccaggagtaggatttaaaataaaaagatattaacagctcaatgacttttcctcccagaggtggtgtgattgtgaacctaatcaaacttaggctacaggacccctcacttgcacaggcctttccaaggctctgtgcaaaactttgtaaattttttttttttttgagacagagttttcactctcttgcccaggttgcccaggctggcatgcagtggtgtgatctcggctcactgcaacttctgccttctgggttcaagcgacgcgcgtgcttcagtctcccaagtagctacgattacaggcacctgcaaccatgcccagctaatttttatatttttagtagagatgggtttcaccatgttgaccaggctgctctcgaactcctgacctcaagtgacctccccccctcggcctcccaaagtactggggttacaaacataagccaccatgcccagccctgtattcataattttatatgatgtttcttgaagtaggtcctccaaactgtataaactttaggcccaaaaaaatccagatctgcccacgtacttcatattgccatcttgcttttcaccttagaaaggtgactctgggccaagcacagtggctcacacctgtaatcccagtactttgggaggccaaggcgggtggatcacctgaggtcagaagtttgagaccagcttggccaatatggtaaaaccccatctcgactaaaaacaaaaattagctgggcatggtggtgggcacctataatcccagctactcgggaggctgaggcaggagaattgcttgaacctgggaggcagaggttacagtgagctgagatcacgccactgcactgcagcctgggtgacagagcgagactccatctcaaaataaataaataaataaataaaaataaaagtctcattccagtcctgcctgcccttcctcccactcaagtcaaagcccttccctccccttcctctttctttctctctgaaaacagtcagatgccccaagagaatggcattccagaatcctatgactatagctttacaacaccaatgagttatgttacatatataccatatatatatatatatatatatatatatatatatatatatatataaattgctttcaccaaaaacaggaagagccaacctgcataatatagcaagaccccatctctacaaaaaaagaattttttttaattagcaagcattatggtatgtgcctatagtcccagctacttgggaggctgaagtgggaggatcacctgagcccaggaggtcgaggctgcagcaagccatgatcacaacactgcactccagccttagcaacagagcaagactctgtctctagagaaaaaccaaacaaaacaagaagagggtctcagatcgtgccctctagaatgtgagctccatgaggacagggactttgttttgatcacttttgtgtccccagtgcctagaactgtgcccggtacatagtaggtgctcaataaaggcttgttcactgcaatgaattatgattcatcctagaacttttccctacccttatcccagtcaccaccacccaggctaggttaaatacccaccaccaacttcctctgtactcctagaataccctgcacaaatcaccatcattgcacttagaacatagtttgataactgtttgtgtgtgtggtagctgtctcctcctctagagtataagttccgcccaggtagagcctggattttatggctcctcacacaagactaaatagatttcgtgagcaaatcctgacccctccaccttcaaaatatgtcccaaattaaaccacttcccaacttttccactgagctaccccctggcccaactactatcatgccggtgtcgggacttttttttttttttttttgaaacaggatctccgtctgtcacccagactggagtccagtggtgcaatcttggctcactgcaacctccgcctcccaggttcaagcgattctcctgcctcagcctcctgagtagctgggattacaggtgcatgccaccacagcctgaccaatttttgtatttttagtagagacggggtttcaccatattggtcaggctggtctcaaactccccacctcaggtgatccacctgcctcagcctccaaaagttctgggattgcaggagtaagccaccacacccgtcctcagtgcctggacttctgcagtggacttccaattggtatccctgcttccgttgcacccctctgcagtctgcaatcccacaggagcctaaatgagaccctgtcactctcttgctcaaagccacattgcattttattctagctagagtggaaagcatgatgcaaggtccttaccatgaccttccaggccctatatgatgtgaaccttggcaatttctgtgacctctcacttttcccttgtcactctgctccagcctcaataccttccctgcattggacagttcaaggcattcatgtgattgctgtacctttagcctggaacacacttcccccagaggagtggtcctcaaccctatgaggccaaatgctgtcttttaaaatatttgctatcccaatgccacaatgaaaaccataggttataaattacaactccaataaaataaatataatgccctaattgtgatataatgagaaaaaaaggaaaccaacttctactataatatagattttaatgttaatgatcaggcacaactatattagcaaacgtcatgaaaacgtctggtacttgcagttatagatttatggcgagttgagagctataaatgcagacagatatccatgtgttgtatttgtggctcaaacaccaccagctgaatcgattggcattggttacatgactgtccacaatggtggacagcccttggaaaaattctgaatataatagagtgcataaaaattcaaatgtgataaaagacagattcaatgatataaaaataaaatgtgtttgcatgacaaaaaatcacgtagaggtaaatgactaagtgggagaaattatttccaagatatatcatagataaaaggctaaaataaccaagtatataagaacttgtaaaaaatgagggggagaaagaccaaaaacctgacagaaaaacagataaaacacacaaacagataattcacaaaaaaattaaattaccttaaaacattaaaagatactcaattttctcataatatgagaaatgcaaattaaaatcataccgagataccatttctcacctatcagattggcaaaaaatagtacaataggaaatattgtataacaatagaaacaatgtatacatttactctttaactcgacaatggcaattttagtagtttaccttgaagataaacttgtaacagcataaaatattgtacaaaaaatgtcagataccctagtaagtgaagaaagtaaagtgcaaaatagtatataatatgttacttttcatgtaagaaagaagaggaaataagaatacacacacaagtaaaaaagaattaaatcgcgccactgcactccagcctgggcgacagagagagactccgtctcaaaaaaaaaaaaaaaaaaaagaattaaaaagctgggtgtggtggctcagtacctttaatcctagcactttgggaggccaaggcaggggcataacttgaggccagaagtttgggaccagcctgggtaacatagcaagaccccgtctctacaaacataaaaattaaaaaatcagccaggtttggtggcacccacctctattcccggctactcgggaggctgaagtgggagaatcacttgagccaggaagtggaggctgcagtgagctattattgtgccactggactccagcctgggcaacagagtaagttcccatctctaaaaagaaaaaagtgaaagggaaaaatagtacagtctttctcgatgaaaacagtagaatagttaaaaacaaagaaagaaagaatatagtagaagagtggttgcatttcaggaaaatttagtgtatactgaatccctataaatattctttatgtttatatgtaaaacagagttagttctaggttcagatattacaaacagggtttttacttacagcagtatcttaggaattgacaaatgggtgtgggccatcttgcacattgtggaatgtcttcctagcacccctggcccctgccctacatggctgcatgtcccctagttattgtgataactcaaaacaacactgttgcaagttggattgtgttcctccaaaaggtatgttgaagccctagcacccagtacctgtgaatgtcacatttggaaatagagtctttgcagatgtaatcaggttaagctgaatcatactgaatcaggatgaggccaaatccaatgactggtgtctttttttttttttttttttttgagacagagtccaggctggagttcagtggcatgatcttggctcactgcaacctccgcctcccaggttccagtgattctcctgcctcagcctcctgagtagctgggattacaggtgcccaccaccacacccggctaattttttatattctagtagagacggggtttcaccatattggccaggctggtctagaactcctgagctcaggcaatccacctgccttggcctcccaaagtgctaggattacaggcgtgagccaccacacccagccaactgatgtcttttttttttttttttttttttgagacagagtctcactcttgttgcccaggctggagtgcaatggcacaatcttggctcactgcaacctccacctccagggttcaagcgattctcctgcctcagcctcctgagtagctgggatgacaggtgccctttaccacacccggctaatttttttttttttttttttttagtagagacaggatttcaccatgttggccaggctggtctcgaattcctgacctcaggtgatctgcctgcctcggccccccaaagggctgggatcacaggcgtgagccacttcaattggcctgactggtgtcttaatataaaagaaaaaacgtggacacacacagagagagggagaaagagagagagaagatcatgtggagacagaggcagaaattagagtaacacatctacaaaccaaggaatgccaaggatcgccagcaacctctagaaactaggaggagggcatggaacagactccccttcagtgcctccagtaggaaccagccctgtcaataccttgacttaggatttttttttttgtgacacagtctcgctctgttgcccaggctggagtgcagtggcacgatctctgctcactgcaacctctgcctcccagttctcccaggagaacagaggcagttctcctgcctcagcctcctgagtagctaggattacaggtgagcctcaccacacctggctaagttttgaatttttttagtagagacagggttttgccatgttggccaagttggtctcgaactcctgacctcaagtaatctgcctgacttggccttccaaagtgctgggattacaggtgtgatcccagccaacatgcccagtcttgacttaggacttctggcctccagatatgtgaaagaataaatttctgttcttttaaaccaaacctccacacagtatagtgcattactgaaaacctgtcttgggccaggcatggtggctcacacctgcaatcccagcactttgggaggctgaggcaggaggactgcttgaggttaggagtttgagatcagcctgggcaacatggtgagatgagactttgtctctaaaacagaagagaaagggaggggaggggaggggaggggaagggaggggagtttttgggtcttccttctgtacagcttagacaacacccttcagtggtacattccctgaacactttaatcaaaataccatcccatgctatcagtctcatccctttattctgcttaaatgtttcctcacttttcattacccaacataccatttatttattttcttatttgttcattgtctgtctccccagctagaatgcaagctgcatgcaagcacgacttggttttgttcactgctgtagcccccccacccagagcagctcttgcgcacagtaggagctcaattcatatttattggccaggtgcggtggctcatgcctgtaatcttagcacgttgggaggccgaggtgggtggatcacctgaggtcacgagtttgagaccagcctgactaacatgataaaaccccttctctactaaatacaaaaaactagccgggcatggtggcgcatgcctgtaatcccagctacttgggaagctgagacagaagaattgcttgaacccggaaggcagaggttgcagtgagtggagattgtgccattgcactccagcctggacaacaagagtgaaactacgtctcaaaaaaaaaaggaaaagaaaaaaaactgagctaataaatgggcatccctttataaaaagagcacaaaagtggctgggtgtggtggctcatgcctgtaatcccagtacattgggaagctgaggcaggcggatcacaaggtcaggcgtttgagaccagcctggtcaatattgtgaaacctcgtctctactaaaaatacaaaaattagccgggagtggtggcacacacctctagtcccagctactctggaggctaagcaggagaatcgcatgaacctgggaagtggaggttgcagtgagctgagattgcaccactgcactccagcctgggcgatagggcgagactctttctcaaaaaaaaaaagagcaaatgtaaccttggtatcacgaggaacaggagagaaccgtttacctgaggaagagagcagagagaggcaccaagaacgcctgagagccaaaagactcagaggaaaaacaaaataatttgagatgtctcagtaaaagttgaatgtgcaaccccttttagtcacagaatattattgctgccattgcaaacgtgatgtgcaaacatgcatatgcttgactggcaaggcatttgagccaaaaatgctacatctgtcatatttgtttgaagccaagccaaataggctgaacacacatttagagagcgctaagagaattttataccttgtacttgctgtcaaaagcagcaggggaaaatgtgttgaaaagagaaagtgtacatactaaacagccaaaatggtgcatgtgtcaggttacgtgcagagtttctcaacctgggcactgttgacattttgggttgatagttctttgcttgtgaggggctgtcctgtgcattgtagaataatttgcagcatctatggccaccccatgacagtagaacctcttccccaggtatgacaaccaaaaatgtctgcagatattgccagatgtcctttatggcaaaatcaccccggttgacaaacactgagtttgtttggggttttttatttgaaatgcagtctcactctgtcactcatgctggagtgcagtggaacaatctcagctcactgcaacctccgcctcccaggttcaagcgattctcctgtctcagcctcccaggtagctgggactacaggcatatgctaccatgccaggccaattttttgtatttttagtagaatctggtttcaccaggctggtcttgaactcccaacctcaagtgatccactcatcttggcctcccaaagtgctgggattacagatgtgagccaccactcccagtggaacatttcttagatgccaacagcatgtgaagaagctcaagctagactactgaatgataagaggtcatgtggagagaggccctgatggatgagaagccatcttggatgttctaccccagctgagcttcagctgaatgcaaccatgagaggccttggctgtaccatgcagggctgaagaactgttcagctgagcccagtcaactcacagaattgtaaaaaaaaaaaaaaaggaaatcacggttgttttaagccagtaagttttgagctggtttgttgcacagcaataaacaactaaagtattatcaaatgtctaagttgataaagttgaatgcactgttgtagccagctcacaccagctactggagccaaatgttgaattttctgagtcaattattaaacacagctgttattaaaaattaaattagagaacaattcgcaattgcaaaaatgtagaactagcctaaatgtctatcaatcaataggtagataaagaaactgtggcatatatatatacgatggaatacgactcagccataaaaaaggaattaattaatggcattcacaacaacttggatggagttggagaccattattctaagtgaagtaactcaggaatatgttactcgtatgttctcactcataagcaggagctaagctatgaggatgcaaaggcataagaaggatacaaaggactttgaggacttggggggaagggtgggaagggggtgagggataaaagactacaaattgggtgcagtgtatactgcttgggtggtgggtgcacacaaatcaccaataaagaacttactcataatcaataccacttataccccaaaaaacctatggaaacaaaaaatttaaaattatatttttctaattaaattaggctgggtgcaatggctcatgcctgtaattccagcattttgggaggccgaggcaggaggaacacttgagcctaagagtttgaggctgcagtgagctatgatcacaccactgctctccagcctggacaatgaagagagaccctgtccctaaaaacaaaattaaattaaattatataaacttacattaaaacacattatatttcaaaaggtaataagtaccaacttcctatttatttatttatttatttatttatttatttatttatttatttatttttgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttgtatttttagtagagatggggttccaccatgttggccaggctggtctcaaacttgtgacctcaggtgatccacctgcctcggcctcccaaagtgctgggattacaggcataagccaccacgcccagcctttctaattataatgctgtattttactattatctatgctcttgaagttatttatgtctactgtgtctgtacagtaaacatactatataatagtgtactgttgcttacctctgtccaactctgcattcagtgatattacattgatagcctgaaattggccatcacaggagtatttccaccacagaaattgccaaatgttacataccagaactctttttgtccagagaggcggcggtcattaaacatttatagcacatcactggtacccgcctggcagggctttaataatagctagcacccattgaggacttctgtttgcctgatgctgtttaaactttttgcaactctatgaggtgagtcctattatgatactgattttacagatgaagaaatcaagaaacagagaagttaaatactttgtccaaggttatagtactattacagtaagcaatggagtggaactcaggtgtctgggtttcatgcctttaagtatactacgcatattttcccaaccattactcagggacaagatctaataaatgcaaatgtatttagtggggagaacagaacagaaaacatgaaattggaactctatgttcacagtacctatgagttagaggttttaatataatgctaaattcaagtaggaccttctacgggatttaaaaacaaaaaagaggccaggtgcagttgctcacgcctgtaatccccgcactttgggaggccaaggcgggtggatcacctgagatcatgagtttgagaccagcctggccaatatggtgaaaccctgtctctactaaaaatacaaaaattagccggatgtgatggtgggtgtctgtaatcccagctacttgggaggctgaggcaggagaattgcttgaatccaggaggcagaagttgcagtgagcagagatcgtgccactgccctccagcctgggcgacagacagagactccatcaaaaaaaaaaaaaaggaagcaaggccaaagaacaaactagaataaagtgaaaagcagctaacacatacctggcacagatgtctagtcaatgttggttccattaccctctccatgccccagatgttcacacctacttccttgaaaagaaattctctgcagggttaagctgctgggcccaactgctgggcctgatttcactaacagacagtactcttccaaagtctatagaataaatcagtgatctattgtgcttatcctcttatctttttcttttctcacatggaaagttgcttgcagtatttatcaaacccatcaatataataaaaacaaaaacacttggaaaaaatggtttgtactgctaaggccacacagagaaggaaagaaactgaagagccagttgatgtgatgtttggctgaggaggggtctgttaggtgctgatttcttgctggtcatccttactcctcagggagggtgcccgaggagggatactgcactgccctagaatactttactggacaataaatgcttagttcaatcactttgtcttccacccttacagcaattagaggcattttactcatagtttactggcattttctcatgcttgattgacaacttgtcctctgagctcacaaatgttattgggcacctgcaaatcaaggctaattattcagtcctgtggagacagtcccaacatcttttgacccccacagccttctgcccagggggatctttggaataggtcactacctgcagattataattttacagcctaactgatagaatctttccaagctggtttatactagttcctgcaatagcacaattagatattaatttttctggcacgcagatggcaaattttttttttgacagggagtctcactctgtcgcccaggttggagggcaatggcacaatctcggctcactgaagcctctgcagtgagattgtgattctcctgcctcagcctcctgagtagctgggatcacaggtgcctgccaccacactcagctaagttttctatttttaatggagacagggtttcaccatgttggccaggctggtctcacactcctgaccttaggtgatctgcttgcctcggcctcccaaagtgctgggattaaaggtgtgagccaccacccagactgcaaatatttttttaaacccaactgccaacaactgggagattacaaaattatgccacatcctatatgatggaatattatgtagttctggctatggcccaagtggctctagactgtcttcttagaacagctttagatgtcataaaggctgataattccacccccacctcctctcctggccacgtggaagggctctaaagactcgaaacctgcaagcagggctcattctgtcatgggactgggagcttcaccgtttgggctcctccttcctttagagtggagaaacccttttagaaacctaatctatgtcagcagttttctcattgtatgtgggcatgatcttgctgcctgtcaacatcaacgtcacatttcttcctctcctctgatattgtactattttagctgtaggtgccaaatccttttgattatacatgaaacactacccttggttgctttcatgtatgttttatgagaacacctaagcatgaatatttattaaagcagcttggaacacatctctttgatttttttctgttctgactcatattaaagtggggagagagggaggtacactatgtcatagttcacctgcaatggtttctgccttcttcctccccctcacaaggccaaatagttgagccatttaggcaatggaaagcattgccaagtttgcatcagttagcagcgtgacacatatttctgttttactgatgaaacagaactatttcttttgcaatgccaactttcctacacaatagttccataaatttgtcacctaactgttgcctgacttggtcaaggcttcttcactttttgtggaataacagctcccctactgtgaactatgacgcagtgtacctcccctctcccagttttaatgagtcagtacagaaaaaatcagagttgtgttctaagctgcttaaataaatattcaacttctgcctgcagcctcagactcctctgagtgatcttcccactgcagtcaaagggatgtatttagaaaaaaaggagtttccttagaacctttcaggataagatccaaactccttagaaaggcagactcggtatatatatatacacatacatatatatgtatgtatgtatatatatgtgtatatatctgtatatgtatgtatatgtatgtgtatatatatgtatatgtgtgtatatatatatgtatgtgtgtatatatacatatatatatatgtatattttttttttgaaatgaagttttgctcttgttgcccaggctggagcacaatggcactatctcggctcactgcaacttctgccccccaggttcaagtgattctcctgcctcagcctcccgagtagctgggattacaggcacccgccaccatgcccggctaatttttgtatatttagtagagacggggtttcaccatgttgaccaggctggtcttgaacttctgacctcaggtgatccaccagccttggcttcccaaagtgctcggattacaggcgtgagccactgcgcccagcccctaaaatatatatatattttaaacacattgtttccatgtgtttcttgttctagtgatttctttttctttttttctttttttttttttttttaaagacagtgtcttgttctgttgccaagactgtagtgcagtggcaccatcttggttcactgcaacctccacctccagggttcaagctattctccttcctcagcctcctgaggagctgggactacaggcgtgtatcaccacgcccgacggatttttgtgttttcagtagagacggggtttcaccatgttggtcaggctggtcttgaactcctggcctcaagtgatctgcccatcttggcctcccaaagtgctgggattacaggtgtgagccaccatgcctggcccctaaaacacacacacatacacacacacacacacacacacacacacacatataaaaaacacattgtttcagtgtgtttcttgttctagtgatttttttctttttctttttctttttttttttaagacagggtctcattctgttgcccagattgtagtgcagtggcatgatcttggcccactgcaacctccacctccagggttcgagcgtttctcctgcctcagcctcctgaggagctgggactacaggcgtgtgtcaccatgcccaactgatttttgtattttcagtagagacagggtttcgccatgttggccaggctggtcttgaactcctggcctcaagcaatctgcccatctcggcctcccaaagtgctgggattacaagattcagccactgtgcttggctgggtcttttatactctaacttcagcataactcttattcctctgccattctccacatagaaataatagtaacttattgttattattgaaggctttcaaagtgctaagcattgtatatgcccaatgactccttgtgcatcctgccctttaattgaacagaactctagtttctggaagctatcctgtcgcttcacaacctcctggatttttacagacgctatttcctcccctaatgtctcctccgccttggtaagcgccactcatccttccctactgagctcatgcatcatcgcctcctgaagccttccctcgcccttttttcttccaattccatctactctccaaataagaggcaatgttttagctccagtacaggaaagtcagaaggccagatcaacttctggggcaattagaacaagggatgtggccgggagcagtggctcacgcctataatcccagcactttggtaggccaaggcgggttgatcgcctgaggtcaggagttcgagactatcctggccaacatggcgaaaccccgtctctactaaaaatacaaaaatttgtcgggtggggtgccacatgcctgtaatcccagctactcgggaggctgaggcaggagaatcgcttgaacctgagaggtggaggttgcagtgtgctgagattgtgccactgctcttcagcctaggtgacgacagagcgagactctgtctcaaaagaaaaaaaaaaaaaaaagcaagggacgtaaatactgccaggatgctctcttcccaccgctttttccagctttgtcctgacctttagctatcccctctcagactcatcaccacaaagctattgcttatggctactccctgtctttgctaccagggagtacacacacacacacacacacacacacacacacacacacacacacactctctctctctctctctctctctctctctctctctctctctctttcccccccagcactgggttctgattggctcagctgagtcaggccccacccccatgccaatcatacgaccaatgagggtgggctaaggagcctgtccaggaagggtttgggagagggcagtaggtaggtttgccggtggaagtaagagtgctgggcaggcggaactatccatggttacaatcctcccccagccccacttcctctgtgctttactatgttttaaaaatgctctcagcattgacagcctctttatgtaccaagactccctttcatacgcaaaggaactcttttgccttgccttccctttcttttctttttaaaaataattttttttaaatttaatccttgcttggttgaaacttttttattttatttatttttttttaaacaaggtaggctagactaagctatgattgacgttcagtagattagaacagaattttgttataaaggttcccagaaatttttaacccaggttagcaataaattgttttctggtctgagcgatgggtcttttggaagaattatagaactaatcagtctaccagactagcagacccatctacaaaggcagagaggcataggaaatgcagagtgagacaatggagccagctaggtctacatttcaaccttggcttaatggctgtataaccttgggcaagttatataaccagtccaagcctcagtttcctcgttagtcaaatggggacaaaattactgcattaggtgggatgggcagtgtgatggttaatactgagtgtcaacttgattggattgaaggatgcaaagtattgatcctgggggtgtctgtgagggacttgctaaaggagattaacatttgagtcagtgggctgggaaaggctgacttacccttaatctgagtggggacaatccaatcagctgccggcgaggccagaataaaaagcaggcagaagaacgtgaaaagacaagactggcttagcctccccgcctacatctttcgcgtgtgctggatgcttcctgccctcaaacattggcctccaagttcttcagcttgtagatggcctattgtgggaccttgtgatcatgtgagttaatactccttaataaactcctctttatatatacatctattagttctgtccctctagagaaccctgactaatacaggcaataacaagaaaccaccaaaactctttcttctgtgtagaaagccttttccacctcatccttccaggcctagctcaagtgtcactcttctttttttttttttttctgagatggagtcttgctgtgtcgcccaggctggagtgcagtggcatgatctcggctcactgcaacctctgccacccaggttcaagcgattctcctgcctcagcctcccgaatagctgggatgacaggtgcctgccaatgcgcctggctaatttttatggtttttagtagagacagggtttcaccatgttggccaggctggtcttgaactcctgacctcatgatccacctgccttggcctcccaatgtgctgggattacacttgtgagcctctgtgcctggcctgtcactcttcttttaacatctctctctctttcccagataattaatcactcccttctctgaaatttaccaatacctcagttatagatggtcccaacttgtgacaggtcaatttatgcttttttgcctttatgaatattcaaaaataataggcattcagtaggaaccatacttcaacccatataagcattgtttttcactttcagtacattactcaatagatttcatgagctattcatggaatattactataaatttattataaatattatttattatataataggctttgtattggatgacttagctcaagcataggctaatgtaagtattctgagcatgtttaaggtaggctaggctaagctatgattgacattcagtaggtcagagttattaaattcattttttggcaggctgcaatggctcacacctataatcctagcactttgggaggccaaggcaggacaatcacttgagcacaggggttcaagaccagcctgagcaacatagtgagaccttgtctatacaaataataaaaaaaattagccaagcatggtggcatacacctgtggtcccagctacttgggaggctgaggtgggagaatcacttgagcccaggtggttgaggctgcagtgagccatgattgtgccactgcactctggcctgggtgacagagcaagaccccaactcaaaaaaaaaagtatttacttatgatatatattttttgagacagagtctcactctgtcgcccaggccagagtgcagtggcgcaatctcttctcactgcagcctccacctcccaggttcaagtgattctccagactcagcctcccaagtagctgggattacaggcactcaccaccatgccagctcatttttgcatttttagtacaggcgaggtttcaccatgtcggccagggtggttgaactcctgacctcaaatgatccactcacctcggactctcaaagtgctaggaatacaggcatgagccaccgtgcctggccaacttatgatatttttaaactacattgaatttaccaggatacaacttaatcataagttgaggcacatcagtataacactgatcacatggtattatagtcacacatctatttctccctagaacttcccattccaccctaagctgtgagctttccaagaacatgaaactcatctcattttgtctctgcaactccaggtacttgtacagggcctgatgcctagttggcattcaaaatattgagtgaatgatccactgatgattaaatcaatgagtgacaagagcaagatatggcctacctatagagaggagaagagctaatccaggcccttttccgattttgatagaaaggattttgcagacacattgaatatggtcatttataagctttaagtttttcaggagtagttactaagccagcttgtttgagaagcattgggttgcgctgctgtctccaatttggggcatcaaaagttggctatacttgggtaacaagaatagaggtgtggaaaataggtaccagggtttctttgtgacaaaagtcaaaatgaagtgacatgtcacatgtgtgtcatgagaaatcccagaagaaacagggaaataagtgatgagggaatcctatttcccacaaaaaagaaacctctttcggaagttccaaacttgacattgacaatttcaagaggtattttcataaaatgcagccatgtttttatgtgtgtcaggaagaaaacttgtgtgtaaacataaatcatgtctgcttgtggccttctgaatgcatacctaaaaatatgcaataatattttctttgcaattacacagaagaaaaatgtcaagggatgcataaatgagcttccatgttgtatatttagcagcatgggatgtgggaaatggaagggggttaagggagcatttttccattcctgctgtttgcaggtgaggaagatgagactcagagaggttgtgacttacccaagatcatgcaacaatgtattgactgagctaggattagaaactcagcctcgttttgtttttttttcttctttcccactatagtttgataaattatatatatataaacatagcctgaagttgtttaggtttaaataatagctcaattgttcaataaacatgtcttaagggcttactatgtgcctaacactgtgccagatgctagggagcacaaaacaggtaaagtcccccactcgacacatatattttgtccacttttctttttcttttgtagagatggggccttgctatgttgaccggttggttttgaactcctagccccaagggattgtcccacttctctctcccagagtactgggattacaggcgtgagtcacagcactggtcttttgtccactttttccatgccatactctatgctaggccctggggagctctgtcttcatgaagttaacagtcctgtggggcaggcaacattaatcaaagaatcacacaattaatgagtatctgacatggagggaagagagttccataagtgtgtactcttcctaatatttttacttttcttttttaaattttttattttattttatttttttaaatagagacagggtctttgttgcccaggctggtctcgaacccctgggctcaagtgatctgcccacctcagcctccaaaagttcttggattacaggcttgagccaccgcacctggccctcaacattctcacaaggaaagattctagtttctgggtcagcttctagactccatttgactcctgttaatgagaaaaagagctaaataagcagaaagataaagctgagcttctaacaaagaagttagagtcagaaaccctagtgtttatgggcgctgagaaaagttttagaagagaaaaggaggaagccctgagggttgtggagattttaggtactgagaaatagggatggtgtgggagtttttaatgcttttcaccaaatattttaggttcttcccccttccaaacacatggtaggtgttgtagattgtataattggtctccgttctccactcctccctggatccatgaaacttttcagtgctctcctgccatgaatgcaatataatactcagcccttgggctcagccacatactggctttggccattaagaagaaatgaaagtgatggtgtgccagctccaagactagaagaattgcatgtctgcttcctcacctgcaccactgccactgccttgagaacatgcttggttagcgtgggaggatgagagccacttggaatagagttactgcagttgccccagatgaagtcagcctacaaagctgaaaaccagctggcccctagatgtgtttgtgagcccagcccagatcagtggagccacctgctgactccagatgcatgagcaataaatgcttatcgttaaatgctaaagaggtttggtggttgttttcttttttttcacagctttattgcaactatatataactgatttagcagtattgcacttcctagctctgtgttaagggtgtagccatagttctgaggcagcatcattgtctggggtaaatacccaaggttcatcgtcttacccgagggaaatcaagtatgcagacacaagaagtgggtttaggagcagaggtttactaggcaaaagaaggagaaagaagaacagctctctctcttgaaatagagtggggagcccgaatgggacttccagcctttggcagagtaaaccagattttatagaaagtcttgaggaggtggtgtccgctttacatagggcccacagattggttggaccaggtgtgacgtttacataatacctggggaatgctggccacactaccctaatcttattatgcaaatgagctttctacttggccagcaccatgttgtgtgctccttgctgtatacatggtttggcaaagagaagggacgatggagatgccattttgaacatgcctagtcccaggtagtcttttcctattggcacaactgctggcattcacccatgcaagcttctagcttgcttatctatgtctgcagctcgattttacaggctgctccttgttagaaaagaaaatgatttgggggctgcttttcattaaaaggaaaaccttaccaaggacttccctaccctcactatctgcctaaataatttattcttaactcctacatcagttctggtcatgagttggaagcaaaaacaataatgacgtttctgggttggaacatttaattgctggtgtgagaacctctagaactcttttcctactaacacatcaaccaaaaacttttgaaatattagctgctccctctgtctggatccctgagagactaagataaactgaaaacccagccaaaaaaaagctgttttaagccactgagattttgaaattgttcgttactgtggcataacttagtctagcctcactgaataaggtgggaaggggatattttaagaagtttgctaaaggttattaactgctttctctttgatgctcttaaagagattatttgaattgtatttatgtgaataaaattgtattaatttgaattgtattttattcttatacagaatattttaattatattttcaattattgtttgttaactttttttttttgagatggagtctcactgtgtcacccaggctggagtgcagtgatacaatcttaactcactgtaacctccacctcccaggttcaagcgattctcctgcctcagcctcccaagtagctgggactacaggtgcccaccaccacacctggctaattttcgtatttttagtagagatggggtttcaccgtgttggccaggctggccttgaactcctgactcaagtgatctgccctccttgacctcaccaagtgctgggatagttatttttgttactgtactactttaatttgcttgctaacctgttgactggcccaggttttttgagacttatcaatatagttaccaaagagctgggaaagagaatagcttcacttctttacttccaaatatcttgacacttttcccagaccaaaagggtagtcagatgttgggcaatctatatgtccactaagctccctctagcaaacaaattagaagtactctttttctgtccaaattatatattatcatagtaaaaagaaagacatccttcagctgcgaaagtgtagtgtgtgagagtacaaggagaaagggctttgcaaagcaaaatctaaaatacccttagacacacacaactttccattcttctaagaatatatttgaaatacaaagaaaaaaacaacggaagaaatctttgtgaccttggtttgggaaaatgtttcttagatatgacacgaaaagtacaatccataaaagaaaagatggattgatctttgtagacattaataacttctgctttttgacagatactgttaagagaatggaaaaaaaggccacagactgagagaaaatatttgcaaaacatatacagaataaaaagtttgtatccaaaatatgtaaagtattatgaaaatttaataagttttctttaataagttcaataaaaacaaaacgattaaaaacaaggcaaaatatatgaacaaatacttcaccaaggatgtatgcagaaggcaaataaccccgtgaaaagttgttgaacgtcatttgtcatttcagaaatggaaattgaaatcaccgtgagataccactacaacatggaatagctaaaattacagactcatcatagatgtggagcacctggaactctctcatactattggtgggaatgtaaaatggcacaactactttgtaaatgtttgacagtttcttaaaaagttaaacttactcctaccatatgacccaactattccacttctagggtttatccaagacaaatgaaagcacacgttcatactaagacttgcataagaacattcacagcagtgttattcggaatagccaaaaactgcaaacaactccagtgttcatcaccaggtggatcagatggatggataaacaaattgttgtatattgggccaggcatggtggcacacacctgtaatcccagcactttgggaggctgaggttggtggatagcttgagctcaggagtttaagaccagcctgggcaacacagtgagaccctgtctctacaaaaaatacaaaagattaggcaggtgtgacacctgtagtcccagctactcaggaggctgaggtgggaggatcccttgagcctgggaggtcaaggttgcagtgagtcatggtcatgccactgcactcgtgtctgggcaacagaatgagaccctgtctcaaaaaaaaaattgtggtatattgatgtattagtccattttcactttgctttaaagacatacccaagagttggtaatttacaaagaaaagaggtttatttgactcacagttccacagggctggagaggcctcaggaaacttataatcatggtggaaggggaacaggtacatcttacatggcagcaggcaagagagagtgttacgtgaaggggatagagccccttataaaaccatcagatcttgtgagaactcactcactatcatgagaacagcatgggggaagctgcccctctgatccatccaatcacctcccacctggtcccacccttgacatgtggggattacaattcgtgatgagatttgggtggggacaaaaacccaaaccatatcaattgatgccataaaaaagaataactactgatacatacaaaaacacaattgaatctcaaaataatctcaaatttatgatgaatgaaagaaaccagaccaacaaaaaaaaaggaaagacaccaaagtacaatacatacacgtagtctatgaatccatttatataaatttctagaaaatgttaactaaagaaaggaaaacagatcggtggttgctcatgggcaaagtggggtgggagtcgaaaggttacaaagagagatgaggaaacttttagggatgatggatgttttcattatcttgattatagtgatggtttcatgggggggttagctacctaaaaacttataaaactgtacactttaaatatgtaaagtttattgaatgtcaattatttctcagtaaaactgtttatatgtatatacttggaacactaattggtagtcccttctgctctagttcctttctgaatcattagtcactcaataacaggtacatatgtgtatatataatatatatatgtatatatgtacatactgtttatatatgtacatactatttatatagtacatactatttatatgtacataaatatatataaaggtacatattatttgtgtgtgtatgtatttatatatatacacacataaatatatataggctaggtgcagtggctcacacttgtattcccagcactttgggaggccgaggtgggtggatcacttgaggtcaggatttcgagaccagcctggccaacatggtgaaaccccatctctactaaaaaaaaaaaaaaaaatacaaaaattagctgggcgtggtggcgcaagcatgtaatcccagttacttgggagactgaggcaggagaatcacttgaacctgggaggcagaggttgcagtgagctgagatcacgccactgcactccagcctgggcaacagagcaagactccatctcaaacaaacaaacaaacaaatgtataaaggtccatactgtgtacctttataaatacatatgaaagtacatataaatagtatacctttacactatacaaaggtatactgtatactaaaggtatatttatatataaataggtatatagtatacctttatatataaataggtatgtagtatacctttatatataaaggtataaagtataggtatatagtataccatatatataataggtatataggtatacttatactatatacttttatacatatagatacctttatatatgtatatatattttatatatataacatatgtgtgtgtgtatgtatatatatatatatatatatatatatatatatatatatatatatataaaaatagtatgtacctgttactgagtgactaatgattcagaaaggaactagaacataagggactaccaattagtgttgtaagtgtatacatgtgtgtgtgtatatccatatatatacatttggatatccaaatatatatgtatatatatttatctgtacattatttatctgtatatatacagatagatacatataaatagtatgtacctgttattgagtgactaataattcagaaaggaactagatcacaagagactaccaattagtgttgtaaaaactgggagatctaatgagtagaactttagcagctgtgggtacacatctcttcagcctgaccttcaaattgtgccccctaaatcaaaagataagtacaaagtgggagtccagaagatctaacatataaacctctttatcacatatctgagattgaataggatggccacatgggctgagacagcccaaactagcttagctgcagacaggttaagctagagaagttaagaaaatcattcagcagattcatctttgcttccgataaaaaaaggttgtttggttaatggtgtgggatagaaatgttgtgaaataatctgtttcaggttaggcactgtatcttaaatttaagattctaagtttcctaaataataatgcaaacattgatacatgtagtttatctccatctcaaaaccaataaataaaaataagagctgcagttgcttcctctgcaataggtcattacaagttgtctgatctctcagagccaccccttgataacaacataaagtttaaaaacctgcattagtattttttttgagaatttgcttttctgatcaagagtttgaacttttcaaataccacgaccatataatttttttaacatcatttttctgttgtagaacaacatagagactaggaatggaaagatttaaggtttccttgtctgcaaaagtggataatattagtacttacctgtaacaggttgattggtggccccccaaaatatatgtcaacatactaatcccaaaatccgtgactgttaccttacttggaaaaagggtctttgcagatgtaatcaagttaaggattttgagatgaaaagatcatcctgtattcctgtattattcatatggacccaatgacaagtttccttataagagaaaaacagagggagatttgaaacagacagaagaggaaaagatacatccaggaggagaaagacgtgtgaagatggaagcggagaatggagcgatgcgatcacaagcagagaacgccagcaactcccagaaactggaatagacaagtaagggaatcttgcttagagcctgaaaggaggctgcagacactttgatttccgatgtatggcctcaagaacttcccaagaatacatttctgtttttttatgtcaccaagtttgtggtaatttgtgagggcagcctcaggaaattaatgcacaacctcatagagcactaaaaatggagataattagtactacctaacttgtaaatttgctacgaggattaattgagttgatatattcggtatagtagaaaagtgccccatacctagtaagcgctccggaggcactaagtgaatttttatcaaaggaacgctaaagtcgaggcagccagttgttgatattattgcttttctggaccatgattggtggactggacatcataatgctggaaggcctgtcagattacgaaactgaagaaacgaaacaaaaccatgaggatggtgaaaaggtcaggaagaatgaactatttcatctgtaagtttcatttgagcccgaacgttctatgaaaggaacccatcagttctcaatgtatttgtctccttgcttctctgcacttgtttccttgcttctcttagttatttctatacaattccttaatccctaaaagcaatttagaacggaatgcagggaccacaggagaaaatgagttttattgcctctgatgggagcctaaaaccccacgaggctcccaaagggcggaattcccaagccaattcctcgcgtctatgatccacctgcaaaaaactacgattcccagaaggctttgggtccgggggcgggaagactgagctcagaaagaggtggactctaagagaaggtctttggtcgattacattgtccagagagggagtggccgcttgggcggattttgggagggatcagccttccaattggttgttattagaaagggggttggtacggcctgctggtgctggacctaggccgccgcggccggagctcaaatttcccgggccgggagcgctgggcctgccgggaaggcgctgggacggttacccagcgggccgccggcggtcgtgggcaagcttcgccatgcagagcactgacctaggcaacaaggagagcggcaagatatggcaccgcaagccgtccccggccacgcgggacgggtaaaggccgtggcgggagggcgcgggctgtggaggggatggagaccggcgaggaggggacgccgggcgtcaggcagcgttccgggttctggctctgaccttgccccgcatccctgggttggatgacctgcggtggaacagatggctccggacgccagggtccgcagagatccccttctgagttctgggagcgggggtctggtccgggacagcgcggagcaggaggaggccggtggttctcagacctgggaacttgcggcttttgctgtgtaccgggactctcctgcttttatgatcacggtatcccgctagtgtccctggcacgtagtaggtgctcagtgagtatttaacagttgcagctggagcagaactccaggaggagatgcggggtggaagagcaggacaattctgcctcttccaaaggctgcagtttatccatccttaaatccttggatgtgtttagacgcacaagcattcatcaactatttgttgagctcctactgtgtgccaagcacgcctctaagcgctggggacggcgatggaacaaaacacacttccggttctctggagtttacatatcggcgtgtatgtaggggctggggcgttcattatgcattgctggggggcttctagtacggccagcgctgcttttcattctgttcccagttacctgtcctgtttgaggctcagcctgtcttgtttccctggaagcctttgctacaaagcggtgccatttggatttcgatttctgcacgcagagtgatcttattgctcctaattccctaggatttcacggaaattgcttgagttcctgtttcagtgtgtttcttgttctagcagtgatttttcttttctttgagacggagtcttgctctgtcgcctgggctggggtgcagtggcgcgacctcggctcactgcatcctccacctcccgagttaaagcgattctcttgcctcagcctcctaagtagctgggattactggcgcgcgccactacgcccggctaatttttgtatttttagtagagacggggtttcaccatgttggccaggctggtcttgaactcctggcctcaggtgatccgcctgtctcagtctcccaacgtgcagggattacaggcctgagccaccgcgcccggcctctagtgatttttctattgatcctttggttgcttcttgacaaatcagaattttttttttctcttgagacagagtcttgctctgttgcccagggtcggatgcagtggcgcgatctcggctcactgcaacctccgcctcccgggttcaagcgattctcctgccgcagcctcctgagtagctgggattacaggcgcaccactcccggctaattttttgtatttttagtagagacggaccgtgttagccaggatggtcttgatctcctgatgtcgtgatccacccaccttggcctcccgaagtactgggattacaggcgtaagccaccgcgcctggccgacaaatcagttttaagtgcctactctgtatatccaaagtgcgatgcgagacgttttaccagcagcttgtttggttcctggttactgtcaggcctctttatcaatgccgctgcctcaactacattgaataaaaaattttctctaaagtggggattcctcaagtttttcattttcaaattctgagtttgtgtgaataccactcccacctctggtattctctaaacattctaaaagttatagcccactcgccttctctttcttgatgatacaaaatatctagatatatgtgcaagattcaaaaagtgaaagaaatgggttgattatccaaatgtcttgtttgcttcttccactaaagcatagcttatctttgtgttcgttaaaacccattgttcatgctgtttagacgggcagagagcactgacttggagtcagatgtattttgttgaagtaaatgtccgtttaccaactctgtgaccttggggaagttaatcactaaggctgtcagtggggagaatcagatttaccagacaggttgtcttacacatttggtgctcagtaaatatttgatattcttcttgtgtttgagaactgaggaactctgtcaggcaatctgtgagaatctgaaaggaagttgctctaaaataaattttttacgtgtgatttatatgaaaaatcggaggggcagaatgtcactattgtgattacatctacatggtaggattataattgagtatttgtttcttagtgtatttctatatttttcatattttgaacaatgattgtgtaattttgtagccagaacatgtaataagtgttctagaaaataagactggaggaaaaagttgtttgctctgagtttagttgccatgaaacattttgatattgcttgtcatttctgtatgtttatttttgtgtttttaattccttggggactagataaaaataagcattgttaagaattttgctatttcctttagtgagtctaaaaagccttatgtttagatacacatggagaaaatgtttaatccacttaattcaatttagtatactttaatgaaattataatgaagatagatgtttctaatataaaatccaaaaactaggcaaggtgcagtggctcacgcctgtaattccagcactttgggaggccaaggtgggaggatcacgaggtcaaaagtttgagaccagcctggccaacatggtgaaaccttgtctctactaaaaatacaaaaaattagctgggcatggtagcgtgcacctgtaatcccagctactcaggaggctgaggcaggagaatcacttgaacccaggaggtggagattgcagtgagccgagattgcaccactgcactctagcctgggtgacagagcgagactccatctcaaaaaaaaaaataaaacaaaatccaaaaatttatgaaaaatcaattaagataaaattttcatgattaaaaactattgttgcaataaagaatgggattattctgatctttgtgacgagaatatacgcacatatattattttaaggagttattttgtgctgtaagttaattttataaattttctttcaacagatacagggtatataatccttctctcaaaaagggtaactttaaacacatgtattcttgtctttcctgttatgaaaatagtatgtaatcattaaataacatgtctaaaagatagaaaagtagaaaggggaaaaaaattaaccatattgctattacctgcagacagctgctgttaatatttagctgtattcatctttttttccctatacgtatttttcttttcctttggagacagggtcttacagtgtcacccaggcaggagtgcggtggcatgatcatggctcactgaagccttgacctccccaggctctagtgataatgccacctcagactcctgagtaactgggatcacaggcacatgcaccatgcctggctaattttttgaaatttttctggagacgtgtttggttttgatttttcttctttattttttcttttaattgtgtgtatgtgtgtgtgtgtgtgtgtgtgtgtgtgtatcagtgtttaaaacttcaggttagaatattttcgttttcatttaagtttaatcattacatatgtgtctccagaataagattgaaaaataagctcccttactgttttatatggcagtatgattaatgtgggttttaaagaatgatttcttaaagcatttgttcattcagcaggcatattttgagtgtcttttgtgtgttgtaggccaggtgctggggtacagtaatgagcaagcagtggtcctgtccttacagaactcgcctgccagggtattcatggtagatacattagaaatggaagtaaaactcatgcacgcgtaattcactgtgaaacattccatacacaaaaacaaaatctcataccctgttgttatcacttaatcacagtttataaatctgtttatatgtgtgtttatttttttaatatctgtccttactactaaattgtaagtgccatgaaagcagggaccatatcaattattcttagcacctggcttgttctgtgtctgacacagtgagttttcaagtatttgatgaatgaataaacagtagctattttgataatgagtagcttctgacctgtttttctgaaatcctggtaagattgattctagaggagcgggggtatagcggtagcagtaggagagggaagaatgaacagacgaaatgctttacttgccatatttttcataatatcaagtaatacgtgacatagattcaatgtttgggtttttttctttgacagaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggtaagcagataccattgatatctacgttctttaacaagttattaattcactgactgttttcgtacctgctattcattattcattcagaaagatttattaagttctattatatttcaggtaccttgcaaaatactgtcataagtgctaaaggacgaaagtgggaaaaaacagaatgataacatggttcacattttaaagaattaaagtgctggttttaatagtatctctagtagtttccttttttttttcttaaatttaaaaatttattattgctaatttttttttttttcttcagacggagccttgttctgtcgcccaggctggagtgcagtgggatgatctcagcttactgcaaactccgcctcccaggttccagctaccgcacccagcccatagttgctagtttgtcaatttctggtacatcatgaggcaatgtagaaataacacagttttctttgcacattgttgttgtggggtgccagatctaagaattttaaagaattgattttcagctgggtgtggtgactcaggcctgtgatccagaaatttgggaggccaaggcgggcggatcgcttgaggtcaggagttcgagaccagcttggccaacgtggtgaaacactgtctctactaaaatacaaaaattagctgggtgtggaggtgcacgcctgtaatcctggctatttgggaggctgagacaagagaatcacttgaacccaggaggtggaggtttcagtgagccgagatcgtgccactgccactgcactctagcctgggcgacaaagcaagactccatctcaaaaaaaaaaagttggttttcactcttcttcctcttctcttcccttgtgaaacaatttagtccgaaagcaattaggtgggattgatggagataggtattcatgcagcggggctaagagggaaggacagctgcagcagcctagcagagaggcagagggtgtctgcatagcgaatggggcagtgatgggaagctagtttaatacagggggctttgatcaactaaatatattagggataatgagggccaagtttctcactcttagaaaagagacttacatatatggagggcagaaaactagaataaaccccatggtattgtattggaattagatatatcagtttgaacccctggttttgaatatatagagatagatatagcactaaatagaggtatgtacacatatatgtacacattccctagcttcgtacacccagagggcctgggagcaacagcatgccagcagcaatgaatatacccggtgttgagttcttgttttcaaaataccactttctactaaaaagaatcaaggatatttgcaaaaatggccaatttcagaatgcagacagggaaagtacaggatgagcctgtaacattttgtagccagaaagaaggaattgttcaaagaatgttcgggatgtgtcaaaaagacacagttgccagcttgaaggagctccctctggtcatattggagatgggtcatgcattgaataaaattgaaatctatgagttcatgttgtaaccagtatacaaacagtttagtaaggcatggatattgaatagtcacaaagtacccccccacaaaatacttattaattatagaagaaaaaaaattatacaatgaagaagcctagcaaacactgccttaatcaaatgactaaagttaatataactagtagtggaatgaatcaaaatttgtgtgccacctgataggatgcagtgaaaagaacacggcatcatttctgtgatattcctcccaagatatataacctgaatctaatcagtgggatcatcacacaaagctaaattaaggacatctaataacaaaactgtgctgatatctctacaagggacaagatcatgcaagttgggtaaagactaaagaactcctaatctgagggggatgaaagggacatgacaaaggcatgaatctggactgatccttttgctataaagaacttattaggaaaattggcaaaatttgattggagttttaggattagatggtggtaatgtataaatgtaatttattggtgctgatggttatattgtgattatgtaggagagttttcttattatgggaaacttgatcttggtaacttaaatagttaaagaaaagatgtgacatataatttacttctctgtgattcattaggtaaaaatctgtaaatcattgtttctgccctttaccaaaaaagtaatgggcccaacttttctaccctttattcttgcttaacttacctcaccaattcctaatcttaaatcagtaccactgtctatttgctaatacttctgaaaaaaataaaaataattgttgattgatttcatgactaatgaacttcaacatcgaggactctttgcacttcatttgcttgtctacggttacttaacgtttcctattctccaccaagtgttgcaaacctttaccaatttccttgtctccttgcattggactctactgttattctgactgccaggcctcctgattcatgggaaaatagataccttcaagctttcctttctccttccccattgcagcctcaagtatattgtaagttcagcccccattaccttattcataaagttcagccctcattaccttattcataaaaacaggtgatcttaatttcttctagtgctaatccctatcttcgatagcctctcctgagatattgcaccataagtgttactattttgtccattcccttttcactgttggttgttggggagaaaaaataatttttcctctacccttctagattctcaactggacccttgtaacaaaagatagattaacaagagaagaatgaataagttattaatatctatcatgcgtgtaacacattagaatacccagagtatccaggtattagtatgagatgttatcaacttgtgtcatgcatgtaacacgtgacagtatccaggtattgctaactcaaaaagtggcttatgctctggcttatatagcatcttcatcaaagaacaatacatttttagagaagtgacaagacaaaagaagaggaccttgagtctctaggggcagcaaattgtgggaaggcaaatatatgggaaactaatggtagttatatacatttctctggtgctattttcagggtgataaagatctaaagtcaactcctgtgatcaaccgttgtccttcctggtagagaagggaagagggacccctttgtaaatgtatgcaaatttatgtaaacttttagacaagagcagagagcttttcttttcttttcttttattcttttttttttttttttttttttttttgagacggagtctcaccctgttgcccaggccggggtacagtggtgtgatcggctcactgtgcaacctctgcctcctggtttaagcaattcttctgcctcagcctcccaagtagctgggactacaggtatgtgccaccacgcccagctaattttttgtattttagtagagacagggtttcaccatgttggccaggatggtctcgatctcctgacctcgtgatccgcccgcctaggcctcccaaagtgttgggattagaggcgtgagccaccgcacctggctgagagcttttcttatatctgctttttctcatttacctttagctcaaagtaatccttatgccaaagtgggatgttcgggatggcatattctgccacccttcactaaaaacatttgtggctgagcagttagcagcagagctgggacttaaaaatcagacttgatcataaagcccagtatactgggctccctaaaaatcttcctaattgttcaatccattggtcacttttcagttctcattttactgaaacagtaaatactcttgtcttcccatcctgcctgaaattattttctttggcttcatggtacagcttttgctgaattttctacctctctgatcatttttcccccttattttactgactcttcttccagtgccttcccctttcatgttgtgctccccagacatctttctttggcttacttccttccatatttcaggtactcttttcgataatcacatcaccaccaagcctcaggcttcatctgccatgtaaacactgttgacttagacctacttctgctactactacctactagaaatcttctagattgggctcccaggagccactagcttgcatgtaagtcttgagcccttgaaaagtgattggtccaaattgagatatgaagcacatgtaaaattaaaatacacagtggattttgatgacttaatatgataaaaagtgtaaaatatctcaataatttttaattgattaaatattgaaatactaatgttttagacacatattgagttcataaagtatattagtctgttctcatgctaataaagacatacccgagactgggtaatttataaagaaaaagaggtttaatggactctctgttccatgtagctggggaggcctcacaatcatggcagaacgcaaaggtacttcttacgtagtggtggcaagagagaaatgaagaccaagggaaaggggtttccccgtataaaaccatcagatctcatgagatttattcactaccatgagaacagtgtgggggaaactgcccccgtgattcaattatctcccactgggcccctcccacaacatgtgggaattatgggagccacaattcaagatgagatttgggtggggacagagccaaagcgtatcatatattatcaagattaattttacctgtttcttcttacttttctaatatggctcctagaaaaatttaaattacgtatgtagcccacgttgtatttctttcagacagcatgactctagatgagtttcacaagggccttaaacaacatgtttaaaagcaggtttattatttcctacccccaaacttattcctcttttgcctaagttcaaaagcttaattttttgtaaattaaactccagctaggtgcccagtactctactgagcactcaacatgtattctttcatttagtcatcacaacagccctgtatctattcttatcttcattttacgcaagatcgggtcctgattccctcttcttcactccatgttgaatccataccgaacctctgcttggcttctgaaacctctcctatttatgctcccatatctctggctgagattttctgtagtaactttcttagtgatctcctttattccttgtccctctatccatttgccattgctgccaggatcgtcttcctaaaacacatacctgattgtgattctgctgtgctaacacttacagtggtttcctattctgataacatccaaactccttaatatggcacatagcacccttcataatctatttttggcctaaaatggtagctcatttttctgggtttcattttcttcgtctctacggactccttccacatggaatttgtaattattggaagaatttgtgatactaatgcaatgatctcttaataggttcaatcttgttcagcgaacagcacaagcttgcacagctctggcctttaatcttcgtaggaaatctgaattccttgtggcattagctgattattctattaaatgttttgatacaggtaagaagttctcctatttttcttttgaagcagagtaaaatataaactgaagaactgcaagaactttatcactctgtacagcttgagggggcagtccccatgacagccctcccttcagacactaggtgcaagctgagggtcctagaaacagcctcactttagatcagttgactacaaagtcagggtttcctgactactgtcaggtttgataatttactagaacaactcacagaactcaggaaagcactacacttaatgacagttttaatataacaaaaggatacaaagtataactagccaaaggaagagaaacatggggtggaatttgggaggcttccaaaagggaagcctccattgtcctcagggatgcattgccctctcagatgacactcccagcattggtgtgtggctggccatctgcgccaagcactgttgacgcagggagtcgacccaagctttggtgtttttggtgttttccctaccaagctgttttctctgcttacaaagatacacacaagtacatcagaatcaagtttaaaaaccaaatgtattatcagtatctcacactgataaacctgttcctcctcatgtatttattatttttttttattttttatttttttagagatagggttttgtcatgttgcccaggttggtctcgaacttctaggctgaagtgattcacctgcctcagcctcccaaagtgctgagattacaggcgtgagccaccgcccggcccctcctcatgtatttcctacctccgctaacagtatcaccatctgcttaaataactaagctggaaccactggagccttcacttctcttatatctcaggacatcaatttgatcactaatattttttgtttttctccttagtagctcttggatttgttcttttctccattgcctctttcttagttgaggccctccatatctcctgtctgaattattacagcaacatataaattagtctttcttgttcaatctcttcccctccaccagatatcctcaaagtgctctttctaaaacatagactagatatggtactcttttacataaaattacctgcaagagaaagcccaaactcactagcatcaattttgaagttattcttcatcaaagcctttgtcagccttgtctcctacatgaatgagatgttgctaacatgttccgtcatacactttatcaactagccacaagcttccatttttgtggatattaatggaggtgcctcatataatacctaaccacccattgcatcagttcatctatggtgtttatatgtaatgttacttctagacgtacagtgttttacctgggtaacaattttactttttaccacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggtcagtgagggggtacatcttggtctgttgtgcttctcgggctaatttcttggtcaacaggatgtatagatgatataagagtaatgattcactttgtccttgtagctctgtaactcagcaacaagcaaagcaaagtggccaacacaaagatgttgcctatagctacaatttataacttagtgagctcttttctaaaattatagctatgtaacttcaactgtcctaaggcgaaagttatttagttgattgcttttgttttcatttttaaccctctgacattttattatgaaaaatttgaaacatgcagtagatttgtgagaatttttgaacacgtgtacattcagtatctagattctaccattaacatgttactgtactatcctttactctactttacatggtaccatactctcttatgggtctatccatctttctttttttttttggtttttgttttgttttgttttgagacagaatctcgctctgtcacctaggctggggtgcagtggcatgatctcaacttactgtaacctctgccttacaggttcaagcgattctcctgccttagcctcccatgtagctgggactacaggcatgtaccaccatgcccagctaatttttgtatttttagtagagacagggtttcatcatgttggccaggcttgtctcaaactcctgggctcaagcaatcctcttgcctcggcctcccaaagtgctgggattacaggcataagccaccatgcccagctgtgtgtgtgttttaaagtaaactttggtcatcagcatactcccctgtgaatacttaagcctgtacttaattaactaggggtcaatatttgttgatttaaaatttatatataatgaaatatgtaagtcttaagtattcatttgttaaatttgacaaatacacacacctgtgtaacctatgcagctgtagcattacattatcccagaaaattccatcatctccctccctgggtgaccaccactcttacgttttcccaccatggactagtgttgcctattctaaaatttcatataaatagaactatacaataatagtttatgtaaggcttttttcactcagcataattttgtttgtttgtttgtttgagatggagtcttgctttgttgcccaggctggagtgcagtggtgtgatcttggctcactgcaagctccgcctcccaggttcacaccattctcctgcctcagcctcccaagtagctgggactacaggtgcctgccaccaggcccggctaattttttttgttgttagccaggatggtctccatctcctgaccttgtgatccacccgccttagcctcctaaagtgctgggattacaggcgtgagccaccgcgccgggccccactcagcataatgtttttgagatccatccatattatatttattagtagtttgttctttcttattgctgtttagaattccattgtgtaaatataccaccttttaaaaatccatttcttttgtttttttccaactatgtagaaacatatggtatataggcctccagttgtactcttgttctgagccccacagatgccccagtttggttctatcatttcttttaacagacaagccacataaccaacctctctgggcttccgtttcctgagcaggaaaatgggtctgtggtaaccaccttaccagggctggtgagaaaatgagataaaataaataattcatgtcaacggcttggccgagtgccaggcccttatatagtagctcccattgttattttgtcctttatgtcccctggctgtcatctcctgtgatttcctatatgacatccaaactggtctctttcatagggtttccacgctgctacccctcctccctccttaccacacccagtaaccttcccattctctccacctagtcaaatctaaccctttcttcaattgtgataatagttactgaagcatttactatgcttcaggcattgtattaagaactttccatacattatctcaactcagtcctgacactgcctcaatgaagtaggcagtgtttattgctccccaaacacaaagacacggggtctggagactggaagcactggcggctgcaagtgccagagccggcagggtgtgaagccagattggaggctttctgcagagtcaggcctcccaaatcctgggatggagtcaaggagcttttggctgtcccacccttttggtagtgccccggtcactcttcctcctccaagtccccatatccaagcctgtcatatctcttcagctctaggggcctgtctgtgacttccaccctaagggagctggcactttgtgtcatgctacattgtccacatcaccgattccccctccctctctccccttccttcttcctccctgttcttttttttttttttcctttgcaacggaatctggctctggcatccaggctggagtgcagtgacacaatgtcagctcgctacaacctctgcctcccagattcaagcgattctcgcctcagcctcctgagtacctgggattacagtcgtgcgccatgacagccaactaatttttgtattttcagtagagacggggtttcaccatgttagccaggccggtctcaaactcctggcctcaagtgatccactcgcctggtctcccaaagtgctgggattacaggtgtgagccaccatgcccagcctgggcacctgttctgtgccaggctttggtgttcaaaatgttagaagtggagaagtcagaggaagatggaattataggtctttcctcttcaaagctttctgtttggctgattttattcaaatgagcacacaggccctattcctcaaagccacttcaaatgtggcattgctaggttgttttagtccaaggaaggccgtctccttaactcccactgtcttttggttttcaggttttttttctttctatttcattagctaaatattattttcaggagtatctgagtctcttgtgtgattaattattttgcttcaggttgtattatgcatgcagtactgcttttaatttctaggttattaacatgaacagctagcaatgcatgtcaaccaaaaatttactttgtagtctccatggaaatcccagagttctttaatgtgcttttaacaattaaaaagagataaaagttgtgccagcttattcattagggatttaagccaaatgtcttttcttctttaatttaggccaaaggtcttttcttctttaattgctttagtacttacattttgaattttaagttccaaagaagagaacattgggagttgaacccacatggaaacagagttatgaaacaatgacacatgacacaaaagccatctgttctttttactatgaaattaaaatgagtatacgctgaatagttgccaacgcaaaccttgcttggacatttagacattttagtttaaaaattaggactgtggaaaatgtatgtatagtgtgatgtgtgcctaagtatattaatgttagtgctataagaataaaactaaatgtgaaaatgtatgtatagtgtgatgtgtgcatatagtaaattgctctaaaataataaaacaggaccgggtacgggggcttacgcctgtaatctcagcactttgggagtcccaggcggggggatcacctgaggtcagaagttcaagaacagcctcagcctggccaacatggtgaaacctcatctctattaaaaatacaaagattagctgggtgtggtggcacatgcctgtaatcccagctactggggaggctgaggcagaagaatcgcttgaacccgggaaacagaggttgcagtgagccgaaattgcaccattgcactccagtgtgggcaacagagcgagactcttgtctcaaaaaaaaaaaaatacaatacaataaaatacactatagtttaagttatcagcaaatttttcttaaagggccagtaaatatttttgactttgcagttcaagagcaaaattatataaccattcagaatgtaaccatttaaagccaggtacccagctactctggaagctgaggtgggagaatcccctgagccccagaattcaagaccaagatgggcaacacagtgagacccatctcaaaaaaaaaagtgaccattcttagctcctgggctgtacaaagactagagatgggccaggtgatgaccacttcagttgtaaacaggaaataactgtaaccttaatattaaagtaaaacgttcggtttttaaaaaatttttttcccctgacacagccctcaggagagcctgagaacatgtgcccctaaaaacgttaattcttaccaaattcttactaaactcatatttttattacagattctgattctatattttaaatagaacttttatttatttgtttgttttgattgcacatgcgacccttcagtaacttgctttgggtcttttgttatggatttcatttttgatggctcttttaatctcacacagtcttctactttttttctcatgacattaattttctggagagatcagacagaccagttatctcagaaaatgccccacattctggagttgttttttctgtttcatcattattgtttaatttgtctgtctttcacctgcattttctgtaaactagacattaagtctaaaggtttgagtagattcctgttaaacatttttgacaagttatttatcttatgtatgggaaaaaatagtaaacaatacaggttgaggattcccaatttgaaaatctgaaatcccaaatgctccaaaatttgaaattttttgagtgctaacatgatactcaaatatcaagctcaaaggaaatgctcattggagcatttaagatttcagattttcggatcagggatactcaattggtgagtataatgcaaatattccaaagtccaaaaaatccaaaacatttctggttccaagcattttgcataaggaatactcagccgtagcacctccctcagggttggtttcaacattaagtgtgataatctatgcaaagttagcacagtgctggttgtatagtaagtgcttagtaaaattgcatctgttgcaattttaccatcaagcctatgataggattatctcagtgcagttagataatttgcttaagctgtagggtggcaggcacatgggctcatgcctgtaatcccaacactttaacacgcaggctgattgcttgagcccaggagtttgagaccagcctgggcaacatggctaaaccttgtccctacaaaaaatagcctggtatgctggtgtgtgcctgtagtcccagttactcaagaggctgaggcataagaatcacttgaacccaggaggcagaggttgcagtgaaccaagatcacaccactgtgctgcagcctgggcgacagagtgagctcctgtctcaaaaaaacaaaactgtggagtaactgttatttattttttagttacattatattaacaattcagaaacccaaaagtatttaaataactcagtggcaaaatgcgatctgacctcaattcatttggcagcaaaatctgaactgaattgacatgaggctgaaatattaatatatttgagtatggggcattgccccaggtctcctaaagttctacataatgttatagaatatacatcatactacctatctaaaattggaaatctgcattctgaaacacatctggccccaagggtttcagaaaaggaactatggaactttgatttcagactgtttttaaagaacctaccagtctaacctctttccgctgatttttgtaagcagtaatagcagtaattattagtaatagtaatagatacccgttatttagtatgttccatgaaccttcattttaaatagttattttaaagctttaatcctaaagggtagatattattatccccattttacaagaagggaaaccgaagttcagaaatattaagtactttgtccagaaatattaagtaatttgttcagtatcacatagtttaggagagaattgcagtttgaattcaaacctgtctttatctaaagtcttactgcttctcaggtaaaccagttacacctcttcaaattagtacatttttattcttttgttgatgtttgggggtaagatattcagctcattagttaaggattttggaatccccgggatttgtgattactgtggttcagcaggtatcagaaaaggctttgtgatggatatcagaaaacatctaataaagagtgttttgctgaactcaattcagcctgtgtacccaggacactcactaaatactaaatatacaaataatacatttgaccttaacttgctaatattagtatcctaaactctttaaaccttgaaaaagggctgggcactgtggctcacacctgtaatcccagcactttgggaggccaaggcaggcggatcacttgaggtcaggagttctagaccagcctggccaacaagaccagcctggccaacatagtgaaaccccatctctactaaaatatacaaaaaattagccgggcatgttggcacatgctgtagtcccagctgcttgggaggctgaggcacgaggattgcttgggaggttgtagtgagccaagatcacgccactgcactccagcttgggtgacagagggaagactctgtctcaaaataaataaataaatcaataataaataaataaataataaggtaaaataaaccttgaaaagagttcatctacctcctaaaactgaattggaaagcttaggatttttgtgttctacaaggaaaaactacagctccgtccttgaacctaaccccccaaaaagtatactttgttaatgttttgaagtttttcctaaggtttttatgtttctcaagagatgacactatctaaataataatgacatgcttcattaggaacaattttataatcattaaaatatggcaattaaaatcacaaatctagtaatgaataatcatgtaggcaataatctatcacagttattctgctaaaatagcagttgatgctcattaacttttaagcttctgcttttcccagtaggaataaactttattacttttccagaaaaatgactgctaattataataataattttcttaagtcactttttgacatcagttttgaaacagtgttctaatgcgttcattatagattatagaaatctgtaaggccttcatattataaatcttcctaacagtgaatctaatagcaaaagatctaccacagattgtctttagcaaagtgagccaaggaagaagggaggagcttgatcaggcccttgcctgatctgtcagtatctgatgtagttgagttcgtattttttattgtcttattggcattaatcctgagtagattatttttgctaaccagtctgttctctagtgcattatatatgtgtgtgtgttgtacagatgacacacaaaattatattcaaggccactgaaacttttacgagaaaatattggttaatttccgttaataattttgcattaacaaaaggaagcattgtttatgcttatgtgatagaaaaatgaaaattaggagaataaagtgatgacattttcaactttactatcagtttcattctcagttgtccattaaatgaactgaatctgtaataagataggattatatatgcatttgcacctttttactcatataaaaaaatggcttaacacttacttatcctgaaacactttgcccagtattcccaaaggactaacttttttttcttgagatggagtttcactcttgttgcccaggctggagtgcagtggcgcaatctcagctcattgcaacctccaccctccaggttcaagtgattctcatgcctcagcctcttgagtagctgggattacaggcgtctgccaccacacccggctaatttttgtatttttagtagagacggggtttcaccatgttggccagactggtctcaaactcttgacctcaggtgatccacccacctcagcctcccaaagtgctgagattacaggtgtgagccaccgtgcctagccaggactaacttttaaaagcaaactgactaatttgggaagatatatattttaaggctgttgacacatatcatataacatctttaaataatttttactcccagcggcagtgtatgacagtgcctttttttactctatatatagtatatgtagaactatatactaatataaacactgtattaaatactaactactgatagatgtttaaaaaatatcaaatgttggtgaaagtatagggaaaagacactgtcatacactgccacggggagtaataaatacatacaccccattttgtgggagtaatatatatagacaaacaccccattttgtctatgcatgtatgtgctttctttttgaagacagagtcttgctctgtcacccaggctggaatgcagtggtgcaatcttgacttactgcaacctccacttcccaggttcaagggattcttctgcctcagcctcctgagtagctgggactacaggcacacacccggctaatttttttttttttttttttttgagacgaaggctcactccctcacccaggctaaagtgcggtggcggggtcttggctcactgcaacctccacctcccaggttcaaacaattctcctgtctcagcctcccaagtagcagggactacagatgcctgccaccatgcctgagtaatttttttatttttaatagagacgaggtttcaccttgttggtcaggctagtcccaaactcctgacctcaggtgatccacccgccttggcctcccaaagtgctgggattacaggtgtgagtcactgcgcctggcctaatttttgtattttttcgtagagatagggtttcaccatgttggccaggctggtctcgaacttatgtcctcaagtgatccgcctgcttcggcctcccaaaatgctgggattacaggtgtgagccaccacacctgaccaatgtgctttattttaaaagtaaaattgatactcaaaattatatcttgttttcatttaactctttagtaatattaggtgaaattttttaaactgtcatttagaattttgtgacttgcctagtcattatagtgtacctagttttcgtttgaagggttttttttttagttaataataatttatgaaataatcagtattactccttgtcatatattagaaatgtattttccccagcttaagaaaataatattttaataaagaaaaatagactacttgtataattttaaatttaaagtctctatgtgaaccttatgtgaaaactaactttctctattcctccttaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccaggtaatgtgcattttaagacactaggaatatttaagaaatttaatttctggtaaaaaattacaaattttcatttagtttttattcagtatctttttgtcatattagaaaaagttaccttcaaatttagatatgatctgctaactttttttattttgcaaaatatcaaatatacacaaaaatagaaaaatacatgaacccctaagaatttcttctttttttttgtttgtgtgtgtgtgttgttttatttataccagcctttcctccatcagaaccactaaatatttccataagctacaataatcatcaacgaatggccatttcttttcttttcttttttttttaaatggagtctcactctgtcacccagactggagtgtagtggcatgatctcagctcactgcaacctctgtctcccgggttcacgcgattcttctgcctcagcctcccgagtagctgggattataggcacgtgccaccatactggctaatttttgtatttttagtagagacagggtttcaccatgttggtcaggctggtctcgaactcctgaccttgtgatccgcccgcctcggcctcccagagtgctgggattacaggcatgagccaccgtgcccggccatttctatttttatcaataacttcacctacttctccaatgcattgtttgaagcaaaacctaagcatatcattttatccataaatatttcagtttatctctgaaagataagggcgcttttggaaatataaccatagtattatcacactttatttatttatttatttatttatttatttatttatttatttatttttgagacgaagtctcattcttgtcccccaggctggagtgcaatggcactatctcagctcactgcaacctccacctcccagcttcaagcaattcttctgcctcagcctcccaagtagctgggattacaggtgcctgccaccacacctggctaatttttgtatttttagtagagacgggggtttcaccatgttggccaggctggtctcgaactcctgacctctggtgatccgcctgcctcagcctcccaaagtgctgggattacaggcgtgagccactgcacccgacctattatcacactttttaaaaattaataagaatgtcttaatattgtcatatatctagttattgttcaaacatccttgattggtctaataactggtttttatgattgatttgtttgaataagaagcaaaacaaggctcacagattgtattttgttgatatattcgtctttttttttccttatagtttattcattaaataactggtcatttctcctctagagttttctatattctggattttgctcttgtcttcatgtggtattgtttaatatgatcctctgttacctgtatttttcctgtatactggttatacctgtattttctaaaaactggaggcttgatctgatttaaggacaagaagacattataggtggtttgtgtactttcataaggaacaacatagaacagttttcttttgtgacgtcagtagccattagtgatcattccctagatctagtactgccttagaagttagcaaaatgctgctgttctaattctctcatttcttcttcacttattagttaataaccttctatagaaagaaacttcctctcatcaaccctttggttattttgatgtacagttgtaaaggaaaggcaggataaatgcttaattttcccctcttttttcttaaactagtttttgaagtaatgaattggtttattagcatctttcaaaagtggctaatgaagatttttgtcttgaatctttgtaaactcataggcttagagtagttgacaagttttaatacattgcagctgtcattcttagagatgttccaattctctcatctttgactaataggatcctcttttcgctgactttggcatccttttactacaactccagttgcctgtgatagctttcatgctttctggtatgacaagatgttccaagcttatcttgtacaattcccgccctaaccctggaatcagccatttctctaaagagtctgggttcttttttgggaaatggtatttcaagaccctaatccggatgctaggggttctcattttgactgggccaatcattgtttctagtcaggggaaagagttacaaaatagatgttaattcctctcttttctcacgctgttcttctaagtcatcagtaaataccatcaactcaaccaaaccatatagcaaattggtcaatttgtttttattcattgctgtggttattaccctaatccaagctaccctagcctcttttagactactataatagccttcttatttgttctccctgttttcaatctcatttcctatagtcattctctacacagcagataaagtggtttttataaatcagtaagtcagatcatgtcactttcctatttaacctccttcatcacttagagtaaaattcaaccccccacccctcatttcccctgaggccttctgtcacctggcctacgcctccctcgcttcatctcatttccttccttagtctgctctagccacatccgagtatagcagtgtactttcatatggcaatgcacttgagtatgacctcttacttacttttccttatatactaaccttattgctttttcagcacttttgtaccagccagtctggaatactgatcaggatagaattcttcctccaagtcatcccatgactggcctatttgtgtcattcaggtagcagatcttcctcctttcccagctttcatcaccttattttatagttctatatagaacttatcacctgctgagatcaagttcatttatttgtttgtttgccttcctctagaccagaagtcctgtaagagcaggattacttggcttgtgcagccttaactgactgtgtccatggcttctgggaccatacctggcttatagcagacacttgaaacataaccatagtattaccacactttttaaaaattagtaagtcctttacaagttcttgttgaatgagtgagcaacggccttgcaagtcaaaacaacttactctttttgtatcttattaaggtagctttctttgagcaggaaaaaagtttgggctgttttgtttttttcatatagccatgtaccaccaattctatatagctgtacgtgaaatatagaaagttggatagtgataagtgactttgagattatgctataaaatataagtgttatgtgaaaaacccacaatcaggtcattaaacaagtgtttggtaaactggtgccttagcacagtaggtaaaaaaaatatatactataaacctgagctgtccatgcaagtatttgaattaatacaaattaaataaaatttaaaaataaggtccttattaacattagccacatttcaagtgctcaataatcacatgggactagtgtgaccatattgcatagcatagacacagtacatttctgtcatcatagaaagttctgtcggacagtgctgctacaaacaattgaacccgtttttctttctcacttttttgtttatatagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttagtaacataaatgtagggcactgtactttttgagaaagaacgcatccgtctctgaactatattagctcttatttatttaacttacaccctggctgttacaataatttgaaattacaaatatgttatttttgtgaagagtctaggattgaaaaaaatttcaaaatcttgtattctttataccattgacaatttgctctttttataaaatcaacatactgtaaatttatattgtactttatggtttgcagtgtgctttagcatgcaatttttcatttgatccttaattctttggcataggcaggaaagatattctccccattttacagattataacactaacgaccagaaacattgactcgtcaacattcctgttaattgtaaggattaaagattggactagaactaaaatgtttttattgtgttgttattttatttatcttaactggttgctcactcctgtgaaacatgtttttattggtatctttccttagtttacagagtgcttcttccttcatcccccttcgcttattcctttttaagacttgagttctgtcaaaccttaactttcttgtttcaaatagactgtcgtggatcttgtattttaacagattagatatatgttttacatatatatgtatacatatgcatgtatgtatatatcatgtccattttacttactttttgattaggtaatatattaacatggttgaaaacataaaacagcatacagtaggaagtctgtcacgcctttctaccatttgtctagttgttcacctccccccatatccactgttgttatatatagtgttatgtttttcccattattttatacagccttgcaccttctattcttccagtttttttgttgttgttttgagatggagtctagctctgtctcccaggctggagtgcagtggtgcaatcttggctcactgcaacctccgcctcccaggctcaagtgattctcccgcctcagcctcccaagaagctggcactacaggcatgaaccaccatgcccagctaatttttgtatgtttagtagagacagggtttcaccatactggccaggctgacctcaagtgatccacctgcctcagcctcccaaagtgctgggattataggcgtgagccactgcgcccagtctaccttttattcttaagttggaaattgttctatatcagtgcagaacttctttctttttcacaactgcatagtgttgcagtttattttttaaaccagtctcctattggcagttaacctatttttagtcattttctgttacaaataatgctcactgaatgacttttcacaagtgtcatttcacacatcctctttgtaggataaaatcccagagttgaaatagtggcataaaggttatgtgcatctgtaatttgggtagatcttgcccagttgacttccagaggagttgcatcaactgcagatgaggggctttgtttcctacaagccaaccaacaggagaactttatagagtgtcacctccaaactgccttttaccatcttttgtatgataagtgacatcagcatttcaagcaatcacatggtggcatcacttaccagccactgccactgggaagagaacctgcacttagacaaggcagcatgggggtttatttgcttaaacttttttattacatttttttttgttttggtttggtttttggtttttggttttgagacggagtctcgctctgtcacccaggctggagagcagtggcatgatctcggctcactgcaagctccgcctcccaggttcacgccattctcctgcctcagcctcccgagtagctgggactataggcgcctgccaccacgcccggctaattttttgtattttttagtagagacggggtttcaccgtgttagccaggatggtcttgatctcctgacctcgtgatccgcccgtgtcggcctcccaaagtgctgggattacagatgtgagccaccatgcccagcctttattacatgttcttaatttttgaaattatgagttaaaatttaaacttttctctccccttaaaagcctagcttccctcctacccctccactacccttgcaactcacaaactctccattctccaaatgttacttaaaatatttgctgaaaacaggcagacagtggggagcctcagtgggagtgacaggtttgtgtgggggtagcagggctgttagctttgattagctatggaaagggtacaggaaggcaaaccctccaccctccttgtttctgatagccagtgtggaggcaaaagttgggaactgtctgtcttagtctgttttgtgctgctgtattggaataccacagactgggtaatttataaacaatgtaagtttatttttcacagttctggaggctgggaagtccaagatctagaggttggcatcttttgaaggcctttgttctctgtcataatatagtagaaggcctcatatgggtgagaaagggagggaggaatgggaggggacaagagggagccgaactcatccttttataccaaacccactcccacaataacagcattaatcttttcatgagggcagagccgtcatgccctaatcacctctcattaggccctatctgccaacactgttgcattgagcaagtttccaatatttgctgttggagagacgcattcaaattatatcattgtctaatcctctctgtcccctgtatatgtcatcagtgggcatgatctgcctgtgggaagggaagattcttagggcacctttccatagtctaccatgataggttccctcctggttctgattagagccagggcataatcaacatgagccataagttgtgattttaaaataggtaatatcaggccaggtgcagtggctcatgcctgtctgtaatcccagcactttcggaggccgaggcaggcagatcacctgacatcaggagttcgagagcagcctggccaacatggtgaaaccccatccctattgaaaatacaaaaattagccgggcctggtgacacatgcctgtaatcccagctactcagcagggtgaggctggagaattgcttgaacccagggggcggaggttgcagtgagtggagatcgtgccactgcactccagcctgggcaacaagagtaaaattccatctcaaaacaataataataataataataataaaataaaatatataatatctcactgagaatagaatttcctctaggtgtccctctcaaaatatatatatttatacacacatacacacatatacacacacacatacatacacaaacgttgcatacacgtaaagacgtgtatatagtaggactttcagacattgactatcacatgtttttaggaatttatattttttctctcttaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataaggtatgtatgatgaagtaatcaacatcagctttttataaacacttatatattatatcatcaagaataaaatctttatgctactatttctaacttacctggaacttatccatttttctggatatattttgttgctcttactcccaaagccacatctctggccttgatttctcacgtatgctccattcttaaattgctgccttcctgagggacatctccgtttgatgtctctcatttaggtgttactcattatctcgttcccaaaagagttctttctgcaattctctctcatgttttcttcccatctcataggctagaaaccttgaagttctatgacttcctatgcctttattttctaaatccagtcaatactaagtcatataacttgtttgtttttgttttgtttttgtttttgtttttgttttttgagacggagttttgctctcattgcccaggctggagtgcaatggtgcgatcttggctcattgcaacctctgcctcctgggttcaagtgattctcctgcctcagcctcctgagtagctgggattacaggcgcacgccaccatgccctgctaatttttgtatttttagtaaagatggggtttcacaatgttggtcaggctggtctcaaactcctgacctcatgatccacccaccttggcttcccacagtgctgggattacaggtgtgagccaccacgcccagcccaacttcttaaatttgaaatatctgtaaatgtgctgtctgttctccacttccataattgctatccttgtattggtcttcattaactactctggactaatggtaatttaaagaaatatcttaaactcagagccctcagtgcttgccctgcccatccttccatcttctaaaataattcatcatcatttcttaactagtgctactttagtggcttccttccttcgcctgttgaattaagtccagactcttctgcctggctctcagtgttctctctaatcttgtctacctgtctaacttatttcctcgaacttatagcttccctcattatccccatagacaccatccttatttctgcatctattatccacaccatccatttcacgaaaatgcatgcctcacttctcttctctggttatctaaaattcccccagctaaccagtcatattgtccgtgtgtcttccagtctgaaattgcaccttggtagctctaacagagactttgatgatcacctggtctaaccctttcattttacacaggaagaagttcgtgctcaaaattaatcacacagcgagtaactagcagttctgggtgttccaattcttccaagattacatgagattgggtgcatttggagtggcgtttgccacctttttttattctaaaaaaaagtttgtgcctcctcctttttgttttatcttttaaaaaattatacaagtagtgtcttattgcagaaaaaaataagaatgtacagaatagcaaacagacaaatacaaatcactgaaagtctcaccattctcagaagattctgatttatatgttcccaatttcttttctatgtgtgtaaatatatatagtcactcctcattatttgtgcattctatacatgagaattcacctgctcactaaaatttatttgtaacttcaaaattaatagttgcagtgctttcatggtcattcagggacatgcacagagcagtgaaaatttgagtcaccagataccctttttcccagctgaagtcaaatgaggcaacactctgtcttcttatttcagctctcatagtgtaaacaagtatcctttttgtgatctacttaataccatttatttttttgcattttgaagctttttgttaagattctactgcttaaagtggtccccaagcgtagcgctgaagcgctatttattgtttctaaatacaggaaggctgtggcttaccttacagagaaaatacatgtgttaaataaactcattcaggaatgagttatagtgctaagctgtgagttcaatgataaggaatcagcaatgtgtattaaataagatgtctttaaacagaaacacacatatatgtattgattgattaatgaggctctcaggaacctgactctgtgtttcccctaggagcagtgtttcagtattcactaatcgagtgttcatggtgactttatagaaccactgcaaatagtgagaattaactatacatatatgtttctgtgtgtacgcacatgtgtgtgtatgcatacttgtctctaaacatatgggattatactctgctgctgttttgctctttatgtcattatgtatactatataagtatatttttacattataatatgtgctatatattaataaatttttttaaatgtattaatatctgctcttactgagagagttttcagcctgctgaatagtcagttttacagtactagctaaaccttcttttctttttttttttgagatggagtctcactctgtcttccaggctggagtgcagtggtgtgatcttggctcactgcagcctccgcctcccgagttcaaacaattctcctgcctcagcctccctagcagctgggattacaggcgcgtgccaccacgcccagctaatttttgtacttttagtagagatggtgtttcaccatgttggccaggctgctcttgaactcctgaccttggtgatccacccgccttggcctcccaaagtgctgggattacaggcatgagccaccgtgtccagccttgcaaaccttcttaatagaggcaggcagagagctgagaaaaactatggtaagaatgagtcattgagttcctttctgcttgttatctgttgagcaaattgatatcacatgaatagaaaagctagcttggaagtagaatgatcttttttattttttgacacattcccagtaccatcagtgtctttatggctgttccaggctacattaatgttcaattctatattctctataaatcataactcacctttgtctcatttttaccagttttattttcttgtcattggagaatttctggtattgtggtaatagagtaaatgaattcttaagtgttgaaggtttaacactacaaaggtatgtcaagtcaggttgtttctcaggttcttttttgggaggttatacttcatggtagaggataaggctcaaacgggaaattgtgacattttaataaattttaattttaataaaattttagtaaatttcagctctcatggtgtaaacaagtatcctttttgtggtctacttaatgccatttttttctgtgttttgaagctttttgttaagattttacttgttaaaatgttccccaagcgtagcattgaagcgctatttattgtttgtaaacacaggctgtggcttaccttacagagaatatatgtgtttttaataaaaatttagaagaatggattgaagtcaaaaaatagtttaaggatattaaatatgggtaatattcataagtcagaccactattaatcccatcccatagatgaattgaagaattgaatcataaactgtaaatggtcattgtgttttaattgtatttagaacttagaaagcctgagttaccttatttgctcacttcctttgaagaaggaagatcttttgatttcaaagagaatattgtttatggagaaaatgttctagtgagtaatgttactttaagtaaattgaagttgttcaggtttttttccgtgtttgatgggccccataaaaatgaaggtataggttctaagtcacattgtctgaactgcttaagctgttgatacaataaggaactaatagtgatcactaagcagattaaaacatttaaccaagggatagaggggcagaggttccatgcttctagaagaaagtcatttggcagtttcctcttagaaatttcacttgaccccaaagaatattagggtacttctgtcagaattctagagggccatacctctaactgtaccttttttgctgtagataataatcaccatactaactttaccatgtatgtgtaaacatgatttggtattaaatgatttaaggccagctttcaaggaataattatatttattgctattgttaatcatgtatctttattatgttcttcaaaaggattcagcagaaatttgctttgatttattagtcaaagcaaatgttcctagacattttacttaagttttttgcctgaagaataattctacatattaaggcatgttattaaagcaaattttgaaaatcatacattaacaggcctgtcttccaaggatatccattagaatatatatatatttatttttccatttagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaaggtaagaatatttggtaattaaactttgtcatgattctgctgtagacaagtcttgtgatttctaagccatcaccactcttctctctcttgggaattaaagaaagagaataaaatgaagagaataaagttgtaacctaaattatgcacaggctggtctcaatcctggcctcaagtgatcctcccaccttggcctctcaaagtgctgtgattacaggcatgagctgccacacccagccatatggcagctttgagaaagaaagaaaatatagctattaatagagaagtgacattattttcaagggatttgaaaactttttaatgacaaatataatcacacacatatacaaagtacacattaatatagagctcagtgaactttcacaaaatgtacacaccatgttaccagcacccagatcaaaaactggaacattaccatcagcttattgctccacgctctctctccctcacccccacccaccccagaataactactcgactgatacactgtagattaacttagtaaatactgtcagttttcctaagtggttgattgaaaagtagttgatttacatccctaccagcagtatttgagagttctagttgctccatattctcactaataatacctgatatttttcacattgattttaatacagtgtccttccttatccatggttttactttccatggttttgtttacatgtaatcagctgtggtccaaatatattcaaaggaagatttcagaaaaaacaattcataagttttaaattgcacaccgttctgagtagcatgacgaaatctcctgccatcttgctctgttccacctggcacatgaccatcattctgtctagcatagtcactcagtagcctcttggttatcagatctactgtcacagtatcacagtgcttgtgttccagtaacctttattttacttaaaaaacttctgtagagcacaaaagtactgatactgacatattgtcagaattgtgctattttattattagttatgataatctattgttgtgcctaatttataaattaaactttattataggtatgtatatatagggaaaaacataatatatttagggttcagtgttatctgaggtttcaggcatccactggggatcttggaacatttcctcgtcaaatcagtggggactattgtaacttcttttttctttaagcattttttaattgtaaaatttgcaacacagaagagtgtctaaaacagattacagcttaatgaaaagtaataaaaagattacacatgtatcctgtgtcaggtagctgcaagaccatccttaggtttgatgatttattaggactcagcatgtagccatattcatagctataatatattaaagtgaaaggatgcaaagcaaaatcagcaaagggaaaagacacatggggtgaagtccagaagaaaccaggcacaagcttccgggaatcttctcccactggagtcacaggacatccttgattcctccatcaatgaatatgtgtggcaatatgtgtgaaatattgtctaccagggaaatttattagagacctggtgcccaggatttttactagaggctggttctgtaggtaccctgttttaacaggtttcaaatttcagactcccagaaggaaggcgggcattaagcataaaccacattgtacaaacagtttaagcacaatgagccactctttattggttctaggggtggtgagaactttcctgaaattcaacttctagacaccagccaaaggctgaccttgcaagtaagccttctgagggtagcaggctcagaccggcttgtgttcacttttttctgcacatacccatttccacatgaagaaatagagcattaccgtagctttggagccccgtgtgtgcttatcccccatcacatttttctccctaccccatatatataaccattgtcctcacttttgtgttaattatgccgttgattttctttatagttttataacttcttcatgtaactctaaacaaaatattacttctttaaagaaaaaactgaatagcagacacaagcctagcctagttgtgtaaagactgggcaatgttgctcctatttaatgaatgctttaatgcaaagataagctgaatggtatctctgagatgttctggcttcagagtttgcaggaccttttctgggaaaactggtgggaatggtcatgagcaactttgggaagtaaaagcctcatcatgtcagggtatctggcagcattgtagtgtggatccaatgtggatatcctacagaaatatgtcaaggaatggagctgcttccaaggaaaccatagccagttctaaaaagtaggtcaaagtagaacacttctatggcatgaagtgcaagtcctcaactaatctttgcattagcacgtggaaagaaaagaaggaactttatcagctcatggccaagacaaggacaggtcaaattgaggccaaactccccagggcatctttttctttgtttaaaaagaagcttcaatggcagcaggtatcttgatgatgaagtcagtcttcctggatcatgttgctctcatttgttctagttgccctctatacctttaatatggcactcaagtatcttcattcaccatcatcttaggttttcccttcacccttctcttacattggactacctgtttcttcttgtaaaaagagcactaaacgaaatcagaaagtctggcttcgagtcttgagccaagatttagcagatttgtgaccataagcaattcaccaaacttctctgattttcccattttttcaaataaaggaagacatttcatctgtttcatatagttgttagatccagttgagataatatatgcaaacagctttataatcctaaattctataaaatattttttattaagataaaaattgactttaaagtcttagatataagggactatcagcaggagctgatgtctgttaggataaaatgatgaactcccacatgtttttctgccagacttgtccttgatgctttaatgctaggaattgcctagaattttaaggaaagagagaggtgggggaggagcggtcagagtggattgctcttgatgcaggagtcccagatgacagccgatgggcctaattcggctattcaagctaagaatggtttgtgcatttttaagtagttatatataaatatataattttgatttttcttcttggcccacaaaacctaaaatatttactaactggcctgtattagtctgttttcacactgccataaagaatactacctgagactgagcaatttataaagaaaggaggattaattgactcacagttccacatggctgtggaggcctctggaaacttacaatcatggcagaaggtgaaggggaagcgggcaccttcttcacaaggcagcagaaggagagagaggaatatgtggaggagagactgtcaaacacttaacaaaaccatcagatctcgtgagaactatcatgagaacagcatgggggaactacccccgtgatccagtcacctcccaccaggtccatccttcaacacgtggggattgtggggattgtaattcaagatgagatttgggtggggacacagagccaaagcatatcatggccctttacagaaaaagtttgtcaagcttgtttagggaaggtactatatcatgaactttattggctatgtatatgcatgctcaagagagggagagaggggagtggggaaaagacctatgatacacaaatatgtcttactatgtgttgttttctaaagttgggaagtcactgtggactagattacctttgtcaccttttcagttttaatgattgtgtcatttattaatattgtctttttctttgtagaatgaattaccagatggattaaacaaaaagcgtttacaaatcttattaaaaggctatggtgaatatccaacaaaatacaggtacaatttaaattctgtatgttacatcagttttactcaaaaaaaattggggggattaaaatatatttttatttcagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagaggtatgttctatatattgcagcaatgtgtatgagacctgtaactaataattgcaatgttataaaatctcctgtttataaaatattgttttgtcagtttgattatccttatgtgatatgttggtttaattttaaaaatgtacatgcacatatattacatgtgaatattagtttgtgttgtgttctagaaaataggactctttcagttaatctgaaagaacatcccagcactttgggaggccaaggcgggcagatcagctgaggtcaggaattggcgaccagcctggccatcatggtgaaacctatctctactaaaaatacaaaaattagctgggtgtggtggcgggcatctataatcccagctactcaggaggctgaggcagggagaatcggttgaaccctggaggcagaggttgcagtgagctgagatcacgccattttactccagcctgggcgacagggcaagactccatctcagaaaaaaagaacagaggcatagtggaaagagctttgaatttgaaggcaaaagacctagttttgaattcttattctaccacttaatgattgtgatgtaagacgtgttattttacttcttagccttaattttttttatctaaaagtgggggtaataacaccaacatcataagactattgggaaagttagatgagaatctcttttagaatgcatatgctagagtccattcctaggaagcatccagtaaatgttaataataacagtagctcatcctttaacctgcttttcatgtgttaggcacatttgacttataggtaaagaaactaaggcatagagagactaggaaatatgatcaagtcacagcagtgatagagctaagattaagcccaggttccagagccgaagactttttttaaaaataatttttattatgaaaaatttcaagcataaataaaaaataatgtaacaaatatccccatgcccatcacccagcttcaacaattgccaactcatagccaatcacgttgggtgaatattcccactcactctacaccccacatcccaacatacacacactccccttgctaaatatatacatatgtatccctaaaggataaggactctttttctttaacataagtacactatcatactgacacacaaaaaagaattaataattcttcagtatgttcaaatattcaatcagcattcctctgattgtcttaaaaattttcttatgtaaacttgttcaaatcagggttcaaacaacatgtacacattacatttggttgataccccactgagattaatctatagactctgatacctctttttttcttacaatttatttgttggagaaaccagatcgtttaacccatacagccctctatgttctgggttttgctgattttatttcatagtattgtttaacatgtttctctatctcctgaatttactataaactggcagttagagctaggggcttgatctgagtcaaggttttttttttcccccctttggtatttgtttctttcacttgcaagaaaacttcctaggtggttttatgtacttgttaggcggattataattaatacctggctgtctctcttttcgtgatgttgtccattgatgattattgcctacatccattatttcaccagagattagcaaaacagtgataatataattctgttccttctcattttataaaccgggaaatttctccaaagaaaaagttcttaggatcaactacttggttaccggaagatacaacccatgtaggaaaaggcaagttaaatgcttggtatctttttttttaaacagttttcagaatagtaaacttattaccttggagctccccagagcaatcagtgtattgattatgaactcagattgaacatatagaccttttcagtacatagaaccaggagttcatactaatattttcaattcagatttaagattacaaatttgcatagctgctttgattttatatttgtatttttttcttatgctaaaaatcttgatttctaacagcattgacataattccttattttctttaacacacatacacacacacacactcacacaatggtttttaagctccatatatttatgctgtataataaaaactatataactataaataataacaatgtgaatattatgattattgaaagcagtccaaaatatcttttatagttctttttgtccttaggttatatcccactaggcatatataatcaaattattgttttcatttttgtttttgttttttgagacagggccttgctctgtcacccaggctggagtacaatggcataatcatagctaactgtaacctcgaactcctgggctcaaacgatcctccccccttagcctcccaagtagctgctacaggtatgcaccgccatgcctggctagtttatttatttatttttaagtagagatgaagtcttactatgtggcccaggctcatctggatctcctgggctcaagtgatccttctgcctctaccaccaatgtattggtattaatgtattggtattacaggtgtgagccaccacacccagcccaaattattgttttaaaatgacttgaaataactcctcttcatatgataatgccactagctcactacacaggttaatttgtttcatttgttttcagttttttgaaaaatttttgtatttaatttaatttgttttatacttttataaaacatttacatgttttctaaatcaaatctacaaaataaggtacattcagaacaggctgacttctgtttcctttgtcctgttacttctcctcccaataagtcatccttttagcaaatatcttatttgtatttacaaatatgtttgtatttacctccttaggtaaatggttgtatactattacacttttctgtactctgctttttaaatttaacaacgtattttggatatcattttaaagcaatgtacagaaatattcatcttttttttatacctgcattatgcaccattatttatttggcctgtcccttaatgaacatgtagattattttcaatcttctgctgtcacaagcatgctgcattaattagtttggcccataagtctttttctattaagtgtatctttggaatagattcataaatgttagatgctgagtcaaagggtaaatacataatatactgcccttttcaattagagaaaacatcagataactttgttaagagatgacttagagatgggaatttgcttactttttctatttggtcttcacacttactatgcttcctgtctgtgtgtaagataacatcacagttcagacgtttgtcagaataccagtgtagactgtcagtgccttgcctttgctttttaggttcatattctaggttgagagccgtaaatatcttgggtagagagtgaagtctctcatcagatgccgaaggaattaaaagaggagagtacattacttcaaaaatgatgattttgtgcattcttctgaaataataaatttcctgagttcagaggacaaggtagaaaacattttctccttctgttgaccccctcactgtagggaatgaagaactgattttatcaataagtaaaagttactcaagtaactgtttaaggtatctaaaatttcttataatttttccgtatcctaggattttagactttctaaattatgaatgcttttcttgggtacttgttgatgcttcttccttatccccagtagtacaacttaaaaacagaatattttaggattttttcactctttcattaagttctgttcacattcacattaagagcaaataatactgctctgctttttgggaaagagtgaggtaacacttttaatatcatagtgtaagctataaatttgattaaaaattcaaattatcagagaaataattttgatgttttctacctaaatacagtgtatacatggggaccttcttgagatgtattttccaaaagatcttcctaaagtgacaagaggttgctcatatcatttgaagtttctcataaaatgtaataagctgttacgctttatatacttatatgcctactagtacatttacaattaaagttaccattgtaactaattctgtgtaggtgtactttaaattataatcctagtttagttaaagcttcaaagcaattttttttgttggttctgaaatttctgtttttctaaatttttaaatttaaattttacatttctgtttctactaaaattcaaaattgtaacttaaaagggagggattattctacattaaaagagatagagatttaagggcgataaccaaattcaatgagtgagccttttttttctgctacaaaaatggatcaatgaatgagtcttgtttagacaattggggaaatttgagtcttgcctgattatgaaacaatactacaaaataattgttaattttatttacgttacagtggtgttgtgactatataagaaaatcatccctcccccacttttttaaagagttgtagacttctgtattaaaagaataaagtggcatgatgtctgggatttgctttataatagtctagccaaaaattgaggggatatagtcaatgaaagaagtataataaaacatggatttattgttgtagccaggcgacaggctcatggggcatgatcgtgctttctagttttatatatgtttggaattttttgtgatacagttttttgttgttgttttctgtttgtttgttttttgttgttgttgttgttgttgagacagagtttccactctgctgcccaggctgaagtgcagtggtgccatcttggctcactgtaacctgcccctcccaggttcaggtgattgtcctgcttcagcctccagagtagctgggactacaggcaccccccaccacacctggctaattatttgtgtttttaatagagacagggtttcaccaagtttgccaggctggtctggaattcctgacctcaggtgatctgctcgcctcggcctcccaaagtgctggcattacaggtgtgagtcactgcacccggcctgtgatacagtatttttaaaagtaactttaaagtattcattttcaatgacaaaaagaatattccttctttgtaaaataattcaaacagtacagaagattatgaagaaaaaatcagcacctcttccagccccaatttgacttgctagaggtaattgtttggtttacttttgtatagatatttttgtatgtatataatgcaaaagtattcacatacatttaacaagaatggaatcatactatacatactattttgccgcttatcttcctttttactttcaagtctatcatggacctctttctctcagtatatgtaggtttacttctttctaaaaaatgcacatggatggatgtttcaggatttaagtcttcatcttgttaattgacatttaggttattttatgtttatttgcttttcagacaatattataataaataccctcataaatatcttgtgtgaatatttttgtgtagacttctagaattgaaactactaggtcaaatcattcattttttctttctctctcagaaaattctgccaaccctgggaaatgccagtgttactgtgttttcaccgacactggatgttatcagtctttatttgttgtcagtctgagagtcagtcaaaagatggcaactcagcattgaatatgtaacttctgtaattatgaaagtactatccttaggagaatatgttcttgtatttaggttgatttctagcccttccaaaaatgaggatttccttacattctctggaattccatgtcctaggctcagtaatgaagctaatccctccctcctggggttgttctgagtattgtatcgaataataaaaaatgtctgacatagcttattaactccattaactatgttagttctctattgctgctataacaaattaccacacatgtagtggcttaaaaacaacacaaatttatccttagagtttggtaggcagaagttcaccatgggttggatctcactgggctaaaatcagagtgtcagcagggccacattcctttctagaggctctggggagaatccttttctttgccttttccagcttctgcaggtttcccatatttcatgactcagacccaccttttctgtcttcaaagcacctctctaaccattcctctgtagtcgtatctccctctgaccgcaaccaggaaggggttctttgatattaaggacctatgtgattagattggacctacccaggtagtccaggattaatgccctcaccccaaggtgcttaacttaatcatatctgcaaaatctcatgtaaaataatatcttcatggattacagggattagagcatggacatcttttggggagggggacagttttcattattctgcttgccacattaactataaagtatactcagaaaaataatttatatttaaacagtaatgaaagggaattagccttaaaaatattaaaagctattataaagcattgaaattgctgctgacatataaatagatatgcagagtctaacaatagacccagctacattccaaaattgacttgtttttaaagatgtcatttcaaagtaatgaagaaaagataggttatttagtaaatgacatggaataactagctagccatctagaaaaagttgaaagcatacctcatatcttacaccatataaattctgcttgaactaaagatttaattcctttttaaaaaaacaaaaccatcaaagtattagaaataaatgtggagttagcaagtctgaaactactttatgtgtagaagccactttttgtatacaaatagctcaatagagacgagagccaggtttcttactctcagagaaagaagataaataagcaaaagggctagaatgaatcttgcagtagttgattggaatcgatagtgttagttcttaacgtatatgcagataaatagacacagaaaggaatatagatatgcatgtatgcaggagttagtatacatgcatatattgccaagctctttctaccgagaaggcctaacaatgacaccctggtaacagtgagcgcacctactggtgtggggaaaatacaagatgaacctgaagcatcttttagtgccataaagtaaggaaatgctctgaaaggatgggcatgtcacaagggcacgtgactcaacctaaaagtttccagtggccaaagctggaacaatttgaggaacaaaataaataacaatcaattataacttgtagaataaaataaatatccatgagttcatcctgacataaataattgaataaataaagatataaatgagggagaagggacagttctaataaatatagaaggaattagagatatagaaaatcactattgggacaccacggtgataattgttggaggcaagatccaccaattgatgctaaaattactggacaaaagttctaggagtgcctgggcacggtggctcacgcctgcaatcccagcactttgggaggtcaagacgggtggatcacctgaggtcagaagttagagaccagcctggccaacatggtgaaaccgtatctctattaaaaatgcaaaaattcgctgggcatggtggcatgcacctgtaatcccagctacttgggaggctgaggcaggaaaatcgcttgaacctgggaggtagaggctgcaatgagcccagatcacaccactgcactccgcctgggtgaaagagtgagactttgtctccaaaaaaaaaaaattctaggattcacaggatatttgcatagtcttaaaatatctcccccaagacagttattaatggcaaatggaaaaatagtaattttgtagtagataaactcagcagataacagcttaaccaagtaagcacatttaaaatcactagtacaccaggcgtggtggctcacgcctgtaatcccagcactttgggaggccgagacgggcggatgacgaggtcaggagatcgagaccatcctggctgacacggtgaaaccccgtctctactaaaaatacaaaaattagccgggcatggtggcgcgcgcctgtagtcccagctactcgggaggctgaggcaggagaatggcgtgaacccgggaggcggaggttgcagtgagtcgagatcgcgccactgcgctccagcctgggcgacagagcgaaactccgtctcaaaaaaaaaaaaaaaaaaaaaaaaaaaattaattgagcgtggtggcacacacctatagtcctagctacttgtggctgaaatggaagaattccttgagtgtggagattcaaggctgcagtgagccatgatagcaccactacactccagcctgggcaacagtgtgcaaacctgtctcaaaaattaaataaataaaatgactggtaataagatgtcaatatgatgcacatcacttttgtgatattctttccaaaaatatgtaacctcattctaatcataagtatcagacaaacccaaattgaggaacaatctagaaaataactgatattcctcaaaaatggcatcatcatgaaaaataaggaaagactaaggaactctcatattggaagaaactagagagacaaaacacatgtaatgttgaatctggggttggtgaaatgaaagaaataacggaaaaatgatatcagtggaaaaacggtaaaatctgagtaaagtccataatttagtgaatagcatgtgccagtgttaatttcttagtactgatcattgtactatttgcaagctgttaacattaggggaatttaggtcaaaggtatacaataactctactatttttgcagttttttttgtaaatctaaaactatttcaaaacagaaagttaaaaaaaggaaattaacagtacaggtattagaagtacatgtgggagaattataatcccagaggtaatgaaggcctttctgagtatgacatatccagaagaggttgataagaataaaaatctctacatgtaaaaataatttccaaaacaaagactcatgtaaaactgaaaaaacatatgcaaaacctgacaaatgaaacgctggtttctttaatgtatgaagcgcttatataaataaacatgtaaaggaccagccagtaaaaaaaaaaaatggataaacaatgtaatatacagtttacagtggtaaaatggttctttctatttattttagttttttgttttagagacaggatcttgctctgtcacccaggttggagtgcagtggtgtgactatagttcactgcagccacaaactcctggacctaggcaatcctcttgcctcagtctcctgagtagtaggcgtgtgccaccacacctggctaatttttaaaaattttttgtagagatgaggtctcgctctgttgtccaggctggtctcaaactcctgggcttaagcagtcctcctgcctcaaccccccaaaatgttgggattacatgcatgagtcactgtgcccagcctagaaatggttcttaaacatgaaaagatgcttaatctttctcatagaaagagtaatgccaattggaactacgttgaagtaccatttctcacctagattaaaggttttttaaaaatcattgataatatgcggccaagagtatgaaaaacaggcatccctttacgcgagtcataggaacgtaaatagacactttttgtgggggctaatttggcactgactttcgaaattgcaaatgcacgtattcttgactcagcaattccactttaggaatttccaagtctgtattctcatgtgaagaatgatacacactgtgtggcacatacagtggcattaagcacagcattgcttataaaagactgaaagcaaatgccctacgatagagatcatgttaaagaaatgaaggtggctgggcacagtggctcacgcctctaatcccagcactttgggaagctgaggcgggaagatcgcttgagcccaggagtttgagaccagcctgggtaatatagtgagaccctgtctctacccgcaagaaagattagccaggcatagtggcatacatacacctgtaggcccagctactcaggagactgaggcaggaggaccacttgagcctaggagtttaaggctgcagtgagccatgattatgccactgcattccagtctgggtgacagagcaaggccctgtttcgggaaaacaaaagaaaaaaaagaaatgaaggtgtatcggtacgaagctatcatatccatctgtaaaatgtaaggaagttctgcatatactgatataaactatttccaagataccattaattgaaaaatgcaaagtacagaacaatttttataatatactaccatttgtggttttttaagaaaggatttatacttttaacaatggttacttctggagaggtgaactagatgataggggtacaaggaagaattttcaccaaatatactttttgtatcaaatttttatcatgtgaagatattatttattcaaataaattttaatgctaagttattttattcacagaaccttatctgcattagctcactggtctgtcatttttagtgacacaccatatcttccactcttggcatttccatttgtaaaattattccagaacaaccaactcatctgttttgaagttattgctactctcataagtaagtaaatacttgttaaagtataagatcaagaatggattcttatacattttcctgatgtctttgcacctttgcaacatttaacaattctagatgtctctacttttaagtcacgaaagtgtgaaacaataaggtatcaaacataaaatagacaattgaagcatttatatgtaaacctttttatttagaagaaaatctggaggccgggcacggtggctcatgcctgtaatcccagcactttgggaggctgaggcaggcggatcacctgaggtcaggagttcgagaccagcctggccaacgtggtgaaaccctgtctctactaaaaatacaaaaattagccgggtgtggtggtgcatgcctataatcccagctactcaggaggctgtggcaggagaatcacttgaacccaggaggtggaggctgcagtgagctgagattgctctacagcactccagcctgggcaagacagagcaagaccccgtctcaaaaataaaaataaaataataataataatttattgtctgcataatatagtatttcatcttatgaatatatcatttatatattccccaagtgcaagaattttatttttctaatttttccacacttttaaagcagttttttgttgttatactacttttacttcatgttatatatatttcccttatttttataaattaaatttcataaacattttttattggctattattacataatgtgcatgtactagtttaatcttcttggatatttagattgttcctaattttaacctcttttttttttttttttgagacgggagtctcactgtgtcacctaggctggagtgcagtagtgctcactgcaacctccacctcctgagttcatgtaattctcctgcctcagcctcccaagtagctgggattacaggcacccgccacaccatgcccagctaatttttgtattgttttagtagagacagagtttcaccacattggccaggctggtctcgaactcctgaccccaagtgatccgcccacctcggcctcccaaagtgctgggattacagacgtgagcccctggcacccgacattttatctattaaaagtaacaatgttgtaactatcttcgcatgcaaacataatagttccctttgcgtagatttccagaattggtgttatcgggtcataaaatgtgaataattgattccccaaaagggttgtcatatggtttggatgtgtgtcctctccaaatgtcgtgttgaaatgtgatccctgatgttggaggtggggcctagtgggaggtattggaccatgagggtgaatcattcataaatggcttagtgccattcccttggttgtaagcgagttctcgctcagttagttcacacgagatctagttgtttaaaagagtgtggcaccacctgccctgtgctctcgttcctgccctcttccagaggccctcacctcatctgtcgctcctgctctcttcacttcctgaagcaggtgctggagccctgcttgcacagcctgcagagccatgaatcaattcaacccttttctttataaattagccagtctcaggtatttctttatagcaatagaaaatcaaactaatacaagtattagtttacctgccaatagcactaccgtgttttaaaagcaaaagaaacacaataacaaaaagacaaacaagccaattaaaaaatgagtaaaggacttgaatagacatttctccataggcagtatacaaatgaccatcaagcatatgaaaagatgctcagcatcattagtcattagggaaatgcaaaccaaaaccacagtgagatgccacttcatacctactaggacagctgtaatttaacaatgttatatacatgttaatgaggatgtgggaaaattgggaccttcatttattgctggtagacatgtaaaatggtgcagtcactatgaaaaaacaatttgccatttcttcaaaattccaaacatagaattaccgtataacccaaccatttcactcctgggtatatacccaaaagaattgaaaactgagacttagacagatacccacgtgtgaatgttcatagcatcattattcccaatagccaaaagatggaaacaatctattaacagattaatgggtaagcaaagtgtggtaaatacacgcaatggaatgttatccagctgtcaaaagcaatgaggtcctgccacatgctagctactacacgggtgaaccttgagaacatcctgcttagtgaaatacactagatacaaaaggacagttattgtatgatttcacttaggaaatatctagaataggtaaattcatagacacagaaaataaattagaggttacaggggctagggaaagtgggacagagagctagtcctgaatggatacagagtttctatttggggtattgaaaggatttggggaatagatagtataaccctgaatgggatcattgtataaccctgaatgggattaatacctctgaattgtatatttaaaaatggttaaagtggcaaataacatctattttactataattaataaagaaatggattgtagttaatttaggtatgtatgccaaactaaattttttatttctggtaaaatcttgttacatagctaaaatgttttataccaaggaaattgatttttctcttctaaacaaacatgcctgaaatctaaatttgggagattattgtttcctcttggatggtcagcatgagtggtggatttttatcaagggtctcaaagtagttttactcaataaacatttattaaagagtaacatttcagaggggagcaagtgaggaggctgcgtctgactcctgctttcacggccattgcagtacctggagctccacttgcacagatgcaagcccagtggacactgggtgactctacccttgctgaggaaaaagaactaaacactggcaaggcaattccaagaagctgagaggcagaatgtcatcacatgcgttctttgtgcagatttgccaggagaagcataagaagcacccagatactccagtcaccttctcagagttttctaagaagggcttcagagaaatggcaggccacgtctgctaaagggaagggaaaagttgaagacatggcaaaggcagattaagtttcatcatgaaagaaatgaaaacctacacccctcctaaaggggaaacaaagaagttcgaggatcccaatgcatctcacaagaggcctcctttggcctttttcttgttctgttcttaatattgccttgaaatcaaaggagaacattcagcctatccattggtgatgctgcaaagaaactgggagagacgtggagcaacaccactgcagatgacaaacagccttttgacaagaagtatgcaaagccaaagaaaaaatgtaaaaaggatattgctgcataccaacctaaaggaaagcctgatacagcaaaaatgagaaccatcaaggctgaaaaaagcaagaaaaaggaggaggatgaggaagatcaagaagacaatgaataagttggttctggcacagaattttcttcttgtctatagagcacttaacagtcctgtacacactcacttcttttaaagaaaaaatttgaaatgtaaggctccagaacatttgtttaaactgtacagtgtctttttttgtatagttaacaccctatcgaatgtctttggatagtcttgtcctggtgatattttcaataggattaacttcgcttggtacactatggggattataaattggcatggaaatttaaaagcaagtttttgttaatccacagcacaaattagttattttgaatggggatagtagtttttcatcttcagttttctctaatgtagcttatacaaaataaatgttttgttaactgaataccactccataattgaaaaaaaaaaaaaaaagttgcaactgttttgttgacattctgaatgcttctaagtaagcacaattttaaaaaatttactgaacttcagctaagcactagcactgctgggatatgccatcgttttggcttttaggtttgtagtctagttgggacttagaagacattttgaaggaaaagtcacatctacatataatttggaacgtatttgtaaaagtcttttttagacactagagtctcttttatgaccagacataaagtcttttggtttaacaaagactctccacacaattatcatttctctgtattttgctatctgtcagttctctctctaggtcctctacccatgcttttgtggtggcatcaaagcagaataaaaatacttaagagcaggcagacggttactgtatgcagtaggatatcctcttgctaaggaaaaacagcgctctcttaatgaagattgtaaggatcaggcctttgggtatatgtgtggtgttttaagttctcagaactaccagtgtcagagacataacaagtactcaggtgctgaaccatatttttccacttaaaattaagagctgggctgggcgcagcggctcacacctgtaatcccagcacttgggatggccaaggtgggtggatcaactgaggtcaggggttcgagaccaaactggccaacatagtgaaaccctgtctctactgaaaatacaaaaaaaaaaaaaatgagctgggcatggtggtaggtgcctctaatcccagctaattgggaggctgagacaagataatcacttgaacccgggaggcagaggttgcaatgagccgagatcgcgccactgcactccagcctgggccacagagtgagactccgtctcacaaaaaaaaaaaaaaaaaattaagagctacagagaatttgaaatattttttaaagctcagtctttgcaagattttatttctgacttcattattaactcaaatttaaataatcaataataagtgaaataatggaactccagaattggaaagttcttataaaccactgtaatctaatattctgctgataaagccttcttttgctattttgagataggagatcttattatcaaaggatgaatctacaactcaatatttaaaattaaaaaaattttaaaattaagttaaacatagtcttattgaacaaaacaaaccgatggtcttatatacggctttgagaacaatctgtgggtcgttctactgattacagagtgcaagtgagtcaaagtcagccttagagttagttgaatatattctactttggactaactgactttcaaagaatgccactgttaccgattggttggttttcaagtcaagtttactgaaacaagttgtcaatgatcagttagatataaaaccagtcctggtggctattcctggttattccttattaccatgcttatagaacaatcagtcttttcctcagaatgaggacatttttattgtcattataatgtttaagggattagggatacagtatatacacatttgtttttatatattgctgatgtaattttgaacattttccttaagttttctaattttgattacatgtgaattttagtagatttgaggagattggcatgctaatgttgattacatttaatgaagggttaaataggggccctttttaaaaagatcatttcgttaatcaggtgatgaacaaagcaggagtcaggagccagaatgccatcaggagtactttgggaagttgtgattgtttgttttaattaacactttttcattgactactgtaaggaaatttgcaaaatttctgtaaacatactatgttaacatgataggattttaaaatcgattgtcatacaatataaagagtttttttttattattcatggacatattgagaacataaagattggatacatttaagaattgcaaagagttttgataacatggaaagatatttaaagatatgttttcttttttttccttcatagtcaattggtgtcaacactggtttgaatattttcctaatcctcctatcaatattcttagcatgatagaaaatgttttggcatttcatgacaaggaactgctgcaacacttcatagatcatgatataacctcccaggtaagaagcataaggtttttagaataacatgccttattttgtaagctaacattggttctggtataaacagtcttttcttgaaggagtataataaaaagcatactacatgttgtatttttaacagtattccattctttttcttcattaaactgccttcctgaaagtctgtaaagaagggtccaaattaaggtagttattttcataattatgtatttaatatgattttcatagcttaaatcgaatgtaagggaatattaccaatgactccctttttacttttccctagaaaaataataaatttttccttatctgttttagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgaggtaacggtccttgttcttaagagaaggttctcaaatatcagttatttctctctattttttttttaattttttgagacagagtctcgctatgttgcccaggctggagtgcaatggcgcgatctcagctcactgcaacctccgcctcccaagttcaagcgattctcctgcctcagcctcctgagtagctgggattacaggtgcgcaccatcatgcccagctaatttttgtatttttagtagagatggggtttcaccatgctgtcagggtggtctcaaactcctgacctcgtgatccacccacctcggcctcccaaagtgctgggattataggcgtgagccacagtgccaggccatatcagttatttcaattgaaaaatccatttatttattgagtccctgttatatgtcagacactggtgctaggtagtaggaatataaaggataacaagttagaccacatccctacctgtgtacagtttatagacaataaagtaggcaattatagcaggctagtagtcttataatcatagcttaagaaaagaatcatgataatattggggtttgtgctttttgcattttttttttttttttttttttttttggagacagagtctcgctctgttgcccaggctggagtgcaatggcacagtcccggttcactgcaacctctgcctcccgggttcaagagattctcctgcctcagcctcccgagtagctgggattacaggtgcccgccaccacgcccagctaagttttttatatttttaatagagacaggatttcactaggttacccaggctggtctcgaaccccttacctcagatgatccacctgcctcggcctcccaaagtgctgggattacaggcatgagccaccacgcccggctgcttcttgcttttataaaggatgtttaacaggttattctgttattctgtgcataatcttatcatgacccatctggtcttagagggtctgaatgcttattacacatgcaaaaggtaactatgagagttttgagacttggcaggaaagtgtctgaaagaaagcattaagatcattataaaaagtagacgctcttttggtagacaagatgaattagttgggttcttgtgtgtgtgtgtatgtgttacttatttagtggttactgtccaattaaactttatttttacttcatgatcctgtgatacattaatttggatcttccagcaaaacaagataatgtggaaactttttagatatttttaaagaagcaagctaatttattttcaaaggctaatttataatttattttggattttgaagaaaaaaaaaatccaagcagagtttgttccattgttgaagcattctttttctattgtaagaaaagccttcattttttaattttatgtcagaatttcttatgattgtgaaactcttacattttttaaataaattgtctttgttgtaaaacttgagtaaagaaaagctttaatgaatttgcaaaaaaatatatattcttaaagatagatacactttttttaaattcttgttttaattctacctcataattgctttgtcaggtaaatctcgatttaaacaccaagttttcttacagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggtaattatggaatagtttttctttttctgatacaatgaaatatgttataaacataagaaagttttaatgaaaaatacatttggctgagcgcggtggctcacgcctatagtcccagcactttgggaggccaaggcaggtagatcacaaggtcaggagttcgagaccagcctggccaacatggtgaaaccccgtctctactaaagatacaaaaaattagccaggcatggtggcacgcccctgtagtcccagctactcaggaagctgaggcaggagaatcacttgaacccaggaggaggaggttgcagtgagcggagatcatgccattgcactccagcctgggcgacagagtgagacttcatctcaaaaaaaaaaaaatgcatttaaattatgagtatttgtgtaaaatcagagtttgaaggctagaaatattaaagatagttaattcttgcatatggaaataaaatagattatacattaatcggtatacattttgtgttttgatgattcttagctttcttctttgtgttttcataataatattacctacttaaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggtatgtgttatcactttaaaaaaaaatctggacatataagttagttgaataatttttatgttctttcattttttcattttagaaacaacattatatataggattacccagctgtagcatttctataaagcaactattaagttaataaaaagaatctttatataccacttttcaaaaaaaattgctatgtagtaaaatgtaattctgaagctatgctgaatataatatagctttgcatggattaatgttccttgaaggacattatttagaaacattattctatagtgggcagaaatgctttgtaatagaatgctaggtacatcacctttagtagagtataatttttttaattgtgttttaaacatacctgtgtgacctgacagttgtaacatagaatgattatgtcattacccatttaacactttggaggacaggggaatgagtattaaatgcgtattcaaaagtacgttagctgggtgtggtgccacatacctatagtcccagctactaggtaggatcacttgagcccaggaggtcaaggccagcctgggcaacatagtgagaccctgtctcttaaaaaataaaaagaaaaaacttaaaaataaatacataaaagtatgttaataaggtaaaatgtgtaaattaagtaaagtaatgggataaacattgagactaagcccaatagttgggaaactcacttctgtgtttattgattcctattcttagatggaactttatgtaacagatttatagtgtgggttaaaaggaattactgaactgagccagtgagctttctactaaaattcttaaagcataagtatacatcatctttggtaacggtggagcagttctcgcattcttctttcaaataaaggatatcaattgtattgaaatgatcagcatggcagacctgttatgaaaaaactaaatcatattaggaattgctgtatttgttccacttgatgtattttgtatttaaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtttattattcttaacttagttctcatacatcatctccatttactctcacttaaatgtaatgaacaccttcaaattaaataatattcttagagtccaccatgaatactaaatagccgctttaattttatttacttttcccctcagctttctcattctcttttgtatttcatgaatggctaaatatttaagaaatgccaggaaaattagtcaagtgtccttggtgactatttctctaaaactagaaatatcagtatcagttagccattaagttattttttcttttcttttcttttttttttttttttgagacagagtcttgctctgttgcccaggctggagtgcagtggcgtgacctcagctcagtgcaacctccgcctcccgggttcaagtgattctcctgcctcagcctcccaagtagctgggattacaggtgcacgccaccacacccagctaatttttgtatttttcttagagacgggatttcatcatgttggctaggctgatctcaaactcgtgacctcaggtgatctgcccaccttggcctcccaaagtgctggggttacaggcgtgagccaccaagcccggcagttaatttttaattaggggacatattcttttttcatataaaaattatctgtggccagtataaaaataatttccagtacaaaacatacagaattaaaaattgaccttctccattagttctcatgtcatccccagagaaacactattaaaaaatggttaattggctgggtgcggtggctcatgcccgtaatcccagcactttgggaggccgaggcaggcagatcacctgaggtcaggagttcggaaccagcctggccaacatggtgaaaccctgtctctactaaaaatacaagaattagctgggcatggtggcaggcgcttgtaatcccagctacgcaggaggctgaggcaggagaattgcttgaccctgggaggtggatgctgcagtgagccgagatcatgccactgcactccagcctgagcgacagagtgagactcagtctcaaaaaaaaaaaaaaaaaaaaaaaggttaattacatagactttcaggtatgttctatagatagaggagtaattatagtcatgttttcctatatttatacaaaaatgggattattctcattatacattgtttttgtaacctgctttttaaaatttcatatgctgaatatcttttcatatttgttatatgtgtatctatttctctttttgtggttgtataatattccattgaattaatagcttatttaatcctttgctattggacatttcggttatttgcagtgttttgcaaattacaaaaccatgctacattgtaaaagtctttgagtacttgcacacatacttttgttgagtaacttctaaattatgacaaattgttctctaaaaatgaaacagtttcagctgttttaagtctgtaagagtacccactccctagtatagtcaattgtactgcatcagtcttaatatttgccaagcagatagatgacaaatcgtctattttaatttgcctttttttattgttagtgaggttaagtatcttttctgttacttatcttccatgtgtagaattacacattacatatttgtatcatttgtccatctttttgtcaagttagacttaactttctgtcaggttagcttacttatttccaaaaggcaagtcaattgtcccaacaccatttgttgactattatccaagtcatttgccaactgatggtttttacatattaaattctcttacatatttgatctccttcctcgctttttctattcctaagccagtaccacactgtttgaatgacagtagctttgaagtgttttaccaactaggcctagttctcactcattagtcttccttttcagagttttcctcagtattctcaaatgtttatcattccaagtagactctaagaattgtttcacttttggaattctcacctctcccaatcctattggaatttttattaggattacactgactttatgcactaatttagagtttcaagcctagttttgataaaatactaagtattttttaagtcttttttttttttttttttttttttttttgagacagggtctcattctgtcacctgggctggagtacagtggtgcgatcccggctcactgcaacctccacctcccggattcaagcaattctcatgcctcagcctcctgagcagatgggattacaggtgcctgccacaacacccatctaatttttgtatttttagtagagacagggtttcaccatgttggtcaggctgatcttcaactcctgacttcaagtggtctgcccaccttggcctcccaaagtgctgggattacaggcacctggcctaagtctttcaaagtatttttaattcaatagtattagaaatctatcatctctttatagcatgatacttcttgttttgtttaaagcttgttaattttaaattggttttcaaaatccaagatttcttttaattttctcatctagtgaatgacattgatatttcattactgtagaaaagtgtatgttcttcccgcaaagtaagctcagaactctgatgtctttattccaaacccctttgaaacaggaggaggcattttttggtccaagaattctatagactcctttcagcaacatgatctggcctccgcctacccttgcagcctcctgtcctcccagctacctgttctgatgttgtgctctgaccctgccaaactgcaaaagctcttctcatggttcagactctagcaggaaaggctgcttgaatctgaagtgacaagtacatgtgactgtgaacatctgttagcagcaagcaaagctgatcggtttttgctgtggcacatagctgtttgtatctctgaaaattcataagcaaaagagctctgtaattgaaattcctaaaaagcgtgatttgctaggccacacctctcctccacttcctggcattattactgttcttgcttcacacaatcaagcttcccccaacctttgagctagctcctttcccaataacctctttaaattgaactggtcctggtccatgtttctcttttagtctttggatatatatgtttgcacatccaactgtattctcatttagtgtttctcctattttaggtattcgatagcatgtcttttaccataatgacaatatctaacatttcactttatatctaagatcatttctaagagtctctagagagttccatatcccatatccaaagcctctagtatataggaataaaaagcctccaactaatcaaattttggaaataggtgaactctaaattaattcacttggagcagaacacatacaggttgaaccatctgcaagaaatttaaacctagaattgttaattgtcaaaccatacttataaaagtagagaagtttagtcaaaaagagcattaaataaatgttatatttttatctaccccagatttaaattgctcaagtttttctaactcatgatattggttactgtaatactgtaagaactgctatctgttcttccagtctgagtagatgggcatatggtattgtgctttttatttttaaattaaacttaactttaactgagagattattcctaggttctgcagtgaatattaatctttgtctgttactctggtttcaaaaacccagttgctgttattttaaatactgttagtaggtcgttcagattacaggattactaaatatattaaaaattattttgtaaattctttttggtatttacagtttgttgtttggccataggtatatatgagagatcgagaaattgctgccacagccagagacctagaaatgagacagctggaactcgaatcacaaaagagactttatgagaaggtataattcagttatttccaacataagaaaagcaggttttggccaggctcagtggctcaaacctgtaatcccagcactttgggaggatgaggtggaaggaggatcacttgagctaaggaattccagaccagacctgggcaatatagtgagaccccatctctactaaaagtttaaaatttagctggttatgcttacctgtagtcccaactactcaggaggctgaggcaggaagatcacttgagccctggagttcgaggctgcagtgaaccataatcacatcactgtactccagcctgggcaaacagagcgagaccctatctccaaaaaaaaaagaaggaaaaagaaaagcagggtttgtataagcccattttagactgtatttattcatggttttctagcgttcattttattcactttttaagcagaatatagtgccacacaggattgtaaggtagccaaaatgtctgaatgtacagtttgttgtaattatttaattcatgtttctgttagcagcttagtctagtgtctgaagcaccagatgtaggccccagattttgcctcaggattttttaccaacttactaaattttcctgtaattacgtaatagtgactacaaaattatctcaatacctcacaaggatcctgaaaggtaaatcagtcaggagctgtaaagtactttctttctttatttgtatttttatgtatttatttttgagacagtcttactcagttgcccaggctgcagtgcagtggcaccatctcagctcactacaaccttcacctcccctgctccagtgattctcccacgtcagcctccccagtagctgggactacagacgtgcgccaccaagcctatctaatttttgtgttttttgtagagatagggtttcaccttgttgcccaggctggtcccaaactcctgggctcaagcaatctgcacacctcggcctcccgaagtgctaggattacaggcatgagccaccacgcctggcctgtaaagtactttaaattggaatcttctggagttaactcagcaaatatctgcttagtacttactattcagttttcaagacactggaaaaaaggagctttgttaatataaatttttattatttaggaaaaatgttttgttactcatttagtgttgaaactgtaagttttcacttctttcagcccacttaaaaagtcagaccttttagcctgggcaacacagcaagaccccatctctactagaaatacaaagaaatagccaaatgtggtagtgcgcacctgtggtgccagctattcaggatgctgaggtgggaggatcacttgagcccgggggacggaggctgcagtgagccaagattgtgcacttcagcctgggtgacagagtgagaccctgtctcaaaaaaaaagtcatacttttagtttgaaattagtgataactgtgaattcacaacacataacatatatgtttgatatccacattaggtgagatttaaaccatatagcatccatttacacctataacacttttaaagtctccacactgaatttcttctagaacagagcaagggatttacagtttggctgagtctcccatgatttggaattagatgtaattcatttggactaagctaaactttactatattttctttgggggtggaggatagtggcaatcgaagggtataattttagaactaacagggaatttgcaagaaaaatactaaaaatttccagatatttgtctctcagatttttaaacactaacattctactaaatttgctttctcttcctctttttctttacctatgcacatatatacacacaaacatatacttgtttttctgaactgttacagacgtgatgctcctttacctctaaatacttcagtgtatatttcctaagactaaggaatcctcttatataaccaccgtacagttctcaaaatcagaaattaacataagatgatctgatatataaaccttattcagatttgatccattgtatccaaaatgtcctttagagcaaaagaaaatctgagatctcatccattgttttgttgttgtcactttagtctcctttaaaataagaaatgttcgtgactctgtctttgtattttatgacattgatattttttgaagcatgtaaaccagataatttgtagaatgtcccttaattagcatttggctgttgtttcttcatgagaagatttaagttacccataggagtgcataactttaatctgtggcattcctgcaacagaagttatgttttgagatggagtctcgctctctcacccaggctggagtacaatggcgcgatctcggctcactgcaacctctgcctcccgggttcaagaaattctcctgcctcagcctcccgagtagctgggattacaggtgcccaccaccgcacctggctaatttttgtatttttaatagagatggggtttcaccatattggccagcctggtttcaaactcctgacctcaggtaatccgcccgcctcggcctcccaaaagctgggattacaggtgtgagtgactgctcccagcctatgctgagttttttttctgtgtatcagaatgggaggcaaatgtttgttaatctctttttgctgtcttttgaaggaattatttatttaaacaaaccaataggattagagaagagttaaactattcatcaaaacaaatatatgaaatcctgaactttatctggtcagttaggtacggatgtgctgccactacctttttcaaattggctgtagtgattgccactttacctgcccaatttatctcttacattaggttgattaaatgtgtctatttctaaagaaattatgtcccagaaaaccaacaatattatgattacctccacatgagctcaacattccatacgtatctaatttgaatcaaattattgttcaacaaaagaatgaaactaagtataaactaaaagaaacaagtaaatactaacctgtactccagatcccatcccctcataatcttctaggacctcatttatcaagtctgttttctatctgtctttcacatgtatgtaccttctccttcggataataccagtcttgcaaagattgctataaagattaaatgagttaatacgtatttgtctgtgtcaggggtccccaagaccaccctcaggttcagtgattcactaggactcacagaactccagaaaagctcttatattcatggttacattttattatagtagaggaatacagattaaaatcagtaaaggtaaaaggcacatggagtggagtccaggagagaccaggcagaagcttctagttgtcctctcccagtggagttgtacagacagcatttaatttcctgcaaagatgtgcgacagtatgtaagactattgcctaccaggcaagctcactcaagccttggtatccagggttttactgggggtcatgtagacatggagtgcatatgtggctgactttagttactttctctacaacccatccaaaggtcaaactgacagagcatggcccatggttcccaccagatcccatcatttagcagaaaccagctggcatggccaatatctccaggtatacagacactcttatcaggcagagtattccaggggcttagagattatctcccaggaactgatcaagggccagtcttttctttagaatgtgcaggtttttaattactcaggcctactgagttaaccctttattgcacagtgtctgatgtatgatacatattggatagatactagtttccctcttttccctttggcctaaaaagctctattattttaaaaagctaatggacaactccagtatgcacacgtcgtccaatatgtttcttcataccactacccaatctttgatcctcttcaccatttttagagttccattgtttcctcttagtccttaatctctacacatacatgattttacttctttatggagtagctaaaattctatgttctgcttgtcttcttcgcttaataaaattctttttaaaattctttttctaaatggctacatatttttgtaactgtcattggtagtggctgctggtgaaccataacttatttaagctttcttctgttgttagatgtttaagtggtttacaatttttgataataagcatcttcacatatatatctttttgcatataattgaaagatatttttatttttagcaaattataaggtaattatgctgtctatagatgattagaaaagtagaaaaaatccctcgagaaataacaactgctaatgtcattaatagtgatatgagattatttggtacatacaatttgtgtttggcttttttaacctacattttcatgaaggctgtttactatccttctcccaactactgtacctgttagcatttactctcctatatccctgcccctggcagccacgaagctactttctgtgcccatggatttgcctattctggatatttcatataaatggaatcatacaatgtgtgattttttatgactggcttctttcacttagcatgttaagcatcttttcatatgtttattggccattttgtattttctttggagatagtgtgattaatgtttacttaaagtatgtatgggtcatatttcttgttttgttttgtttttgagacagagtcccactctgtcacccaggctggagtgcagtggcgtgatctcagctcactgcaacttctgcctcccgggctcctgcaatcttcctgcctcagcctcccaagtagctgggactacaggcgcacaccatcacaccctgctaatttttgtagtttttatagagagggttttactatgttgctcatgctggtttcaaactcctgggctcaagcagtcctcccaccttggcctcccaaagtgctgggattatacgtataagccactatgcctggcacatatttcttgttttttttttttttcaaacagtcatgtgattttttgttgaaaactagacattttaaatacaatgctcctcaacttatgatggggttatgtcctgataacttatagaaatattgtaagttgaaaattcatgtaacaccctgatagacccatcataaaatcaaaaaatcattacgtcaactcaaagaccgtctggaatataatgtagcaattttggaaataagattgtctcccctccccagggtttcttcttgtttctttgcttagtgacttttctgaactaattttgaaagtccctattctttgttgtatataaccactgatgtctctactcaggtagtttgggggtcagcaaatgattgaacagagattttaatatattctttgaaccagtaagcttctagtagttgttgaggggctctgtgtgcatgttagggcacgcctttatcactcagctaggcagtttatactttctagattccgcttcctggttatgcaaaacctcagagttgaccagaagtgtgagatcttaggtctttctgtggtctgagaacacagcccgtagcatatacacagccttacacatgcacatgaccttccaggaacctatcagcttttttaagcctcctgtggacatctgattctccagtttttcctgttaagctttttacttagcctattggttgctcttctaagatctactgccccaagtagccaagatactcaacagtttgctctaattgttttcagcaacttccccagggataaggctattctgcactaggtgagctctgagtgagatcaaaaaagacagccttaggagtggtctttcagggaccaccagacaggtcaaacagtgacagttctccagcaatggtggtttgaaggatctccgtccaacccccttttgcttggcttccttccttggcttccaggctgctggttttcaagactaatgtataggctggacatggtggctcacacctgtaatcctagcattttgggaggccgaggcaggccgatcacatgaggtcaggagttcaagaccagcctagccaacatggtgaaaccctgtctctactaaaaatacaaaaaagttaaccaggtgtggtggcatgcacctgtaatcccagctacttgggaggctgaggcaggagaatcacttgaacccgggaggtggaggttgcagtgagctgagattgtgccactgcactccagcctgggtgacacagtgagactctgtctcaaaaaataaaaagactaatgcatagcttgggagtggggtgggaacaggaaaaatgcaagatgaaatgtcagagagctagctgttcttaccaagattcagccatttttataagtaaatgctccccagatagctccaagcctttggttaatttccagaatgctgaagaagttcattttgacatttttttttatcagtgttctcaatgcttttatggatgagaggatttccaggggtccttactctgccatttttgctgatgtctccagtcgttgaattttactttgaaaattagatgattacagcttttatttgtgtgcatattactattctgaaaaaagtcatttttgtattctagcgttatataaattagtgatttttttttacaaatgattttaacagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtaaaaatatgatccatttagtatacatgcagaggagaaattttcatctgtcaccctcttaagagaacaaaatcgaaattaaactctgtgaagttgagttagtttgtttctttgcttcagttgtcacagttcctagaatctcacattgcttccttttatatatgggatgcttacttcactgacaatcacatgatatgcatgtctttttcctacagtttgaggaaatacaaaggaatagtgacttacaagaaaatacaaaggagtagtgacttagaagaaaatacgaaggaatagtgacttaaaagaaaatgcaaaggaatagtgactttacaaattttactgtccttctgtgttctgcctctgaaattgtccctgtgttgattaggttcaaagcatcaggtccctgcatggtatgtaagccagcacttccaagtgtattgtgtggactattaactattattcaataagatgggggatggtcaaataagtattggaaatgctgtcttaaagtgaggtatttttcacgccaaatttgaggatttaagagaatttccaagatgtatttcagagaatttcttacggagtacactttcagaaatgctgacttaagtgaattgaaatagaacttgagactttcaaagaagagctttctctattatctctttaacaaaatgttaaatgggtatgtgtaccggtctgctcctattccaaaaaccaggaatagtgtaccgtagataccttctgttgtacaacagtctcttaggtgatttcctcaagatattccatttttttttaataggcttgtgtccagtctgttaaaatgggctcttcttcagagtctcctcttcagagtgctgaaaacatggaaattgttgaatcccacccataccctagccgataagttcttaaccttggctgtaaattagagtcacttgaagagctctttttttttttttttttttttttttttttttgtagagatggagtcttactctgttacccaggctggagtgcagtggcacaatctcagctcactgcaacctccacctcctgggttcaagcaattatcctgcctcagcctcctgagtagctgtgactacaggcgcgcgctgccacgcccagctaatttctacctgaagagctttttaaaggtgctggtaccccgctgtccagtgattggtttaattggcttgtggcagggcccagtcatcagcttattttaaacactcccaggtgattctaatatgcagccagagttgtgaacaactgccccagacacttggatacattgaatggttataccttcattttatgtactagtagtttgaccttgtttctgaaatgtataactttttcctaggtgattaaagaaaatttggcaaaggctgaacaagcatgcctaaataccgactggcagattcagtctttacataaacaaaaatgtgatgatctacaacgaaacaaatgttaccaggaagtagccaaactccttagggaaaacagaaggaaagaaatagagataataaatgcaatggtggaggaggaagccaagaaggtaaaaaatagtgttataaactttttaatatcaagcattgattttttttttttttttaaaagacagagtctcactttgttgtacagcctcgaaattcaaactcggggccttaagcaatctgcctgcatcagcctcccaaagtgctgggattacagacgtcagcccctttatccagcctaagcactgaaattttgaaatagtacagagtcaaatgacaaaagcatcataccaagtcgtttttgctggaaaagataatctgattttaataggtgtttgtcagagacgtcgtctaatattgattctacctaaaaatgactaagcgtctttctcatttacattagtgtgcttcaatttctcaacttcctggatttttgttctggctgattgaataatattagtactttaatttagctaattctttatacttacaatgtaaaagatgctgaataggtagaaatggtacgtagctgctagtaacaaaaccccaaattacagtgactatgaacaggatagaaatatagtctggaggtagggagtctagggttagtattgtggctccaaggttatcagggaaatgccatctttcagcctttctgcacctcttcttagtgtatggctttcattttcaaggttaccttaccatccaagatgactcctggagttccagccatcacatacacattccaggcagcggggagaagggagagcacaagtgcgaatgttctgcctcccatctgagtcacactcccttctaacttctttccaggagttccatatcatatttcaagccacatttgtcagcaaaggatgctgagaaaaatagtattcttcacagggagcattatcatcccaaataaaattaagattctgttcctatcagttaataagatagctaaaaataaaaacaaaagattctactgctaaagaagaatcaaagaatggagtccgaggaggtaattaatagtatatgtcacacgtgtgtatcttttggttgatcctcgcaaagactctgggatctgtgctctggagatattatcgcaggtaccatagactttcctaaggaccctgaggagctggggaaagatcaagatgtagatacctggcttaattgcttctctctgttgctgtatcacaatgtctattctgaaagctggcttcttacagtgtatttccttcaagtcactattccagattcattttcctcctaccccatcccagtggcatggagccttatcttataacccttccattctaggacaggaaagaagggcttggagagggtgggggtaatatccagaaccctgaggctgttctcaggaaaacaggggtggaagctcacattctcatcctaaacattgctgacactagggctatactgtgtgaaattcactgctgctggactttgggtaaaatggtacttttgagaattggctgagaatcattgtaggggcccttcacgttctgcagaaatccttccttgtgtctagtgtcttgcgttgtaaagctgacttgactactgcgtggccttgggaaattgctcagaatcagccccctcatcagtaacatgaaagggatggatttctgtgatccttccttaccctattttgtgattttttaaaaaagtttttgttatttaatgcattattatttctatagcataaaaattatgtgtttccatgtaaaagctgtagcttttccagaatttcggcaaactttaggagttggattttaaatttattttagttaccttctgagctaattttaagattattattttctcattttatggagaagaaaataagggtgaatagaaatcacttgacttccctgtggtcatcatgtggaccagagctgggcaaagagttcattctctgaattttgtagattttattattaagatagagcattcaaattaaataaaatgcaattgccactaattcaaaactagcttagtctcataagatttgagatttgaaacttattgaaatgcattattatttcagcaattattgggatatagttgtgtgctttgtggcactctgcaatactgggggttggataaaacctgcctctgctttcaaggctcttaatagccttgggccaacacaggcaccccagttaccataacaccaaacagatcctacttgccatgggaatataaaggaaagtggatagagaagacagaagtggctcattccactgtgaaatgtgtattactatactttttatgtaatctttttttccatttatttgaatttagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaaggtgagtgtctgagaggcctttctctccatgatgttacagatttattcttttagtagggtctattattatgatttttttttttttttgagatagggtcttgttctgtcacccaagctggagtgtagtgatgcaatcatggctcagtgcagcctcgacctcctgagctcaagcagttctcccatctcagcctcccaagtagctgggaccataggcgtgtatccccacacctagctaatttgttaaattatttgtagagatgagatctcactatgttgcccaagctggtctcaaactgctgggttcaaaccatcctcccgccttgcctctcaaagtgctgggattataggcgtgagccactgtgcctggccagtgaataaattattgggatgtattttggcacttctattcaatctactgctcaagtaaaaggtaatcactggttaccatatttttggtgggaaagggtgggctgaggtgggactattacagaaacagagtcccagtcgaggaaaaagtttgtgcagactgtcctgtggagttctgtttgattctgttgctccaaggtaaaatatgtactttgccaaaagctggtcctcagaacaacagtatattcaagtatcacatggaaacttctcataggatttgatccaacattaggtttcgatacaaggcttacagtggcatcaactgaaaaatcaaaattataatttaaaactgtaaaataccctggaggctgaggcgagaggatctctttgagcccaggagtttgaggctgcagtgagctattatcacaccactgaactctagcctgggcaacagagaagaccctgtctctttaaaaaaaaaaaaaaagatttccaaaaattatagagtacagttaacaaggagcttttattttactgtgttttattttgtttcagtcttttataatgtgtatacattgctttttaaaataatagctttgttgatacataattcacatgccctataattcaccttttttctttctctttttcttttttttttttttttgagacagagtttcgctcttgtctcccaggctggagtgcagtggtgcgatctcagctcactgcaacctccaccacccaggttcaagtgattctcctgccttagcctcctgagtagctgggattacaggcctacaccaccatgcctggctaattgttttattttagtagagatgggttttcgccatgttggccatgctggtctcgaactcctcacctcaggtgatccacccgcctcggcctcccaaagtgctgggattacaggcgtgcccagcaccgcacgcagcctaattcacctatttaaagtgtattattcaatgtcattatattatcatgtactaaaaaatacacttacatagtcatgcagccatcaccacaagcaagtttagagcatttttcagcacttcaaaataaacccagtacccattagcagtcactccccatttccactcactcccccaagcccctggcagctactaactaccttgtgtccactcacctattcaggaagtttcatgtaaatataatcatgtaatatatggtcttctgtgtctggtttcttgtacttggcataatgtcttgagattcaaccatgttgtagcatgtaccagtacttcattcctttttattgctgaataatattccattgtgtggatattatgtatttttttaatctattcatcagtcgatggacatctggattctttccaatttttggcttcatgaatatgctatgtgcattacttttacatttcacaaatttgaagagtgaaaatataggttaggtcatttaattatgcctacctttttttttttttaaagacagaacttcactctgttgcccaggttggagtgcagtggcacgatcttggcttactgcaacctctgcctcctgcattcaagaaattctcctgcctcagcttcctgagtcgctgggactacaggcgcatgccaccatgcccagctaatctttagtagagatggggtttcgccatgttgcccaggcttgtctcgaactcctggcctcgagtgatctggccactttgacctcccaaagtgctgggattatacctcacccggccaaatcatgccgactcttaaaaccactcattaccgctcatacttgagatttagtggtcccaaatagcaccaagagtacttcagggaggtggagaggagtagaatgtgactctgcacgaattaaatatttaaaactggcttacaaaagatactaatcatgggagctgtcacttctccctcaccctctcacacttacccttgtttttttttttggttgtttgcttttttgagacggagtctcgctttgtcgccaggctggagtgcagtggcacaatctcggctcactgcaacctccacctcctgggttcaagcaattctcctgcctcagcctcccaagtagctgggacaacaggcgcccaccaccacgcccagctaatttttgtatttttagtagagacggggtttcaccatgttgggcagggtggtctcaatctcttgacccttgtgatcctcctgcgtggccctcccaaagtgctgggattacaggcgtgatccaccgcacccagccttacccttgttttagaaagaaaaatagaaaatctttagagagctatctacgtagaaatagagaaaggtaagaaactgtgaaaagctttcgtcatcggtagttttcctacacctttgcccctctgcctccatgatgtcttcccttcgtgctaaattttttttggcagaccagtcagccatgtatgttttttaaccttgctgaatttcaccaatagagataatttgattaataaacatccagttttcaaaagtcttaagtttatgactgaatgatgtgtcagtcatgttcttaatcagggtatatagatttaatcagattcatttaatcctaaaagcaggagataatcacctaccattaagaaaatgacatttttgagcccggcgcggtggctcactcctgtaatcccagcactttgggaggccaaggtgggcagatcacaaggtcaggagtttgagaccagcctggccaatatggtgaaacccccgtctctactaaaaatacaaaaattagccaggcgtggtggtacacacctgtaatcgcagctactcaggaggctgaggcaggagaatcgcttgaacccaggaggcagaggttgcagtaagccaagatcgcaccactgcactccagcctgggcgacagagcgagactccatctcaaaaaaaaaaaaaaatacaaacctatatgtgttcaaaaaatacacatgttcaagacctcaccaatagtgatttaattcagtagatctaataatagtaataattccgtcagtagctctagggtagaaactagggagctagatttttgttttaaagtttcacgagtgaatatccccagccagtgtttgaaacattgctggagacaaaaggtaatcattagttgtttgaacagagataatatttacaacacagccctttgggaagatgaattgaacaggagtgggcaggttgaattttggaggacagatgagagggagctgtgagatctcagctctggctgggcacggtggcgcctgtaatcctagcaatttgggagactgaggcgggaggatggcttgagcccaggagttcaagaccagcctgggcaacatagtgagactgcctctaaaaaataaagaaacaaaaagatctgaggaaccacacctgattcgcgtcttgtctgtgcagcaaatgtagcagtggccagcgtgcttgtgccagaatgctggtagactgggaagctcgtgaccttattccatttgctacaagtattttattttggagttatttctggccaggcgcagtggtttacgcctctaatcccagcactttgggaggccaaatcatgcctacttttaaaacccctcatacacctgaggtcaggagttcgacctggccgacatggccaacatgaccaacctggccaacatggtgaaacctcgtctctactaaaaatagccgggcatggtggcgtgaacctgtaatcccagctactccagagactgaggcaggagaatcgcttgaacccaggaggtggaggttgcagtaagccgagatcacgccactgcactccagcctggggtgacagagcaagattccgtctaaaaaaaaaaaagtgttatttcttagtaaaatagttcaatctgctttttcttttctgtttttctttttccgctgagttctgtccgcagaaaccgttctctggaacagtgcagattgcagattacgtttactacctccgccatgtcccgcccttcagatgtttgaagatgactcttagattccagtcccccaccagttcaaattagtcattggtgattagtcacattactttaatgactcattgagctaaaactatgaggtaaaaccattagctaaagcttttcagagaggtaaaaggcagacatcttaccgatttaatgagactcccagcattctgggctcgacacatggagcttagatgctagcggtgggagtagaaaggaagggaccattataagccatgtcaggatgcaaatgtttttaaaaacaccttggtgtcatactggatgtgctgctgtaggagttagggaacagtgaaaacacagctgagggtgagtgtaagttttgagatgaggagagtaattgataaaagtaggggaggcaccactagttgctagggcactgccctgcctgctactctaagaagggttcgggtaaaacttgcctatggctggctctgatttgctgtatgttgtgatgaggccctgcctagctaaaaccagtagtgatcagctcataatagtttccagggaagccttgctgatcacatttcgtaatctctatcttaatatccatatttttgagtttgttggctttttgttttagctgaaagtgtttttaaagtacgttttacagaaatcagctcagctcttaattctcactaatgacacttccttgccttttgaatgttgaccgcattcttcttaaaatagaaaagaaaggagtttttagccatccttggtgattgtaacttactagggaccatttggaattagtaagcctttctactcactcccaaacatcatcttaatctcctcacttttataacagaagaacccaggttccaaaatgaacaggactcaagctgtttgcctagaacctcacaattaaatgactcttctgaaatggatccctcaacacagagtaagttgataagcaagaaaatgttattctgccattttaaatttcacaatatttaagcaaaattgtggcttaaattatatttatagcatgtggacgccattttcccagggcactgataatggaaatcctaaaagggaggcagcaagattctctcagattcctcagtgggagaactgggtgcagaccaaattccaagtaaagaaaatgtgctgaatccactaaagccactccagttcttgagcaccagcactgctgcccaaaaacatagttggaggttctaacagaagtctctaactaggttgataatatgaaattcataactattttgacatccttgtgaaaaaaaatctcagcgttgtttttcaaagctattgcatagttgaattttcttgactctgttcatttgggctgggctccctccaacaaccattgaaaacatgtgtctgccctgggcactccgatggaattctgggccccagcagcagtagaatggccaaaggcaaatggcttcatgctgatgagctgacttttgatccctggacgtggttcattggagggtttggggttttttagaagggacagggtagaaacatcttacagaaatgtaatcacagcattaggccatccataaagaagctaacaatcttcccagtaaagtatattatttatttttaaaagggaggaggagaaaagacactctgttaaacttactttcaactattttttttcaataaaattgccatatagatgaagcagtatttaacaagatcttttgacttcttttggaagaacaaacttttatacaatgtcccaaaaagacgagctttataagaaatatgcctaataccaagtcatgagattccagtattgtgtaaaatatttttgctaactcacatttttatatgcatctataaattctgtgccagaatatgaattaaaccaaaaatcattcaagagtcagatgaagtatgagagattctcagctactctctattctgacatatcaaatggttatttggcagcaaaatacaaaagcatgaaagttgtatttctttgggaggaaaaacagtttttcagaaattgaagctgactgactatttgaatatgtaactaaatttcagagaagtatatttttaagggcttttaaaaaaaatttcagtgttcactagcccctctaaatcagtaacgctcttacacttggacatgttgtagtattttaatcttgattctggaccttcctgatattagccaatattaaaaagcatttgatttacttatttttatttatttattggaaaggtaatcatggtgtatatttcacagttttatgacttggaatgccttttctcattactattaagcatcattgtgaggaagcttacagttgcacaaactcaaattctctcttaaattaacaagctttgtttctaacttaagattgtttgtatcccaagtatttcaaagcagagaagttctctgttagcattcattcagtccaacaaataattatttggcttgtaaatggaaccacctagggccaggttatatgtaaaatttaggttttagaattgcatttcattatttgtttttacaacacatttatctttaaaataaatgctgtatcaccgctaacatcagaaaactcagcttttctaaattttaaatttcgttttcaagtttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgttaaa

SEQ ID NO: 615 - DNA, 49393 bp, Homo sapiens
cccctcgtttctccctccccgcctcctccgcagaagccgagcgccaaactcaaactttatcaggacccggacctctcaggctaatcccgagggccgggcctgttgggcttttctgcacaccagccgaggcagcgagccaacatgagccaagtgctgttccaccaactagtcccgttgcaggtgaaatgcaaagactgtgaggagaggtaaggtccgcgtcatccagtgcccgcgggtggcggttggggtcaggccaatggggaaagatggcggttctggcccgtgggatccaccttgcacctaggtgtcgagtcggcccccctaggaagcggatagggaacccagagggcccggtggttacctctctcaccaagtcggccgttgcagaggggactggaggaagggtgtgaggagttaggaagccggctcacatcaagttaatgtcaaaaaccctacctgtgcacggaatcgtgaagattatagccctactcttcccttttgacagataagaactctggcccagagaagttaaaaaaatttacgtgagggctcacagccagttcatggcagggtcaggactagaactcaggccttggctccgagcctttccccctcgttctcttttgaagtatgttggcagtaaagttcaacttttaaaaacctaccaatttggtggcgtactttggctcttcacatcagttgctttaaaaaagtaaattacatttaaccgactaaaaatgagaaaagcagaaacgtcattaattcattcaataaatattgcctccttgtaaaacaccttactgggcactgggaatacagtggtcaggaaaaacagtccttttcttcatggagtttacaatcactggaggaaataaagaccagtcgcacagagaagtgcaactttgattaaggaggtggtattattggggcgtaaatagatttgaccagaggtcaggagacttactttttttttctcagttctaacactcaatggttgtctctttttttctctgaacgttctttcctcatttgtaaaactgatataacatgcgtattcacgtgtttgtaatgaggatcaggtgtgaaatcttttgcgtattcacgtgtttgtaatgaggatcaggtgtgaaatcgtatgtgaaaactaagtggtgtacaaatgtaacataaaaaatgaagacattgccttattgagttgccagtaatgtcaaactgtagtatatatagttcagaattcggtcaaaaatcaatggcaagccggtcaaggagatggtcccaaaaccagcagctgcatatggagatctgtaggtttagttgatcattcttttaatgctgtccagtatggtagccactagccacatgtggttattagacatttgaaatggggcttatctgaattgttgtgctttacatatgaaaatgcacgttggatttttaagacttactatgaaaaaagaatgtaaaatatgtcaatttttatattatgtgttaaatggcaatatttttgggtatattgggttaaatacaatgtattattaaaattaatttcacctgcttttaaaagtctttttaaaatgtgacttctagaaaatttaaaagtaggctaggtatggtggctcacacccgtagtcccagcactttaggaggccaagacaggaggattgcttgagcctaagcttgaggttacagtgagctactatttgtgccactgtactccagcctgggtgatagagcgagatcctgtctctgaaaaaaaaaaaagaaaaagaaaaaaattaaaattacatacctggctcacatttgtggcttacattgtatctccattggacaacactgttttagaatgattatagaaagataaaggaggccatgactttggtttcaatatggaaactcctagatggtctctttctggttacattgccatcacagttaatctaaaaactcaatttctctgcttagaaacctttaatatattcctattatctgtataataggggtcagcaaactggagcacatgggccagttggctcactgttttcgtaaataaacttttcttggaatacagccatgctcatttgtttacatattgtagctgcttttgcacaggaagggcagagatgagtaattgtgacagagaccttatggcccgcaaagcctaaaatatttgctatctggccctttacagaataatttggtgatccttgacctataggaagaacaacccagactctctctctttctctctctctttttttttttttttctagacagagtctcgctctgttgcccagactggagtattgtagcacgattacagctcactgcagccttgacctcctgggcccaagggttcccctcaccttagcctcctgagtagctgcaattacaggcgcataccaccacgcctggcttttttttgttgttaatttaatttaaaagagacggggtctccctgtattgcccaggctggtcttgaacacctgggctcaagtgatcctctcaccccagcctcccaaaattcggggattataggcgtgagccaccacgcccagcccagacgccttggttgagtatttgaggccagttcagctcaacaaatactggcaaatgtctgctgtgtctcaggaactgtcctaagtgtggaggatgtaaatacgcacccccctctccgtccccaacaacaacaaaagccaacaaaaacctcttttcattctgtccctcaaggaactcacattttaataggggaaataagattttccttgaacaggcaccatagcacagattaggagttcaggctctggagccagattgcctgggtttaagtcccagttcttccacttactgacagatcttgtacaatttccttctctgtgtctcatctttaagttgatggtaataacagtacctacttcatggtattatgagaatggaatgaattatacatatgaactgcttacaacagtgactagagcataataaatgttcactaaattttaggtattaatgtgtgacaaatgcataaagtaatataagtacactaaagtcagagaagaaggaaattcagttgaggacagtggtaatgatcagggaacttcatctggtggaaaattatgcaaaattttggaacccatgatttgacactaatctgccttttcagttttgtttcctaagcttatctctccaatatgaaagtcatacaagcattcttgttaccttctgaatatacctgatactcattctatactattacccctgctgttccttgtgcctcaaatgcttttttctttcataactttcaggtatgtcttaaatcctttcactataaggacccttcaaagttgcctaagttgaaatgaattgccattattcagttattagatagtgtggtgtaggtgaaagatctgagttttcatttgggctctgtaatgtgaccttaaaccattatttgggccttaagttcttcttttgtaaaataaataatatttacttatcaagattattgttaaataagatgatatatgtagaatacctggcaggtactcagtagtgttggtaacccttccctcccctctcatggagccctaaaatgcaatcagaagcaaatctagcaaaaagtcattaatctcatctcaatttgaggacagagaccatggttttttttgttttgttttgtttgtgtcatcctatgttcaaaaattattatttttttttttttagagagaggctgtcactctgttgcccaggctagagtgttgtgtcataatcatggcttactgtaatctcaaactcttggtcttaagctctcctgcttcagcttccagagtacatgaaactacaggcatgcaccaccatgcctggctcattttataaattttttgtagagataggattttgctatgttgcccatgctggtcttgaactcttggcctcaggtgatccacccacctcagcctcccaaagtgctgggattacagatgtgagccactgtgccaagcccctggaccatgtttatttctgtttgtatccctagcacctggcacaatacctggcttaaagtaccttttatttgtttgattgatagtttaagagcacagctactgggtgtcagagatggcctagaatccagttgtgctaaagcaagcctgatgtttagaatactttttatttagaagaactcataactaaatctaatgtcattagtattagacatctattgagtacgacatctattgagatgagaaataacattttattgagtttttattgttttatattgctcttatgacattaaccattataagggaaaaaataagatttgtgattttagttagcgtatcctctgaaagcttgtatttttctacagcatatttctagggatgttttttaactaagcatggggaattcgtttaacttacaggccttccgttttttctttcaacatctaatgtatataggcatttggaatatatgcaacaatatcattaatatgattggtaaattgtcatagtaatataactcttccaggattatgtaaagaacactttgataagtgaattcttcttgtactttttgcaaatatatgaagtatgacaggacttttaaaaccgtaaaacaccgtctaggtgcagtggcccacgcctgtactgctatcactttgggaggctgaggtgggcagatcacttgaggtcaggagtttgagaccagtctggccaacatggtgaaaccccatctctactaaaaatacgaaaattagccaggtgtggtgttgtgcccctgtaaactcagctactcaggagactgaggcaggagaatcgtttgaacctgggaggcggaggttgcagtgagccaagatcgcaccattgcactccagactgggtgacagagcgaaactctgtctcaaaaataaataaataaataaataattaaaataaaaataaactgtaaagcaccataaaaagttaaataccaactgcagtatcataccactatggcatttatactagagaaaacttcagaagatgaaaaccaaacataatgatgtagagctaaaaaggttttcacaaaccttctagttgaatccacttatcttacaagttcggaaactgagtccccccctcccccaccccaccacgaaagcttaatcttgctgtgttgcccagactggacttgaacccctgggctcaagctatcctcctgcctcagcctctgaagtagccagcactacaggtgggaggcactgtgcccagctcaggaaagcttaaatggaattggagtaacactctaatctgtttcacatatgttgctttagatactagaaaaatagcaacagtgtattctcttgttttgaaaataattcttcctctctctggtgtaaaccagtgcttcttgttccttttcagaaaacagatacaagttatgaggtaacatttaaccttattgtacaaacggagatttagcatccaatcatatgttcaacaagaaacttaactaaaatgacacattttaaacccatataaaattacaagtcagcattaaaaaatctaaacaattgaatctagccttgatcaactgtttccaagttttcctatcagtactcaattgctgtttatactttttacttgtgtagtagataagcaatagtgtggaaaaggtttaaaagaagtccttagaagaaaaacttaaaattgaacaaattctatttgttagtttacttttttctacctgcacatcaaagaaaggccattgttatttaattctggcagaatagtttgagaagtacttgtgcataggtattttttactaatttctccctttattttctgaattatataagcatttgtgctctatttgattaatgtttatgagcactttcacctatatacctctgtccaattctggattctctaagatacagcataggatgtggaacactgtggtctctccctctcagggcttaaagttactttactcaaggataaaataggtgtaataaacttgttgataatacttctgtggttttattacataaagaatatattaagcagatttaattcgtggatgtgaaaatacgtttttgtatgaataaatgtagggaatatgttatttccttgattttaaacattcaaagcattctaatatcgcttcacatattaagtttttattttattttattttattttttgagacagggtctctgttgcccaggctggtgtgcagtggtgcagtattggctcactgcagcctctgcctaccaggttccgcatttctccaacctcagcctcccaaatagctgggactacaggtgggtgccaccacgcctggcttgtttttgtattttttgtagagatgaggttttgccgtgttaacaggctggtctccaactcttgacctcaagtgatctgcctgcttcagccacccaaagtgccaggattacaggtgtgagccactgcgacgggccacatactaagtttttaaaatgcaatcagtctctcattaatcagtttgattacatgacatggtaattttttaatgtgaaaagttgttactaaattggtggtttgtctttctagatgttattttagaatcagggcagtaagggtatatgaggttcttacctcatttaatcctcaaaacatccccattttacagttgaaaagttactaaattgatggtttgtctttcaatagatgttactttacaatcagggccgcaaagtcatatatcaggctagtgctaggcactccacagtgtttatttcatttaatcctcacgatatccccattttacaggtgagaaaaatttagttttaggttaaacactgctagattactcactagtggaacaagaagaaattaagcttcaaatccggtgtgcttttcaaacttctgttcataagttagagaacacctgtggaaagtcttgtcacttaagactgaaaacttaatacaaatgatagtgataactcatttcgtgtgaatgtttctgatggttgggtatgtcttttcctacaggagagtaagtataagaatgagcattgaactacaatcagtttctaatccagttcacagaaaggttggtatttagtccttttttgaaatatcatttcggtacattgtagacaattagttttgttctttaagaatgtgacatcttttattgcatttattttgcttttacattttaggctattttgcaactgttggaaatcaagggtggtggaatctactgagacaacaactgaaggataattatactatatatttcttttttttttttttttttttgagatggagtcttgctctgtcaccaggctggagtgcagtggcacgatctcggctcactcacctcccgggttcaaacaattctcctgcctcagcctcccaagtagctgggactacaggcatgcaccaccacgcccagctaatttttgtatttttagtagagacggggtttcaccatgttggccaggatggtctcgatctcttgaccttgtgatctgcccacctcggcctcccaaagtgctgagattacaggcttgaaccactgtgcccggcctataccatatatttctaaaacatacgtgaaaaattgtggggtggggtgacattctccttagatttgcccagtgcacttagaagttgcatattatatatatataataacatatatataaaaatatattttattgctgttggtcatacacacacacacacacacacacacacacacactgctgccttgtagaattggcatttcatggtataaatgtaaaaacaataaaccgaagtactgcagggagatatttgtgaatcttttactttacgttttgaagagaggcatttagagtatcagtctcatataaccttcaaaagtgtgagtcattaacagaactaaggatatagaatagaggaggggtccccaaccccctggccacttactggtacggtctgtggcctgttaggagccaggctgcacagcaggaggtgagtggcaggcagggaagcgagtgtaacctcctacgatccacctcctgtcagatcagtggtggcattagagtctcataggagtgcaaaccctattgtgaactgtacatgcaagggatctcagctgtatgctccttatgagaatctaatggctgatctgaggtggaagtttcatcctgaaaccatccttcactccctaattcttggaaaaatgtcttctacaaaactggtttctagtgccaaaaaggttgggggccactggaacagagaactaagaaatacggcatctgtgccaagggcagtgcctcacacctgtaatcccagcactttgggaggctgaagtaggcagattgcttgagccaggagtttgaaaccagtgtaggcaacatggtgaaatcccatctctacaaaaaaatacacaaattagctgaatgtggtggcacactcctgtagttccatctacttgagaggctgaggtggaaggatcacttgagactgggaggttgaggctgcagtgagctgtgagggtgccactgcaacctagactgggcgacagagcgagaccccatgtcaaaaaacactgaaatatagcatctgttttctgtgtgccatagctttccctgaacacattcaaggacctagtagtattaatagtacctttggttttttaagtagcatcctgggtgaatttcaggaagtacttaaatagaagctgcttaagaacaaggcattctgaggcagagcaggtgcctaaattactaattttccagagtagagatgatatattatacttcttacatgttattccttatgcctgctgtacctcttcattttctagcttggtgcataagtggtttagatttttctaggatcttagcatttcctcagtagacatgagtagagattttatttcaaatgaattcttaaccttaatgcccagttctttattagttttacatcatcttgtaactaatgctgtttttctttcaccagtgttctctggtacataattttggtgtactttttgtgagctctagctgttatgatggtctcccacactatgtacacgtagctacctggaaagtgatctttatgaaaggtacttacttcatttgagactgaaaacagttgggcttccatatcagtggccacctggcctaggagagaataggctctttggaagaagcctggcaacgtgttacctgataccctggtcttctgagagacagaagctcttttttctagtgtggattattgtcagttctgctgatatatttgccacttttgaaatgccataccagttaactttaaggaaactaaaaataaaattgaatgtggtatgttcagtggtaaagaaaattttcatcatgttatggtgtagcaaggactgggtctaaatttccccaagcctctgataggaggatattcctaaactttcaactcctagcacttgcttaacttttacagacctccatgtggcttttaaagagcggaatgtctacccctatttaagattctaactctctaaagactaataaaaaaccagcagcactagaaaacaaagctgtctgcaatataactatgatacactgatgttgttggatttctttacttctgagaagaaattactcaaaaggccagatctagtaaaaacatttaaaaacaacaaactttcttttaggacttagttattcgtctgactgatgacacggatccattttttttatataaccttgttatatctgaggaagattttcaaaggtaactaaatttttttctgatcttatatttagtgaaaaaataagtttctaagttttattggtactgttctctttcaaacacatacctacatattagatttagttactttgggaatattgggctatttgtactatctttacttagggtgttttggaaaataaatattttgtgggttattagaattctgcttaaaacacctgtgaagtttgaagcttttgctgaatttattgattttttttcccattgaatacgttctataaaaatcagagttccttagcttagttcttgattataacaagcgttagtaaatttgaaaaaagaatccttcaggatgctaattataattaaagatagtaattggccaggcacggtggctcacgcctgtaatcccagcactttgggcggccgaagagggcggatcatgaggtcagaagttcgagactagtctgaccaacatggtgaaaccctgtcttaactaaaaatacaaaaattagccaggtatggtggcatgtgcctgtaatcccagctactcaggaggctgaggaaggagaatctcttgaacctgggaggcagaggttgcagtgagccaagattgcaccactgcactccagcctgggtgatggagtgagcctctatctcaaaaaaaaaaaaaaaaaaaaaggcaccaaaacaaaacaaagttaattaaaatttttaaaaaatttcttttcctttcttctgtatagtttaaaattccagcaaggtcttctggtagacttcttagctttcccacaaaaatttatagatctccttcagcaatgtactcaagaacatgccaaagaaattccaaggtaagttgcatgagaatgctacattattaaatttaattcaagacagactcttctttgaaacacaagttgatggcaaaatcttttccgtttattatgactatccctgtttatttttagaactggggttaggcctccattaaatctcagactttaaggcatcttgattaaaatcagaaatatttcttaattttcatgtcttgacaaaggcactaaagtcatccgaaatatttagcagcatcaaatatttggttttataatgatattggaaaaagggaagactaagattgtatgtgtgtatggtgctaacgcctgattcttttactgtaaagttcaccatcaaccttttatttattggttttatcagttgacgattgttgttgaatcagttatttcattaggaagaacaaaatgatgcttctgtataattttttctatattaagtataattcttctataaagaagaacttttcctcagcaattagggctatttgattactcagaaaattcataaaggataaatgcttaattcttgcatttaaattgtcaatttttagagtaaagagctggtagtctacttttgtggcactcagtgaatttttgtttctagtttttgctttttctctcatttgtttctcatgaactcatggacttttatgtagtcactgtgtttcagtcaatcttttcttttttttgcccaatttatcttttaccattgggagtcctcaatgtgctccctttcctgagctttcttaagtagagaagcttctgattcagtgagagattttcactatctcttaagtgtgttataatgtaacattttcttttcaaaggtttttgctacagttagtttctccagcagctattttggataactcacctgcatttttaaatgtggtagagacaaatccttttaagcatcttacacacctctcactaaaacttttacctggaaatgatgtggagataaagaaatttctcgcaggctgtttgaaatgtagcaaggtaagatttaaatttaagttattcttttaacaaaataagtatcaatggtctttgataaattattgaagagatacattgccataagtttttgttttctaaataaagttttatgaaatataacgaatttattttactgtttcttatttagtcaaggtatagtcgggatggatctggaccaggaattgagaagcttaggtctcagggtttttaccaatcgtgtgattttggacaggtcacttaaactcttctgtcatggtttcatcaactggtagacatgtatggaaatagctaccctatctagcccatctttttttttttttttttttttgagacggagtctcgctctgtcgcccaggctggagtgcagtggcgggatctcggctcactgcaagctccgcctcccgggttcacgccattctcctgcctcagcctcccaactagctgggactacaggcgcccgccactacgcccggctaattttttgtatttttagtagagacggggtttcaccgttttagccaggatggtctcaatctcctgacctcgtgatccgcccgcctcggcctcccaaagtgctgggactacaggcgtgagccaccgcgcccggccctagcccatctttaatgagataagatatatggaaatgtcttgaaaattataaagtgctatatggcacaaggaaacaacatagggatgctgcttgagtttttagagtctttctagtcaaatgctatagatcagtgcatgtcaaactttaaattatctggggatcttgttaaaatgatttagatttgagatggagcctaagaatctgcatttctaacaggcttccaggatgatgctgatgctatactttgagtagcatggctatagatgattacattgtaaactgtgtaattttattatttttatgaataggaagaaaaattatcattgatgcaatcactagatgatgctactaagcaactggactttacacgaaaggtaattcaaatttcattttgtctttgtaagtcatccagacattggcactgaattgcttccttgactcagttccaagcttttatgtattttctttcaaagcatgcttccgttgaatttccattcctctttgccacccttcaactaccacttaattatcttaatttgatactttctcttgtacatacttgattttacacaaacatttctgtatccccaatatataacatgttccctcgagtcttcattaaataagatatgtatgtttctgtcatatattagttctccactccccacttgttcgcctcattcctctggcctaaatggcttttcagttcctatgctctaaacctttccctttctttgctatgtttagaattaattcctctgataggcttagcatcatttcagtcatagctacaacatttctgccctagttcatgaaattgaaggccagagtatctgttttagcttgttcttgctttgctttaaagaactatctgaagctgggtaatttataaagaaaagagatttaattggttcattgttctgtaggctgtacaagcatggcaccaacatctgcttggcttctagtggggacctgaggaagtttacagtcatggctgaaggcaaaggggagcaggagtgtcacatggtgagggtgggaggaaggaggtaccacatgcttttaaacatccagatctcatatgaactaactgaatgagaacttgcttaacaccaagggaatggcactaaaccattcccatgatccaatcacctaccacaggccctgcctcctctgttggggattacatttgaacatgagacttggaggggacagacatcctaactatatcggtatctgataatctgcatggcctcatgcagaaaatacccctgcacaatgtggcccacagggccatgttactgggttttatatgtaagtgaactattccttataatcgacttgcttccccttacccctctttattgggtggtaaagagccagatttaattaaaagctttaattaaaagatagttaatcttgacctgtgggccgttttgggtctaagattgttcttattctaatgttgatttcctaaaattaaaaaattttgtgtaggaaaaggctttgaacatgtcctgaaaagctataattttgttttctttaatatccttgtaaatattgctatattctaatcaaaattattacatattaaggagcctatcttaatattttgtgttaaactctaatgtagacattagcagaaaaaaaacaagaattagataagttacggaatgaatgggcgtcacatacagcagccttgacaaacaagcattctcaggaactgacaaatgaaaaggaaaaagccttgcaggtaagaacattaaaggaaactgaaaaaatatcttttattgctgttagtcattttgttaattttaaaagtaatatatgcttgctttaaattttccaaacgttacagaagtatataaaataaaaataaaaatcctctctttcaaagtcttactacctagagataatctataaacattttgatgtatttttttcagacttttctctacgtatatgtaaataatatgtaatttataaatatttgtttataaacttataactctgtaaattatgtcatttatatatgtacccatataatgggtttttggttttgttctatactaatggggtcttattggatatattgattgtaactttcttcgcttaatgtgataccattctgtatcagttaagatattcctttttagtgactgcagagtattcattttttgggtttaacttaaattatttaactacttgcctaaatggtggtcatttaaatgcttcgaagttttggttattttaagcaatactgcaagaagcactcttagtttctagaagtgaaactgcaacatatctgtataaaatattgatggatactgcaaatttgccacccaaaaagactaaaccaaatggaatcccaaagataaggtagtgtataaggatacttatttccccatattcttgacattgtttttaaccttcttaattcttcttttttttttttgagacaaagttttgcttttgttgcccaggctggagtgcggtggcacaatctcggctcactgtaacctctgcctcccgggttcaagcaattctcctgcctcagcctcccaagtagctgggattacaggcatgtgccaccatgcccagctaattttgtatttttagtagagatggggtttctccatgtcggtcaggctggtcttgaactcccaaccttaggtgatctgccttggcctcccaaagtgctgggattacaggcatgagccactgtgccctgccacgttcttaattcttaatatatgccacctgatcttaaggtagtactagttttattttatatttcttgtattttttgtgaagataagcatcttttaatacaactttttatcatttttatttcttctatggattattttttattttcttttcatccctttttctgtgtggttattttttttttttcactgtgccctgccaccttcttaattcttaatatttgccacctgatcttagtactagttttagtttatatttcttatatgttttgtgaagataagcatcttttaatataactttttatcatttcatttcttctgtggattattttttattgtcttttcatccctttttctgtgtggttgttttttttttcattttttatttttagatggagtctcgctctgtcgctcagactggagtgcagtggcactatctcggctcactgcaacctctgtctcctgggttcaagcaattctcctgcctcagcctcctaagtaattgggattacaggcgcatgccaccaccatgcctggctaattttagtatttttagtagagatgagtttaaccctgttggtcaggctggtcttgaactcctgacctcgtggtccacccaccttggcctcccaaagtgctgggattacaggcatgagccaccatgcccagctgtggttgttattttctactgctttgtagtatgaattccttttctacctttcgtactatagcttctttttttttttttttgagacagaatttcgctcttgttgcccaggctggagtgcaatggcatgatttggctcattgcaacctttgcctcccaggttcaagcaattctcctacctcagcctcccaagtagctggaattacacatgtgccaccatgcccggctaaattttgtatttttagtgaagacggggtttcaccatgttggccaggatggtctcgaactcctgaccttaggtgatctgccctcctcagcctcccaaagtgctaggattacaggcgtgagccactgtgcccagccttatagcttctttaatattacattttattgttgtttttatgtactttactagatgcttgctcttaagagtacagcttgatgatttttttaaatgtgtaactttcacccaaattaagataaagaaattggaccacccctctaggttcccttgtatggcttcctagtcctaacagtagtccataggaggttatcatacttctgacttacatcatcattcattagttttgccaattcttgaactttgtgtaaatggaatcatatatgtttgcatatgtctttcttcactcagcataatatttctgaaattcacctattttctattgtttccttttattgttatatgaatctgccataatttattttcctattggtaggcatttgagttgtttctggtattttgctattattagttaaactgctattaacattcttgtacttatctttttgtggacacatgcactcatttttcttggatatttatctattattggaatggctaggttgtagtatatataggcatatgtttagctttggcagaaactaccagtttcccaaagtaggtaggtataccggtttacattgccattctatgggtatgtaatactatctgataataatgaacacttcttcatatacatatttatcacttgaatattctcttttcaagtgcccattcaagttgttagcatgtttaatttgcctattattagtattattatagatttgtaggaatttgtatattctagacatgagtcctttgtcagatgtatgcattgtgaatattttcattgtctatagcttgccttttcactttttattggtataaattaaggatatacaccttatctatcatgtacattataaacatttctcccagcctgtcatttgccagcatcttttgccgtatatagtttttttaatttgaatgtcatcaaatctgtcagtcattgcctttatggcttaagatttcatttcacatttggaaagtgtttcccacccgaggactatgaaaaaattctcctatattctaatatttgtttaattttcttgttatatttagctttttaatctacttggaatataattttgtggagtataatataaggtagaatttttttgacatatagtcagtcattgttccccaatgatttaaaatactacctctattattttatttcatttttattttttagaggtagggtcttgctctgttgcccaggctggagtgcagtgacacgatcatggctcactacagcctcaacctccagcgatccttctgcctctgcttccaaagtagctgggactgcaggcatgtgtcaccacaccggctgattttaaaatttttttgtggagatggggtttcactatgttgcccacgctggtcttgaactcctggcctcaagtgatcctccttccttggctttccaaagtgctgagattaccaacatgagccactgtgcctggtactacctttatcacatactaaatttctttatgtacttgggcttgtctttggactgttgttaagaactgatctcattttctcgttcagtggagagatgtatctcttcatttattaaggtcttatttgttgaaaacagacttatttactctctctctctctccctttttctctgttctctttttcttttgcagtcttgttaaacagtgtttttggctagggactttacagatttttactgcataaatgagaccatccactccctaccagtaccactgtggttaaatttataattgtttatcagtagtgtatgttaatgtcatatccagccaccttactaaatttacatactgtttctaagagttttggaattgattctcttaggttttccaggtagatatgtaaactataaaaattagtaattttttctcttcctatgattagtgtccttttttttcttgcacagaaaaataatagtggaatttttatctttttccagtcttttttggtaaataactaaaatatctcactgttaaatatgatatttgctttgcatttgagagaaagggttttcttctcttccttgctacctgagaattttaattcaaagagtgctaagtcagataaaatgagttttgggatctaaccaaataattacgtcatttttcccctttaatagtgtagtaaattataacaatagatttccaaaggtggaatcatctttgcattcatagaataatacttaaatagtcatagcgatttttaataaactattgtatcaatttgctattatttaacttgggatttttgtatttttatttatttaattttagagacagagtcttgctctgttgcccaggctggagtgcagtggtgtggtcccggctcactgcatcctcagccttccgggctcaagtgaccctcccacctcagtctttggagtagctgggaccacagatacagaccaccaggcctagataattttttttatttttatttttattttatttttatttatttattttttttttagagatggagtctcactatgttggtcaggctggactcaatcttctggcctcaaatgatccatctgccttggcctcctgaagtgctgggattacaggcatgaaccaccatgcctggcccaggatgtttgtatttatattcataagtgacattggtctgagattgtctttttcctgcacatcatagttcgcttattgcaaatgtgggttatagactatggtattagaattatgctagcctcatgagatgaataaggacatttttcagttttctttattctttgaaacagtgaaataacagggaattaatctgtaccttgagggcctgatacaattagccttttaacaccatttggatcactcacctagttgaagcatttatctttttcttttccagttttctccatgattattggtctgtttaaattttctcttcttgagttttgctaatttatattttcttaaaaagccatgtgtttcatctatgtgtttttatttttaaaatttattatttttttttatttttgaagatgaggtgttgctatgttgcccaggctggactcagactcctaggtttaggcaatcctcctgcctcagctcctctagagtagcagggactactggtgtgtgccattgtatgtggctgttatctgtgtgtttaaatatattagtacaatatcgtgcatattgtcttgtgatttttaaaatctccatattatttctcttatgttcttaatttgttttgtttaacgcgactaggtggtttttctattgtttagtgttttcgaagaactagtttttcatttcattaattagttctacactgtttctccccctatttcgttaatttctatttactaccttttcttttttttttggcttgattttctttttttttttgagaccgagtctcactcttgtcacccaggctggagtgcagtggcatgatctcaactcactgaaagctctgcctcccgggttcacgccattctcctgcctcagcctcctgagtagctgggactacaggcacctgccaccacgcctggctgatttttttgtacttttttttgtctttttagtagagacagggtttcaccgtgttagccaggatggtctcgatctcctgacctcgtgatccgcccgcctcagcctcccaaagtgctgggattacaggcgtgagccaccgggcccggccttttttttggcttgattttcaagcaagttgtgttcttcttgacgttgttgttcgattcaggggtacatgtgcaagtttgttactggatatattgcttaatactgaagtttgggcttctgttgaactaatcacccaaatagtaaacatagtactcaataagtagtttttcaatctctacctcactctattcctccctcattttggagtactccttgtctattgtccatggaaacaagttagatctgaaagtttcttcataagggcatttgtttaaaactccagagtgactgaaggatttgtttgtatttctgtattgcactttctgataggattgttaggcagcccttcgggactttaaaaccaggtcaacacttctcttcctgctaatagataatgtaaaactttagtgtgcgtgagaatcatttgaagggtgcattagaatgcagattgctgggcttcatccccagagtctttgatacagttagtcgggggtggagtccaggaacttgatttcctgataggttcttagctgataccgattattctgttcagaggaccgtactttgataaccactgccatagtgtgctctttctcaaattaggccaattttgtgactatatagaaatctgctgaggcaggtaaactgccttctattattactgatggtttctacaaatgttatagggaataatggctgtattatctatatttgtcacttatctattcaagtggacattaaacctgtgttatctttaaggcattttaatagggcaaatttgattcttgcattttttatttctctttatgtttacacttatttctcatgttttctttatacctccatttaaaaaaatatactgagtaatctgaattgtttctacactaatttctttgtagaagctttttttctgtgaggaaagtcctagcaacacgtagaatcacccatcttccttctatttattgtattattttcttaattctgacttctatatttcatcacttcttcatagaattttttattaatttttgttttcccattcatatcattattattccattcccaaaacatttttctcatctaatattcttccaaaactactgtgtgcttttctgatttaagcctctatagaatattcatttgaaaaatattgcttccacctctacaaattctcccttttctgttagactctattattttgaaactgtccttccaatgattattttttttcctccagaatggaaaatttttaatgtatttttttctaaaaataatgaaatgattcagaagggaacaaagtagaaaatgtgaactttataatgctagttctcacactttttttttaaacaaaaatctccaaggttctgatgagcactggaataaaaaccagttctttattttcactgcttttggcctctattgtctttagtgtctttgattactctcttagacagttacagttagcatctttaccagtttgctctgatttttcttcttggttgcttcttcaatgttttcttccaagatggcattttcaattttatatggactgcttcctgttttatctctttttgctccttctcctctccttttcagctttctgaaaatgaggaaattcctgaagtagtaatgtaaaattcctaaggtattttatgagagagacactcccctgtactagtgctaagacttttgaatgggtataacttctctgggatacagttttggaacttgcatcaagctttatatttgtttatattctttattctataattgatcataaagaaataatctgaattttagatgtatgtctgtgcaaaaaaaatcatcattttatttataattgtgaaaaattgggaactaaatgtccgtaatagggcagaagttaaatgaattatggagtaaccatggatggaatgttgtgtagctattaaagactttacaaagaattttttaatgatgtgagaaggtgcaaatgctaagggattaaaaagtgtgattaaattgtataaatagtttgatattcattcattaaatttaatatgtatattgtgtgtttatgtggatgtcaatataagtatataaacgagtggaagagagtactcctaaatattaggagtgatttttctggatgggattatgggttatttgtgtttcctttttgcctgtaagagcatgtataactttgataaccacaaaaatatgctttattttcaaaagatatttaggatttcatagtgttcgttaacaaaagttactaagataggtttgtgatacgattcagacaggcactaaatattgcacagttataaccatgttcaaattttattgttggtaaaaatgactataagattggactaatgaaccaaccttgctcgttttacaattttaggtgtttttccattataaagcatatatacgagtatttattattaaaaactgaaacactgtgatggtgtttaaagcaaaaatctgctttttttttaatacacaagtaggttcatcctgtatacagtatttgcagtttgcttttttaacttatatagcatcttcccttaacttgaagactgttgcacctaaacatatatggatttagaagaagcaaaaattatgaacaagatcatggtggtaaatttgcttttgttgaccttgctttctccgtcatgaaattcataattgaaaatagacccttttcagaatggggatctaaagaaagatgacaaaattaagacaaaaaagaaaaagaaaaaataagaaattacaatttttttttgttcaaatctttctgtatttgtatttctgatttttttctttgaattttggtactgtatttttattgtatcataggcacaggttcaatatcaacagcagcatgaacaacagaaaaaagatttagaaatcctccatcaacaaaacatccaccagctacaaaacagactgtctgagttagaagcggctaataaagacttaaccgaaagaaaatataaaggagactccactattagagaacttaaagcaaaactttctggtgttgaagaggtattgaatgttgttttttttcctcccccaatttaagagaacgttttgatttggttattttaatgtggttacttgtgtgggtggtgttcctctggatgctcttgtggtgttagggtatccattcagacaatgcaaagaaaattgagaatttgaaatttgataaaaagcataattcataacagaactgaggtaagcttgaatatttttagttagggtcttgagagcagattactggcacagctgtcagatttatcaatatgtttttaatagtaacacagcacctgtatttcatagggtactgtgttgacagggctggggttttttttcctcaacctgcttaacatatatcaaacaattatgtgaatttagtatctagtaataataatgataatggtaatagtaaagataatagttaatgcttactgagcattttctatgtgataggtactgtttgaagtgctttacatatattaactcattttattgttacaacagttatttaaggtaggaactattattagccctattttacagatgatgaaactaaggcacagaaaggttaaataagttgcctaaggtcacatagtcaaggagtggaagaacaaggattagaactcatctattatttgactatctttaatactaccttgttctttcaggcaacagagaaatttttattttttattttatttattttatttaagttccaggatacatgtacagaatgtgcaggtttgttgcataggtaaacatgtgccatggtggtttgctgcacctatcaactcatcacctgggtattaagccccacagaaatttttaaaatcttgctatagtgccacatttgttgttgctttggcattgattacaggcttctttgtagcattatatattattgtcatatgaattattagaaaatatatgtagattttgtctatatttaaataccaaagttaccagtgttattctagctcacaagacttcaaactctattttaccagtctcatgcttagaagctctaaagcctgaccaattttgtgttcagatcctcatattgttttgccccaataatagatgtcttctgtttttcctgcatacactcttcatactggttgtaaagcatttgaaccttcatggtacattggtagtctaaatgcttcagtataatgctctgatttcattattctcagccctggaactggtcattatataaacaacctcattgcattgatttttatatgatctaatgaaaatatttcctccaagattttcataagacttgcaaattgttagttcttggagcttttttttttaactgctgagtattcagttacctattttaagtaacaatttttaggcattagtgtcctaaaaataacaattgctaccatttattgagttttactgtgtgccagccaaaatgctaggcaatttacgtaaggatttttatgaaggttaaatgaaataatttattaagtatttgttatttctgttttacaaatgagggaactgagatttaatttagggagtttcagtaattaccaagatcacacagtagaagagccaggatttgaattttgtttgatactaaagtttgtgctcctaaaaccactatagtcacaatactgtataattatttttggaaactttggttaagaactaaaactatctaggaatattgtatcctgggctttcatataccagcagcatttgggttgatattagctgattgggaagagatctattgtagattttttaaaaatctatttttaatgaacaattattgtttattttgcttgaaagagtgaacagagagatctggaaatgttaacatttattgacatagaaagatatttgtaatacgtgaagaaggtagattataaactgcagagtatcaacctttaaaaaacaatctgtacatgtaagcaacaaagaaaaatgttaagtctacattgtggcggctctcacccgtggttacccttggaatcagttgtggagacatcagaaaattattgttaaaagttttaaagttactgtaatttattcataaattagaattattttcccttgatatgattgaatcagatagtagaatattttacaattatattccagatatatgctactataccattagaaagacatttatgcttttaaaaaaaaatctgtactaaaactttaaaattattaaagacttttttttaatatgttagacatcttaattataaataaccagatgaggcagcttccttttttcataatgcttaatttctttcttttcccattctaggagctacagcggactaagcaagaagtcctctctttgcgaagagagaattctacactagatgttgaatgccacgagaaagaaaagcacgttaatcagctacaaacaaaagtggcagttttagaacaggaaatcaaggataaggaccagcttgttttaagaacaaaagaggcatttgatacaatccaggaacaaaaggtctacttttaaatttttctcagaaattgataatcatatttataagtaaacacaaatgccctaattattcatgtttttaaaaaatatatcaggtggttttagaagaaaatggtgagaaaaatcaagtacaactaggaaagcttgaagctacaataaaatcattatctgcagaacttctgaaggtttgttttaaaaattttatagactagtatttcattaaattacatagaaatatacatatgaagctcttttataggcaaatgaaattatcaagaagttacaaggggatctgaaaactttaatgggtaagttgaaattgaagaatacagttactattcagcaagaaaaactcttggctgagaaggaggaaaaattacaaaaggaacaaaaggaattacaagatgttggacagtctcttcgaattaaagagcaagaggtagttaatattttaaatttttatgttgtaactaaattttttcctcgttttaaaaatttatgctttgttacattaacaaatggctttggtcttgtttttttttttaacaaaagaacatgactagattgagtagatggtaataacctgtttcagtttggaaagttagttatcatgattcagataccttgattgctcatgtatgtctatgtttgtatacacatgtaaatattttattacataattgagctaattcctttattctcatttaataatagtagtagtaaccatttatgtaattatttagttaataataatacattcttcagtttttatttaacctttattttgcttgacttattgtgatgattgatatatttcaggtatgcaaattacaagaacaattagaagctacagttaaaaaacttgaagaaagcaaacaacttctaaaaaataatgaaaagtgtaagtatgttacgtgttaatgtaaatgaggtttgtagttttattcttttatttttttgagacacggtctcactctgtcaccgaggctggagtgcagtggcatgatctcagctcactgcagcctccaccactttggttcaagttatcctcccgcctcagccccccaagtagctgggactaaggtgtgcaccaccacactcagctaattttgtgggttttttttgtagagacgagattttatcatgttgcccaggctggtcttgaactcctgagctcaagtgatccacccgccttggcctcccagattgctgcgtttaggtttacaggtgttagccatcgtgctcggctgtagttttattcttaacctgaaaattttattcgaattcataaaagtagacattggccaatatataagtaatttctgctttaaatatactgtcttaatgccttttctataataaatttatatcatctgcccagtaaaagagttatcatctttataaagaaaaccatatcccataggtcagtaacccacaattaaaactgttgaaaatgttgactgtaatttattgtttaaattcttcattattcctttttttaatagctgtgtttacctaataataacaatatgaattgtttgaaaacaaaacataaaaataagattttaactaacattttctcagtttatactactgggtatcatacataagattgtgaattttaagtaaactgtaagatattctagaagtgaaatctttcaaagagttgcttgactagcagaaatatgtgcttcggaaagtaatacaataaggagtcctatgtggcagcttctaaaataagaaactttaatgacaaaaatttaggtgaacctatattgctctcctgtgatgtcaggtagttgtaaaaacttataatttaaaaatcttaatataatttttaaatgtttaagatgattagaaaaataaacagtcaatattctttaccttgcttcttgttcttttatttaagtaatcacgtggttaaataaagaactaaatgaaaatcagctagtgagaaagcaagatgtattgggaccttctactactccgcctgcacattccagcagcaacacaatcagaagtggaatttctcctaacctgaatgtggtaagatttaaaacaagatgtgagtgatcttagtgaatttcctgaaacaaaagtatttccagattgttaggaagtttccatgatttaaggtgctgataccaatacaaagtggagtcctacaattgcactgaaatagagtttaagttgcccctggaagtggaacaaaggcacacttgctctgaacagaggctgagtttcaagagcacatttcttttttttgttttgttttgttttttttttgagatggagtctcgctctgtcgctcaggctggagtgcagtggcgcgatctcggctcactgcaagctccgcctcccgggttcacaccattctcctgcctcagcttcccaagtagctgggactataggcgcccaccaccacgcccagctaattttttgtatttttagtagaaacagatttcaccctgttagccaggatggtcttgatctcctgacctcatgatctgcctgcctcggcctcccaaagtgttgggattacaggcgtgagccaccgcacccagccaagagcacacttctttataagtcttgactggatattgaaatctttcaatgctaactaaagtaataccaaatatactgaaaaacttgaaaacacataacgtaaaacatttaggagacttgaagaagagagaattcagggtttaggcttaagcctaaactgaattctatcagaaaaagaaaagaaagtaaaaaagaaaaaagtcctattagcaggcttgtcacctttagattctacaagaaactggttatgagatataaactttctagctcccaggaccagatttttttctcttttgagacaagacctcactctgttgccgaggctggagtgcagtggtgggatcatggctcatggcagccttgacctcctgggctcaggcaatcctcccacctcggcctctcaaagtgccgggattatagctgtgagccactgtgcccagccctgcttttttttttttttttttaacctgagaaaaaagggaggctgggcacgatggctcatgcctgtaatcccagcactttgggtgggaggctgaggtgggtggatcacctgaggtcaggagttcaagaggtcagcctgggcaacgtggtgaaaccctgtctctactaaaaatacataattcagttgggtgcaatggtgcatgcctataatcccagctactcgggagactgaggcaggggaactgcttgaacccaggaggtggaggttgccatgagccaagatcgcaccactgtactccagcctgggcaacagagtgagactctatctcaaacagaaaaaaggcagaataggaaaagcagcttcttacattcagaggtggtttggtactatctgatagttaggcctaggtgctgctaggagcttacctagcatccgcacataggcctggggctctcctgttgaacacaacaatttcatggaatattaacatcaggcaaggttactctgtgactctgtcaatacaaaaacaagactgtttcataatcatgcctgaatacagacaaaaatatgaacattgctaaatcacagatatggcccataagcatcctcatatcctggctaacatgaatggctgctgctgctttaattacagctttgaccttaatacattcctcttgctttattagataggatttattcagatacccagtcatacatttatccccatttcccagtagcttccaatccacagcaaagcaccacttaaactttttcttaaatcacctaacatgtgcctaaatccaataaataagtcccttttaatacccacttttggagatacccatgtttgttcatggtgtgcagtttcccttgttgcaaggagcaataaatctagctcgtatatctatacatgggttcctggtggtccttggctacaggacattggcagaaggtttaaaattcagattcctaattgaatttttaacctaatctactctggtaagtcagagtacgggatgtctaaagaaggggaaagattgctgttaaattggagaagggtgcagaaagaagtgcctggggctgaattacaaacttaaaaaagattttttgtccggcttaaaatttgaatgactgatgatagctgtgtgaaaggtgtttttttgtgtgcatccattagtgtgcacaaatgcttctcaagatttctgttacaactggtctcagtataaaaataaactttttcataacgttggttaatgtgtggtgccagtatattgaaaattagtggcaaaaccaattactgtctcaattagtccatttaagaacactgatcttgtttttatgcagtctgacagaaaattagttttattttatctctgattggcctattgatctccagactcccccattccccccttttttaggagacttagagtgaaacaagttggttcagaagcttggctttaacttagtacaaaggcaggcccagtagtttgttttatccaagcttgcacacctaccttgaaaagccctctagttcaaagttatcctagccccatggtagataataaagcagagttgtgtggcatgataaacaagactggcgtctgagatagtgctctcttaattattagttattataacagatgctaatgccacctgatcaacaaatactatttagaattaatttatcatctttaatcatctttatgtttttatttttaggttgatggtagactgacttacccaacctgtgggattggttatcctgtctcctctgcatttgcattccagaataccttccctcattcgatatctgccaaaaataccagccaccctggttcaggaacaaaggtagccaaattaactaatacttgttctgggaaaaaatatagcaacctattagcatacaaacatttcacatcttttaaaagttcatttattctttggtcagttgttaagtagtaggtagtgtattagataaatacattactgaatatctagtatctatgtgtacaggaaatatatgcactatatatttcttgagtcactgtaatttctaaaatcttgacatcagtctgtttaaacctcacttatttctactcaacctctcctttttttttttttttttttgagacagtcttgctcggttgtccaggctggagtgcagtggtgtaatctcagctcactgcagcctctgcctcctgggttcagtgattctcgtgcctcagcctcctgagtagctgggattacaggcatgtgccactacacccagctaatttttttgcaattttagtagaggtgaggtttcgccatgttggccaggctggtctcgaactcctggcctcaagtgatccgcctgccttggcctcccaaggtgctgggattgcaggcctgagccaccacgcccggccagcctttccgtttttattcattcttctacttgtgtctcctacgctctcaggcctggctaggatttctgacttcatactgttggagtctgagctatgatttggagtccattgctagaatttaaaggtctggtagggcaggcttaaatcaaattctaaaatttagttctgacagcattatctcagataagatatgactagcaatccccccaacccttgatatatttgttaaggctttcttctacctacttctttttcctcatttttattattatcttagatttatgtattttttatgtattataattttgttttcacaatagtttaatccacccagaccagtcactgcttttattttcattgctaacttcagatccaggtttattttttcttaaataatgagacaaataaacatttatgaaaaaatattgtataaaagataaaattgaggactttgaaactggtattacaaactctatcaaattaggtctgggctactctaaaaataagttggctgtgttgcttaggcatgtgctctttttagccatagccttattattgccagtagctatggagaattctcagttaaatgaaaattaagcctgagtttttatgcctggaatactgttatgtaaagagtacttagatgcatataactggctcttcttgcattgcttattaaggagaattagatatgtgcattcgaaggaatgtctattgttttattatcagtttcagtatactcaagtgtcgttgtatcttgggatcattttttttctttagaattataagtgaattcacagttgttttttatttaaacaactttccaggaatatatatataatgtccaaaatgaggacaagtactactagagacagttgcctacttggtaggactaaagatggcttataaaataatactatcattcttataggtcttgtggaatcagaggaatcattataataattatgttcttaaatacaggagcaagactttcagtgtttcctgtatcggtgatctccatattcttttaattatgtatccctaacagggaaaaaaaaaaaccctaaaacagaacaatttgcgctctcatctcaaatacattaatgtgtatttatttgtgaatttatgcatatactactgaaatactatatgccgtataattattggttaagaaggcggaatctgatgttaggatttaaaacctgcctctatcaacctgaagttgatcaagccactgaaaaacaaacaacattcaactcttacacttcagttttcccacttataaaatggagtgataattttctctaccttactggattattgagttaagtgaattaatgcatttgcttagaatagtacctggttcatgataagtgctctgtaaatgttatattattaataataaaatatattcaaaaatagaaattaaagaatcagactaaaaatggatgtaaatgaaagttgtaagattttcttctcagacctcagtgaatggtcctaattactgcctactttgtcctccccgactcaaagacccactttaaagcaccaaataccacctactttggtgatcattgatctaggtagttttgtgctagcagctatgttgattaaaacatgtacttttgaattacagtttttaaaaatgacgcttttatttttgacgttgaacctgtgatcttcctgatgtcttaaaatgttactgtcaagattgaatacattcaaggatgtttaactgtgggaatgtaaaataacatgagaaatttggcaagaaacaaaataatgctgaaagaatatgtgagaatatttaacaagattgtgctgttctgacaaatagaacaaatacttgataattttaaagcaagatacacaaaactacgtgttttttctcttttatttttggatacaatgatagccaaagattcattcattgaacaagtatttaatgaatgtctgttatctgctgtggccaggcatagttttagttgcaggagatgacagcagtgaacaagacaaatgccctgacactatggtgcttacattttgtggtgaaacaccagtagatagtaaattgtaatgtctttcaaactaaactgtttattcattcattcatttattcatttatttttgtgacagagtctcactctgtcaccaaggctagagtgcagtggcatgatcttagctcactgcaacctccacctcccaggttcaagcgattctcatgcctcagcctcccgagtagctgagattacaggtgtgcagcaccacacctggctaatttttgtatttttagtagagacggggtttcaccatgttggtcaggctgatctctaactcctgacctcaagtgatccacctgcctcggcctcccaagtggtgggattacaggcatgagcctctgtgcctggcttgggttacattcttgatcttcaaggtcaaactttcatcaaggagattatgaagtatgtgagggattttctgcagtgaggaacgggccagatgattgatttatcttttttcttttaatctggttgaaaggcttagggagacaattctgtttactgttaaggaccaaaaaacaaagtctggaaatgccgtacacaatggtcatgaactacaaaatagtagtggagtggagaggagacacagtaatacacagcattattttgagtgagctccagcttttcattctaacccttgaaccgaggagaaacagctgtcctttttcattgagtctgcaacagaatggaaatgtgactcagtttatcagctcccacagagcaggcagagtaagagactattttaagctggtttggggagcccctatcccaagcatagagtggatgttgaaggttgttcccggcatccactggtggtggcttgtggctagtcctgggctccctgggtcctaggcatctcttgattctcagtaatgaacttgtcagttggccaatgtggacctgttgacaaattactctgaattactgtaaggtctcttttggctttattctctagggtttgagtttctacaggaacgtttacatttttattttctcggaaggaatctcttatcctcctgacactgtaattgtaggtgctgaaatgcttgttttctgtcagtgtcatccagtacagatctctaacatttgtgtgtgactggaggtgccccaaggccctgttgcctcaatttctttatcttggtagtgtttggcccacagtgtgtattcagagacagattttgtgtacagatagcattattcagttgggttaaccatctgattcacctagatggtttaaattaatttttcatttatttggtattaactttttaaaaataatgtgtaagtatgggaagctttgaaaggtacaagaggatgtactatctaaaagtccctactgtggtccccagtcctcttagagaaaaatactgttaggaatttcttatgatatattccagaaatattcagagcatgtattagaccatatgtatgtgcatgtatatgtatatgtgttcaaatatatgagtgtttttatatataaacataaatagtacttgccaattgttctgcgccttgcttttttcatttaatggtattatggaataggtaactgcagtgtatcagaatataagtttttgtttctttttaatgacttcatagtattccagtatacggatgtactataattaactaatactctatttatggatgagtaggtttttttcaatccagatgctcatacagtgctccagcaaatatttttgtgcatacatctcggtggcctggtactaatagatttataggttacattgttagaagtaactgtgtcaaaggcatttttgcataactggtgactaaaatagtatcttattgtaatgttaattaacattttcttgattaaagtgagaaacatctttttatatatttgtaggttatgtttcctgttctgtaaaactcctgtttattcattttttgttttccatttgtttgttttagagatggaaatctccctgtgttgcccaggctggcttcgaatttctgggctcacctgatcctcctggctcagcctcctgagtagctgagactacaggcatgcaccattgtgcctggctctttcttttattcgtttttttttgtttgggaggtttaacatttataaaatggttttataagtgttctttacatattctggacgctagtttgccgttgtttttaatgtgttattttgtaatttttggtttgtttttattcttcattatacttcctttttaaaaatttaaaggttattaaggtagaatttacataccataaaatccttccactttaagattagttcaataattttagtcagcttatagagttgtgaagctataccacagttcaatattagaacatttacattaccctaaaagtaccctagtgcctgtttgcagtttatccttactcctccttctagccctaggcaactactgatcagctgtcactataaaatttgcttttccaagtttcatatgagtagaatcatacaacatgtagtttttttgtgtgtctttcttctttttttttgagataaaatctcattctgtcatccaggatagagtgcagtggcacgatcatggcttattgcagcctcgacctccctgggctcaggtgatcctcctatcttagcctcctgagtagctgggactacaggtgtgtgccaccatgcccaggtacctttttttgcatttttttgtagagatggagtttcaccatgttgctcagggtgatttcgaattcctgggctcaaggtatctgcctgcctcagcctcccaaagtgctggaattacaggcgtgagccaccatgcctggcccatatctttccttttcactcagtatactgtgtttgaggttcatccaggctgtaatgtgtgtcagtagttcttttcttttaattgctcagtagtatttcattgtattgatatgccacaatttgttcattcatcagttgatggacatttgagttgttttaagtttttggatgttacagattaagctgctgtgaacatatgtgtacaagtctttgtatttattgtgggtgagtacccaggaatggaatggctggtggcatatgtttgatttttaagaaattaccaaacttttccaaagtgtttttacaatttaccaccagcagtctgagagttcaagttgttctgcatccttccaacagttggtatagtcagttgtatagccattctaatacatgcatagaagtacctcattgtgattttatttatttattgagacagtgtcttgctctgttgcccaggctggagtgcagtggtgcaatctcagctcactacaacctccaccttcagggttcaagcaattctcatgcctcagcctcccgagtagctggggttacaagtgcacgccaccacgtccagctaatttttgtattttttagtagagacagggttcaccatgttggccaggctggttttgaactcctgacttcaagtgatcccctacctcggcctctcaaagtgctgggattacaggcatcagccaccacacctggcccctcattgtgattttagtttgcatttccctaaaacctaatgaggttgagtatctctattcatgtgcttatttaacatcaatattaaaataccactttggtgatatttctatttgaatcttttgaccattgctaaacaaggttgtctttttattgaattataagttctttgtatattctggatacaagtcctttatcaagtatatgattagcaaatattttctcccagtggcttcccttttcattttctcaatgtgtcttttgaaatacaaaagtttttaatatttgatggagtgcaatttatcaaacttttttcttttgtggatcttgcttttggagttgtatataagaactctgtccaaccacaggttgaaaacattttctcctttgttttcttctacaacttttatagttttagttgttacatttagatctgtgatccattttgaaataatttgtgtgcatggcttgaagtaaggatctaagttcatttttcccccctgctctgaatatccagttcttagtaccatttatgaaaagtctttttctctgttgaattgtctaagcacctttgttgaaaatcagttgaccatgtaaggatttatttcaggattctcaattctgtttcattgatttttatgcctatcctgtgccagtgtcacagcatcttaatcactatgactttatattaaaagttttgaaagtcagtagtataaatctacagactctattcttccttttcaaaattgttttagatcttttacagtttcatgaaaatggtcaccttctcaatttctacaaaatggtttgtttggattttgataggtatataaggaatttataggtcagttttcaaagaaatgctgttttggcagtattgtgtcttccaatccatgaatattaagagtctttccatttatttagagctttactttctctcagtaatgttttgcagttttcaatatataagtcttgaatttcttctgttgaatttattcttaagtgttttattcttttagatgctattgtgggtataattattttatttttcagaatattcattgatgtgtagaaatgtatgtcatttttgtatgttgatcttgtatcttgaaaccttgctaaactcatttattatactcattagtggtttttggtaaattctgttggattttccacatagacagttatgtcatctgaaaataatgacagcttcctttccaatgtggttgctttttatttatttttcttgccttattgtaatggctagaaccgatagtacaatttatttttatttatttattttttgagacagagtcttagtgtcacctagcctggagtgcagtggcacattcttggctcactgcaacttctgtctcccaggctcaggtgatcatcctacctcagcctccctagtaactgggaccacaagtgcatgccaccatacccccagctaattttttgtaattttggtagagacagggttttgccatgttgcccaggctggtcttgagctcctgagctcaagtgatccacctgccacagcctccaaaaaagtgctgggattacaggtgtaggccactgcacccagcctatagtgcagtttaaataaatgtgagagcagacattctggccttgttcctgagcttcagggcagagcattcagtctttcatcataagcatattagctgtaggtttttgctaggtggccatttttcagaataagggagttttattctattcctagtttgctaagagcttttatcatgaatggttgttaaattttgtcaaatgctttttcaattgatatggtcatgtggcttatcttttatcagttaacagattgtattgattgtttaagattatattagcctttcattcttgggataaacttcacttggtcatggtgtattctttttatatatcgctggagttaatttactttttgtttctttttcttttttttttttttggagacagagtctctctctgttgccctggctggagtgcagtagtgtgatctcggctccctgcaacctctgcctcctgggttccagcgattcttctgccgcagcctcccgagtagctgggactacaggtgcctgtcactgcaccagctaatttttgtatttttaatagagacacggtttcgccctgttggctaggctagtcttgaacttctgagctcaaggtcagaggtgggtgatccgcccacctcggcctcccaaagtgctgggattacaggcgtgtgagccccaacacccagcttggagttaattttctgatagtttgattttgtgtccatgttcataaagcatattggcctgtagtttacttttcatgtactgtctttaacaaatttaaatcaggacaatactggcctcataaaatgaacaggaaactgtcttttctcttttattttctggcatatattgtatagagttgctttatattttctttaaatgtttggtagaattttccagtgaaatcatctgggtctggaaatttttttgccggaggcttttttcagctgtgaattaatttttttcaatacctatagaatgtttgggttatttatttcttcttaggccagtttcgatagtttgtgactttcacaggattaaatcatttaatctaaattttaagctatgtgcgaagagttgtttttagtattccattatttttaatgtctatagactctgctgtaacatcctctctttcattacttataatggtgatttttgccttgtctctttgaaaaatcagtttggtaagagttaccagtttcatggatcttttcaaggaaccggcttatggtttcattggtttttcaatttactgatttctccattttaatattttttcccttctaactgccttgagtttgtttggctccttttcttactttcttaaggtagaagattatgttctgatttaagagttctatgttaatctaaacatttaatgctatacatgttgttcagtcttgctttaactgcatttcacaaattttggtatttgtattttcattttcattaagtttaaaatatttttttttctttttcttttcttgtttttgagacagggtcacactgtgtcccccagactggagtacagtggcatgatcgcagctccttgcagcctcacctcctgggtttatgtgattctcccaccttagcctcctgagtagctgggactacaggtgcacaccaccacacctgcctaattttcgtatttttttgtagagacagggttttgccatgtttcccaggccaatctcaaactcctgggctcaagtgatctgcctgccttggcctcccaaagtgtggggattacaggcatgagccaccacgcccagccctattcttttcaagtacacatggaacactaaccaagatagactacgtcctaagtcctaaaccagtctggaattaaactagaaatctataacagaaagatatgtggaagatttgagggaaattagaaaatattttggccaggtgtggtcacacacacctgtggtcccagctgttggggaggctgaggtgggaggatcacctgagcccaggatgtggaggtggcagtgagctgtgtttgcaccactctgctctgtcctgggcaatagagtgagaggtctcacaaaaaaaaaaaaaaaaaaaaaaaagaaaacaataggtattctgtttttgttgggataatgttctttaaatatatctctttgtattatttttattttagtggttgctccaggcattataatatacatacttttcgtagtgtgtagaattaatatcttaccacttaaagtacaatatacataccttgccaccatacagtccctttgccttttccccccttatgttttcatatttcgtatgtattgtatctgcatacattggagacattatcagacaatctataatttttgctatcctccattatacatatttaaaactctggagtgggctgggtgtggtcccttacgcctgtaatccaagcactttgggaggccgaggcacgtggatcacaaggtcaggagatcgagaccatcctggctaaagcagtgaaaccctgtctctactaaaaatacaaaaaattagctgggcatggtggtgggcgcctgtagtgtcagctactcgggaggctaaggcagaagaatcacttgaactcgggaggcggaggttgcagcgagccgagattgcgcctctgcactctagcctgggtgacagagcgagactccatctcaaaaacaaacaaacaaaaaaacacaaaaaaactctggagtggagaagactagttcgttatattacccagtgtttaccatttctgttcttcttgttcttttccttcattcctggtattctaagttcttctacagtataatttccctgaatgatagaacattcattagcatttcttttagaggaagtcttctgtcaattctttttcttcccctgggaatgcctttcttttacctttcccaaatgatattttctcttgatacataattctgtattcataatccttttccttaagcattttaaaactgttgttctgcctcttttaggattccatgatttccaatgagaaattagcagtaaatttgaatcgttctcctataactagtgcatcattttctctgcctgcttttaatatatatatatatttttagtttttcacagtttaacaatgatgtgtctgggcatggattttgaacttatttgactttatccttttgggggtttactaagcttggtgaaccttttcccaaatttttgaagtattcagccattatttcttcaattttttttttttttttttttttttttttgagacagggtctcgctttgtagctcaggctggagtacagtggtgtgaacagaacttgtggcagccttgacctcccaggatcaagcattcctcccacctcagcctcccatgtagtcaaatatttttttctgcagaacactcttctttcttttaggactcaaaagacatgaatataaatctttattttcctaaaggtccacaaccttctgttcttttcttccattcttattttttctgtttttcagatttgattatttctattgatccgccttcaagtttactgttttctctgtccattctactatcaagcccattcagcggtttttttctgttctaaaatttccatttcgttttctttccttttttttttttttttttaatgagacttttttacattcatttgaacagtgttattagagcacggttataatgggtgatttgaagtggtttttctgataattccagtatttgtgtcatcttggggttgacttcttctggtttaacttttcccttatgagttgcttacatttccctagtactctattgagtgattttggattgtatcctggacattagaatattatgagatcccagattttgtttaaatcctgaggagaatgtgatttttttttaagcaaacaatcagtcttgttaggttcaagttctgattagccttctttaggttgtgattcttaagtcagttcaatttttttcaaaagagtttcactctgttgcccaggctggaggatagtggtgcaatctcagctcactgcaattctgggttcaagcaattcttgtgcctcagccttccgaatagctgggattacagatgtgcaccaccacccccagttaatttttgtatttttagtagagatggggtttcaccatgttggtcaggctggtctcaaacttctggcctcatgtgattgacccacctcagcctcccaaaatgctgggatcacatgcgtgagccaccatgcctggctgtcagttcaaattttaaagactttgtcatgtcatgctgtttggatctgtctcaagtgtgctattctgtgaccttggcagtagtttaccccatagttcggttcccaaagcctttggtatgctgattagggtcagattcgtacagctcataagtgagcctaagagtttatataccactttataggatttctcccttgagttttctctccatgatttcctcagaattttctgtgcccttagggtcccccttcctggtcttctggctagaaaatataggcctaggtttcctttccgtgctatgcagttcctgtaattgtatctccatctgttatcaagcagcaagaggacaaagagagtagaaaagtagggaagatgtttcccctgttaatgaggccacagtgcctttggtaggaaaatatgattcccctccttcaaagttttagttatcgcctcgccactgttgctgtcaccattacctctggcacttctgcttccatatagtagcctgggagttggagcaggaaagaacacagggaaaaatgaaaagaaagggattttcctccctctctttgacgcttaggagtttcttttttcatatctcagcagaaaaataaatctaccttgatattaatattatattctggctctcttatgcctagtatttacatgaagtatcattttctatttttttattttccagcctgtgtctttaaatgtgatttcttttagatatttataattgactcatttgaatccattctgacattctggcttaaataatttaaaatgtaatgcatataataagttttaccatattatgatttgttttctatatgtcctgtttcttgcctcccttttctgtttttcctgccttctttccagttagttttgtgcattttatttcatttttcattttatatttactcttggctttcttttattttctttgtgtttactctagtttataatatacaatttcatcatctactttcaaatattattatactacttcccatgtaaaataagactgttacaataatatacttccatttcttcccttctttttgctactgttgtcaaaattttacttgtatctttgttataagctctactttttttttttctttaaacaatcaagtatatttaaaagacattaagcaatgaagaaaaatctccttggttaacccatacattactatttacacacttttttcctttatgtagatctaaattttcatctggtattattttcctttctcctcaataactaagatctcttatagtacaggtttttaaggcttcttacaatgcaggtctgtgaggaattaattcttcttttgtcttataatgttgttattttgacttcattttctctgaatatagaactttaggttggcaagtttttttcctatctgtattttgaagatgttattccgttgttgcctggattgaatactttctggcaagatgtcagtagtcatgtttatatataatgtttcctttatataaagtgacctttttctctgggtgcttttaaattttctctttatcattcattttcaacaagttaattatgccttggtgtggagtttgtgtattattgtttaattggggttttcatgaagtttttaaataggtgggtttgtagtttttatcagtttaggaaattctagtcattattcacatttctttttctgttttgttctcttttttggtgttcctccttggtactccaattatacgtggttgattacatgatactttcccagggagacttagtttatttcattattatttatttcattttatgtagattctgatgctgtgtcttaaagtttattagtcttttcttactgcagtgtataatttgctgttaatttattcagtgagaaattttcattttatatattgactattttatgtctggaattttcttttcactcttttttatatcttcaattttctcatactttttatttccattaagttcttacacaattacatttgtgtccctggtctataatttctaccatttctgaatctgtttctgttggctaatttttcttctgagtatgacatcttattgttgtctttgtaatttttgataagtggagcattgtgagtgttacattgttgattgtctggattttatatttctttaaagcatggcaggctttttttttttttttatagacagggtcttgctctgttgcccagtctagagtgcagtgatgtgatcataactcactgtaaccccaaactccagggcttaagtgatcctcctacctctcatatatctgggactacaggtgtgcactaccacactgctggaattacaggcgtgagccaccacacttagccaaagcctgtatttttatggtgtagatttatcagaaaacaaatttaaccacccatctcaatatagaactaattcaccccggtaatggtggctcatccctgtaatcccatgattttgggaggctgagacgggaggatcacttgagccgaggagtttgagaccagcgtgggcaacacagtgaaaccccgtctctacaagaaataaaaaattagccagacttcgtggcgtgtacctgtagtctcagctagttggaaggatgaggtgggaggatcgcttgagcccaggagattgggactgcagtgaaccgtgattatgccactttactccagcttaagcaacagagcaaggctctgtttaaaatcccccctctgcccaaaactgtctacttctatataactcagttacatgagatgtttttccttctcacaggttcagtttaatttgcagtttacaaaaccaaatgcatcactaggagatgttcagtcaggagcaactattagtatgccttgctcaactgataaggaaaagtaagtgcttaatgacataaaatttaatgtttgcaattttgaaggccatcttacagaatttttatcagtgcttgagagctgtgatgcccacctgtttacctgagacatttcaagttactgatcattggaatttaagttgaattactcttagctataaaaaagagatttctcatacttttttctgtttcctcctccaacaatctactcattattttttaatgtgggatgtgcttagatagtaaaatttcgtttgttgaaagagattttcctacataactgaagactgggctttcaaatattctcagacatattcatagaaatttttaaaaattcctcatggtcagctgtttttgttttcttatatggctatgtctgtccctggaagctctccatttttctgatttattgctttcagtataatctaatctaaaataccagctagttaatatgctagaaatatacagagaatgagtaaaaaggtttgtgagattttcccatagataacaaaaataagctttaatgccattttgcgacttccattccctgttttttaaacagggtttacatagtgaagtctgttgattcaatgacttgtggttaaatcaaaccactcatacaggcaaacttttctctctggatagacttcatgtttgtaatttattactactaatatagttatttattaaatttaatggctttaaggcctgtctgctgatactcattatcatgagctatcaccatcctagttctacattacaaactaaattactaacatagctcaaagagggttcttatccccagctctctagcttttattcattggatcatgatgtgttaaaataattaaaatgtttgtggctggtcacagtggctcatgcctgtaatcccaacactttgggaggccaaggtgggtggatcacttgaggccgggagttccaagaccagcctggccaacatggtgaaactccatctctacgaaaaatacaaaaattaaccgggcgtggtgggcacgtgtaatctcagttactcaggaggctgaagcatgagaatcgcttcaacccaggaggcaagaagttgcagtgagccgatattgtgccactgtgctccagcctgggcgataagagcaagactctgtctcaaataaaataaatagaaaaaataatgtaaaaaagttaatatttgtgagcctccatttttaaaaaagatcaaaattcacttgttcacaagggagagcaccttgaattcctgttaatggtagaatatcataatgtttgatatatttaattcatcataggccaggcatagtgacatacacctgtagtcccagctacatgggaggctgaggcaggaggatcacttgagtctgggaggtcaagactgcagtgagccatgatcctgccactgcactccagcctgggtgatagagtggggccctgcctcaaaaggaaaaaaaccaaaaaaaaagccagacatggtggtacatgcttgtagttccagctgcttgggaggctgagggatcacttgagcctgggagttggagtctgtagtaagctatgatcagtcacatcactgcactccaaactgggcctcaaaacgagaacctgtctcaaaaaaaaaaaaaaaaatcaaatcattatagacagagcaattttactagcagaaaatatgacaatcgtatttgtagtatgaagtcaaacatatccatctgtccataaaattaggactgttcagtgattttgagttttttctggttcttttatttgtcagctagcaaaaagtggcaccgggtatcaaactttaaagaaaaaaataaaatagaaaaaaagtctgttcacccacttatttctgaaaattgggtcaagagcaaccatcatttaattttaaggattgatttattctcattgttttgcaagagcctttaacttcttattacaagtaatactagggaaaccgttaacactggatgtatttagaaaggatggcagtggtagaaaggggaaacacagaaatgcccttctttctcccccagattttctcatttgtattaatttgatcagaatttattgtgtaatgtgtgttaatacttgatcatgactactttgaagcactagaaaatttcgaagagcttttggtcaaaggaaaaagaaatcttattttaaatatgagttagaaattaatagtgttactctcaaggcacgtatttttctgtcatgtatcacttatgtgctagtatttaaatttttatagcacttgtagaattttcatttttcccaccatccttatcccagctcttaaaattttattataatctactctttactgaggatactttggtttatgtataaaattaccatttgcttaagaaaccagtgaagaatgtgttctgaacaaagctaagctataaatagaacttagttacattatcttatatatatgtatacatatgagataaaccttcaaagttaataaagactttgttaaataagttattaccattttctttttaagtggtgaaaatgtagggttggaatccaaatacctgaagaaaagggaagatagcattcctttacgcggactcagccagaacctatttagtaattcaggtaagcagggatttctggatttttgtactttatagttgaattaaatttaatgtatgaagacttaatgaataccagtaacctttttttgtcctcatttgcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaattttacttgagctgttaaagactggatactttaagtactgcttttatggcagtttataatataggaacaaatttgtacttggggattggtaaagattgtgagtaaatgacattttttggtttgtgaacatggcgttttatagaataatatgaattttattaagctattctttagaaattcagttctaaggaaagagttgatccttatgagggagattctgatcatattaaaaatctgggtaaactaaaacctgctcataacctcatagtatgcaaccaaagaatactaattcattttatcactttcattggtaaaacttttaaattcaacacctgaaaatcatgagggaaaatgattacctcttgagatatattattgatgacatttaaagggaaaagtcctaaatttaccttaaataactgaaatgaattaagccttcatagcgtattttccttgaagcatttaaatttgctagtgatgaatcaaataaatttgatatacttaaaataatttggacagtttttatgtgaccagattaagtgcttttgtcatttgagctgacaagtttttaaaacttcagtgcttcctaaatgtttatactcatctagtttttctcaatttgtagttttattatgcagttaaatctgtatcagtggacttttaaaacttggtactactactaaatctactatatcatgaatattcatttatttttatagtatcagaacttgggttgatttcaatgttaataaactaggcaaaacaaataactgttagaaggtacaattttcttctcttccctgtaactgaaagttttaagaattgttccttggggaaaaatttttttaaaattcacctagaatcatagggcctcattttgttttcttattgacaaacaatacctggtagcattctctaaagagtcttctagatcaatttttataaagtactaatgctcatgtgataatttaaaattattttcaactactttattacacagatgaagaaacatttcaagatattgatgtaataacattactgagtcccatggtaagaaagaatctttgctaattttttttttttttttacgaagccagtatcttgaaactattggcaattgcaagtgtctttaaactagggatctaatctgaaaattcagtaactaatattaggcagttgatactcccccacctcccccatttagatacactactgtattagtgagaatacttggtacagtaacttgaaagcacttgctattctggaaagaagcctcttggtgattttggaaggagctttattgtaaatactatggaaggggctttgttgtaaatactatgtaatatatataaaatattgtgacatgttttggatgggatgcatgacatacaggtagctctcttttttaaaatataggtatctctttgcatatatatacacaaggaaagttgaattttcaggagagatcattctgatatcttgcaaatttgtattaaatgtatacagacttccaagtgtgctaattctttacctcctaaacttttagttgcaattgttttgcagtgtaaaattgtacatgtgttaataatcaaaaagtgttgcatttaatgttatttctgtaaactttgagctttgttaataaactattatgcagcatctacactttg

SEQ ID NO: 616 - DNA, 28048 bp, Homo sapiens
ccgagcgcgttgctgcccggaggctcctacgccacggcccgtcgggcccggcgccggaagtgagctgttccgaggcgccgccgggagctgccacgtccgagacctggagcagccaccgccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtagtagagccgagatttgaaccctcctaaccattcctttctgccgcctactgcagctcccagcagagatgattgaactgttgctcggggtagggcccccaggtaggatgggcacctcgggaaacgtaaagatggcctgaacgaccctccgaaggcaggggctcagggttttttaagtctctgtggcatctgcagtgtacattcactccacacttactccttgagtgaatgaatgactgaaggagaactaaagaatggaagtatctgggctgagcctggaatatctagtacatgcattcttttagaaacatgggtgtgtctcagcagcaggtttgagggaacctgcaggaacctagaaatcagaacactgtgttcttgttctgcagagggttaggtgtaaatcactcacctctggctcttccactgcaggttagagttgaggcttttatgctctgacattcagctcatcctaaatgaatttttaactcattatctgatctcaaagaggtgaattattttgagtgcaggtgttaacagggaccagataataccaggtccctgggaagaagtactctaagaagttctctctctctctctctctctccccaccctccctctctccccactccctctccctccccccttcctctccctctccctttctctctctccccctccctctcttctctctctctctccccgctccctcttcctccccccttcctctccctctccctttctctcccgcccttcctccttccttccgtccttttctctccccctccctctttcctcccccccccccccccccgccttctctctctctctctctctctctctctctctctcattcagaagtgtggttcatcaaccctgactggtgggtgagagtggttagaattaaatgctgattatttctaaggtcctttggtaacctggttgaaactacctctcagtaaactttcttcgtgaacctacttaaccgcagctttacagaactcagtgtaacaactgctttacattctagacaggcagcctggtggagtgaagttttgtggactcagcattagaaggttaggggatggggctcttttcccaggtctgccttgaactagctctgtgactttggcaagtgctttctcttctctgggcttcttcatttccttagtctgtcgcaggtctctgattgactgtgcccttggtaccctgccctccccgccttcctgtgcactttgtaacctatacagctcggcacatggaggaaactccttattgtccttacttgcctttgcagacttcggggacctggtttttagagagtctagaatctgatgagagaacctgtgcttacttggtgtgtacctcttgaactgctttgcagccatcctcttccactgtctgcctttctgaaatcacaagtcaaactttatacctacagggcttgtgctggaaaagatgaaatggggaaaatggtaagaaatgtctgttccacactgaaacttcttttaagtcctcttttctatcccaagaatttaagagaagagtggttgagcaaagaaaaaaaataacagcttttgttcatttacttattcattcagcaaatagtcgctgagttccttctatttgcaaagcactgtgctggatgatttgaggggatttgaaactgcagatggctcagaccatggctccaaggagctcaccttctagtggggagaagaaacagcataaagtgttgtatgtgttccttgctgaagatatgcaagagagtccagccatttgagggtctgagaatcttcaagaaaggtgatggatggccctttttgagctggacctcaaagaatagataggagggagatgaccatgacaccatgttccagccctacaaactgttcaactctggatcccactacgtgacggaccagggagcagcctcaggaaacactcgaatcaagtctcccagtctgaagtaataaccccgttatgcataaactgcctggaacatcagaggctctgtcatccaggaaaggaacaccagctgtagctcccttggggtctctcctcaaccttaagggtagccaggactgcttgccgtttccccacacacatcaggctctctcagacctctttgtctctactcgtgtattccctctgcttggctgcttggactggtattttcccctgtgccacctgcaaattcctacccatcatctagggctcaattcgtgtctaccaccccagcccctcaggctcctacaggacacacaaaccaccattaaataatttatcttgcgacactagcattattcgcgagcttctcaagggcaaaaagttcctcttatttgtgtctgtatatccagttcctagcacagtgcttggcagaaagaaggtacttagaatgaatgcttactgaatgaatgaatgaatgagtgagtgaacaaacaaatgcagtcaagaacttgagatggttgtattctaactgccatgagttaatttaccagtgatatctttggttctaggtgtcagtaattaacactgtggatacctcccatgaggacatgattgtaagtattaatatcaccctccctggaggggtgtggacatgggcatttttgtgggagggaagcaatttggggttttcattacccctttctgttgatcattcatggatccagggtggctttgcagtggttgcctatcagcctgtaatctcggggtatggcaggctccctagcagtgccctctgagttgtcaggactgtggcagtctaatcactctctgctgggaggaacctgggaataatttgtagttctaggctgtcagtcttccagccaatacaataacctgctctcggatgaaggctgagtgggtacggaggcttgacaatagtcttcccacctgtcttcctcctgctgtcacttcttagccccactggaaaggggggtgaaaagaagagagtgtagaaagatgactcaatacaaaggcagagggcagccacagtgaaagccccaggcagagcccagtcaaaccaccaagacaataggccagacaaggccctttgaaccagaagtccacactcagggcatttcctgagaggtaaacacaaggctcagtataagaggacagggctgcaggagaaggtccagaggttaaagtctaccgcaggaaaaacacagactctgcttcattcagggccaagcagcctttgagcaagacccaggacagctggctgacagtgtttcatgtcagggttcttgccctcacaacctgtccaccaacagttgcttttgggtttctgagaggttgtctggtcccagagttgtatatgttctctggattcagtcatgagtggtctagctgtaagaccacacctccttggagatagcatggaatcatgggcaggaagacccagtctgagactccctagccaatatcttaacttttctgagccagcctcaatttacttacgggaaaaataatggatatgctacctactcgtatgagtttggtttgagaactagatgaggccaagtagtaatgacaaacatttgcatgctcactgagtgtcaggccccatgctaagtacttttctttttttttttttttttttttgagatggagtttcgctcttgtagcccaggctggcatgcagtggcgtgatctcagctcaccgcaacctacgcctcccgggttcaagtaattctcctgccccagactcccgagtagctgggattacaggcgtgcgccaccactcccagctaattttgtatttttagtagaggcaagttttctccatgttggtcaggctagtctcgaactcccgacctcaggtgatccgcccgcctcagcttcccaaagtgctgggattacaggcgtgagttttcattcaatatcttgtttaaccttcataacaactgttgagacagatgctatctttagccttatttaaagataagggaactaaggcccataggatgttggtaaataataaagataaggaaactgaagctcaaggagatgaagtgttttcaaagtttgcacagcaggtaaactaaggagataggatttagatctgaaaggtactatgtcctgcctccttccactgagaagcatgagaagtgcttcagaaacactcctctactgcctgccctccaagaaaccaaggcctgatacagtggagggagttcccaaagaaaaatcaggatgtgttccttgcgtagggaggtgagaattcccatctgagccagacagaatgagtgcctttgaatgggcataattgcccctggtggccatgggagtgcagctgatagtcctgaaactcccagggtgggacagctggggaaagggacatccattggaataggcagggccagcaagcagaagggaccagggtgttcagtggtgcaggaggcatggtgcctcagagaccatcaccctgcggacaaggatctgcaggtaggggccaggcctagttctgcatgctcagtcagcatcaaggaattcggttcacaagtggtgagagcagcgacacttaaggcattgtgttccttgggtggaaagtctgggaagctctgggcacactactagggaaaaggtcgagcagaagccccaaaacaaaggtccacaaaggatccagggccagggctggaaagagcccaaatatctgaatggaaccctgtgtgcaggccagagctgcatcacagaagacctgactggggactccaggcagtcagaggcccactcctttggcctgctcccatgcattagcatcaggtgctagggctgagctgaacccaggggtattcccctttagcccacagagcctaagaactgaatagggcctgagaggatggaggaagaagagggcagctaggccaactttttttctcccatacccaccctgcggaacaggaatggaagagcccttccctgaggtatgtaaagggtctgtgacaccagctgggcatggcttgctttgtccatttcagagagacactgcccataggtgaagtgagaatgtccacatgctagcttcctgcctgagggtgatgatactttgagatcagattgatttcagggagattctggtccaaactagactctgtgtagtgacagccctcaccccacccacccacccacccagcctgcaggcttcccgagctgtcctccctttgcagcacgacgcccagatggactactatggcacccgcctggcaacctgctcatcagacaggtccgtcaaaatctttgatgtgcgcaatggagggcagatccttatcgccgacctcagggggtaagtgctggcgagcccagggaagggctccaggaatggtgtgggttctcaggccctgcttcaagcgtgggagcaaagcatgggagcccagattcagagcaaccccaaagcacatttagcggagaggacgctgggatcccagccagcctggctgtcctcagcggacgtccccagggatgatgctgttaagggcacaggtggatacaggtgtgaatctcagctctgccactttatgtgtacccaccagaagaccttgggcaagtgactcagtttctctctcagagccttcatctgctcatcctcaaaattgggccaatgctacctcctatccagctagtgtatgcaaggccctgacacagggcccaggacacagtaagtctttagtgcaggcagctactgctacttttaaaagtggtaaacagtaccatttcgttcaagtttagccagtatgacctaaagtgtcacaaaagcatcaccgtaagaataatgtaagaatgctatcattttataaatcccattgttctgcctatatgcccgtggcacgtgttcagtgattatttacaaatgtttgacctgccctgctccctactgagattcttgaggaagtcctggctcatttttatggccacatctctactgctttccctcagctcactgcctttcacgtatttgtgggtttgcctgggtgccgtggatctccaagggttctgtgaatagagttcaggggttgatgaattgggacagggggaaaaaaatgcattttcagtgactctgatatttagcatttccttcaattatggatgtaggccagaaacttcagtagtatttgtagtgcctgtcactttgtcaccagtagaattcacagatattgtcatcacacatcacggttacttagctacctcaaaataccacttatgctcatcacaactttgaaattacagtggttattagacctgccgctagggtttgttgcttgaagtgttaacaaagaagtacatgcatcactatctcataaattgctttataatattttgataacaggctgggcaaggtggctcacgcctgtaatccttaacactttgggaggctgaggtgggaggatggcctgagcctaggagtttgaggctgcagtgagccacgatggtgccactgcactgcagcctggatgacagggtgaaacccttctcaaaaaaaaaaagttgattactgtataatttataattgaattttctttataagcctagttctgtgtgttttgtacattagtctgatgagggtccataaccttccccagaatgcacagaaaagattaagagccatgacaggtgggtgctcagcatgtgtttgttcactgaattaaaaagcataaactaagtcagtgtccatttggggaaatgggcctagaagctcccctctgtctgagtgtcaaatgatcaagtgactgaggagccaaatcaagcttctctatgcaggagccccccaggcaggcagagagctgctgcagtgcagcgtgttggccaaggcagttatgtttgctgtgactctgtcctttctgctgtttttcttacattcaaaggatgtgaaatattggagggataaaaaaaattcccaccccattcttttttccccttagtaaaaactgtgctagttgttggaagattgagtctactcagtttcattagcagcagctttgtagggactgggaatgtcctgttgtcccagccagagggaggaggagacttgagtgtgtgcagcccacggtgaaggagtaaaccaggagcagcactaatagctaatgggtattgagtggcttttttctttccttctaccaagcattgttccaaactttatgaaagaattcttattgatgtctccattttcaggtaaagagacaaagatatccttgcctaaagtcaagagctagtgaatgggagaatgggtctggtctcctaaccactaactctaccatgctactctacctcttgagtgctaaggtgcaaaaccttccctgggccagagaaatggtcaccgtacaaagcctggcacagagcatgtgctcagatagcacctgttatcaggtgaatggataaagatcagaagagaagggaaagacatgcctttcgaacaaattaaaagagtagtggaaaacatcaaaatgaaaccaataatgcctcctcaggaagctgaccgtcgggaaggatgaatagcaattcagtctacaaatatttcctgaacacttctggctggaaaccttggaccaattaatgactatgctgtagacagcacatacagacagtgctggctgcagtctgggcaagtgaggctcctgcctggccaggacaggaaggctgacccagaggctcaactctctctcaaaggctctgtgaccttaggttgcttaacctcttaggacctcaggctcctcactgtccactgagcaccccttttgcaatggcattgtatagttctccctttgaagttcttaagcaattctgccctgatatatcgtctcagggagccatttagttctgtccaaagtagtgcctgcagaggcactgtgggttcctctggcctatctctccctttgtagtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcaggtatgctgagcttggcagcagagcgggcaaggggaccactgggtaaaaaaggactctgtcccggctggagccctggctccctgcccctcgtggtgcctcttgtctgtctcttgagctttggttggcttttctgctactctgtcctcagctgagtaaggccctaagacctaaagccagtccaaagcaaataagaaaagacaggtgagtttctcttcaggattattcattgcaaggactacccttcattctcagattgttttcctacccacttttttgttagatagactgtaggttatgaaatcgtggtattagtaggtgatggggtttttttgtgtcctcagttgaccaagttacagcttcccccggtgactcctacagttgtttgttgtagacatttagtaaaacagtaaatctgtggaaggcgggacctggggccgcggtctccctgctttgctcactgcactctccctcttcccgcagtgaactcggtgtgctgggccccccatgactacggcctgatcctggcctgtgggagctcggatggggccatctccctgctgacttacaccggggaaggccaatgggaagtaaagaagatcaacaacgctcacaccgtgagtccatcccctgcctttcgtgcagtgagagcgcctgccttgccccgtgtctgctgcagcctccctagagggtggcacgggagggtccccgctggacagtgggccggggagtggtcagctgaccagacatgattgctctagagcagctttgagcctctctgccctgaagccagaccaggcagggcttggcactgcttccttgttgtgtgctcccaagcaggggagggctggtgcagcagcagcctgctcactgccaccttagctatggttgcctccaggtgacatgccctgcagtagtcattgggaccctgtagaatggagtggtgttattaaaacttttaaaaagtatgtgagctatgcatacatttaagaaagattaatataaacaaggtcattctttacccaacttttggtgaatcagcgagtgacagtggtcgtgatgttggtggttcaatcaaggaataaatgtttgcaaagcgaacatcaatgtcctacctcctaccaccacacagttcaaaaaccaacaataaccaatgtggggggctcatatgactaatgccacatcgtttgctgtcatgcatctgtatgattattggatattttatgagtttaattctacaataatttgtatctattctttttctaatctactcattccagttcagggtcacaggtggttggagcctgtcctggcagcttagggcatgaggcagaagccagccctggacaggataccattccaccagaggagcactcacacacacccccacactcacactgggacaatgcagacgtaccattgaagtgaacatgcacatctttattgtgtgaaaggaaaccagagtaccaggagagagcccacgcagacacagggagaacacacagactccacacaggcaggggcccccgctgggagttgtttttttttttttaatcttgtcagcattataatgaaatgaaattgaggatcagttgtacatagaatgagacaatctgtggtcttttgtgactggcttctcctacttactataatgagttcaagtttcatccatatcatagcgtgtatcagcactccattcctttttatggctggataatactccattgtgaatatagacattttgtttatccattcatcagatgatggatgttctcggccttatgaataatgctgctatgaacatttgcagataagtttttgcatgaacatatgtttttaattctcttgggtctatacctaggtgtgaaattgctgagtcatatggtaattctgtgtttaactttttgaggaattgctaaactgttttgcaaagtaactgtacccttttacattcccatcagcagtgtatgagggttctaatttctccacatcctcactaacatatgtctgtcattttggttacagctgtcctagtgaatgtgaggtggtatcttattgtgattttttgggtttgttttgttctgtttttttgagacggaggcttgctctgtcacccaggctggagtgcagtgacatgatctcggctcactgcaacccccgcctcccaggttcaagcaattctcatgcctcagcctcttgagcagctggaattacaggcacacgccacaacacccggctaatttttgtatttgtagtagagacagggtttcaccattttgcccaggttggtctcaaactcctggcctcaagtgatccgcccacctcagcctcccaaagtgctgggattacaggtgtaagccaccacacccggcccttattgtgatttttatttgcattttgctaatcaaagatgatggtgagcatcttctgggggcctttggagaaatgaccaggaggggtttgcactctgtaacaccgagtgagtggaagcggcccacaataagaaaggctgaaggggcgggaagaaatctgagctctgtgatcctccagagcaagcctctgggacagggcccctcaggaggaagaactgcaggaaatgaaatcacagttgagctggatagggacacaggaaaggaaggatgagatgtagaccaatgtggggaagaggaacaaagacaggaactcctgaaagccatctcccacgttttttaacaccacacagaaacaagggagagttctgagcttagactttcctgagcctttcttatcaggaaaactcatctcacctaaaaataacagaaaagtatttgaagtgaaattgcatacagttgttatataagaaacaagaatatgcaaaataacctccctgcggacaatgagagcacattagaaagacatgcccacataaccgagccaagctgtaacctgctatttcaaatcaagccaggtgacattctaacaatacaaaacaagagagaatagtgtaaatcaactttttaaaaatcagaaataaggtgacagaactcaggaaagaattagaattaaaaatcatttcagaagtaaagaaagactaagacgaaatgcaagtgtcgatgaacacagcagatcctgcctgaaaaggataaacagtgtgaaaaaggaaacatttcaagagcaaaaaaatgaagaggtaaaaaggttttgaccaaaagtaaagacaggcagaaaggtcagacatacgaataccaggagtccctggaaaggaaaacagaataccaaaaagtaatccagaaaactttcttaaaattaaaaaacaaagatttgaaacttgagattgagagatcataccccacacttaacaatatcagccgggcgcagtggctcagcctgtaatcccagcactttgggatgctgaggtgggcggatcacctgaagtcaggagtttaagaccagcctgaccaacatggcgaaaccccgtctctactaaaaatacaaaaattagccagacgtggtggcgcacacctgtaatctcagctactcggaaggctgaggcaagagaattgcttgaacccgggagtcagaggttgcagagagccaagatcacgccattataatccagcctgggcgacaaagcaagacttgtctcaaaaaaaaaaaaaaaaaaaaaaatcaaggccaggcgtgatggctcagcctgtaatcctagcactttgggagatcgaggtgaactcctgtttgaggccaggagttcaagaccaacctggccaacatagtgagaccccgtctctaaaaaaaaaaaaaaaaaaaaaaattcaactcagcatcaccaacaaaaagatataattctagtaaaattattagactttaaagaaaattttggggggttctagagaaaaggaaccttgtgacttaaaggggaaagacaattagattattgtcagactcttcaatagtaaggattggtgcagaagaaaaaagaataacatgtttaaaatactccaggaaagaaagtgtgagccaaggatttataaccaggaaaattgactttgaagttcacacaaagacttatacacaaaaggttatagcagctttaatagccaaaaactggaaatagtccacatgtccatcaacaggtaaatgataagttgtgatatatccatactttggaaatactgcgagcaataaaaagaaatgactgcaataaaaagaaatgacttaacaaaataagatgaagaataaatttcaaaataattatgctgagtgaaaaaaagaagaaaaaggacacactgtgattccactgctgtaatatctaggaaatgcagctgagcaggcccatggtcaccacgattgggggctgcaggatggggagatggattaccaggggatccgaggaaacttttgggaatgatgggcatgttccttatcttgattgaggtgatgtgatgatcctacaggatatatttttgtcaaaattcaccaaatcatgcacttgatatgcagtttatgtcaattatactatatcaaagctgtttttaaaattagcttttgagtgtaaaggatatgaactattatcaatatgcaagaattcagggactattgtttctaggagcccttcctgagaaatctactagaggatacaagtcacacaactaaaatgactacaaagacttcagcataaatatatagttacttgtagagaactaagacgaaatgagggttaaaaggctgggcccagggcaggcacagtggctcacacctgtaatcccagcactttgggaggctgaggcaggcggatcacctgagctcaggagttcaagaccagcctggccaacatggcaaagccccatgatgtggtttggctgtgtccccacccaaatctcattttgaatgcccatgtgttgtagggggtaaccagtgggagttgagtcatgggaggaggtcttttccatgctgttctcttgatagtgaataagtctcacaagatctgatggttttatgaaggggagttcacctgcacaggctctctctccctttttgctgccatccatgtgagatgtcacttgctcctcccttgccttctgccatgattgtgaggcctccccagctacatggagctgtaagtccattaaacctctcttttttttgtaaactgcccagtctcaggtatgtctttatcagcagcgtgaaaatggactaacacaccccgacgctactaaaaatacaaaaattagccaggcgtggtggcacacacctgcagtcccagctacacgggaggctgaggcaggagaatcacttgaacctgggaggtggaggttgcagtgagtcaaaatcgcgcctctgcactccatcctgggcaacagagccagactctgtctcaaaaaaaaaaaaaaggcagtggctcacacctataatcccagtactttgggagtctgaggtgggaggatcacttgagcctacgaagtttgaggctgcagtgaaccatgatcttaccagcctgcactctagcctgggtgacagtgagaccctgtctcaatttttaaaaaaaaaaattgttaataataaataaagaggagaatcagtcatctttggaaagtgatagaaccagttcagaaagaatcaagcgtttatccagcctttcctttttgaccttgtattagtctgttttctcgctgctggcaaagacatacccaagactgagcaatttacaaaggaaagaggatggagaactcacagttccacgtagctggggaaacctcacagtcatggcagaaggcaaggaggaacaagtcacagcttacgtggatggcagcaggcaaaagagagagcttgtgcagaaaaactcccatttttaaaatcgtcagatctagcgagacttattcactatcatgagaacagcatgggaaagacttgcccctgtgatacaattacctcctaccaggtccctcccacaacacgtgggaattcaagatgagatttgagtagggacacagccaaaccatatcagacctctatccctgggtaactgaatagttaatgagaagaagtgtccctatctggagcattccatggaataaatgacaaagaaaggatggaattagagtatcaccattttacaagccccagtgaattaagagaggcctgagttattgacagctgttaatataagagacaatctaacgtgcctcctgatgagagaacgcaccagctctagtcttgccaaagggatcacacctgagtctgtccagtcttggctccagctgacagttttcaggaattcagaggaacatattgaactgcatatgaagcagcaaaacccagaccgagagactaggctctcttcagcagaaaaattgtaaggaaaaaaatcagaggaggaatctgcaaagtaggagatgtaaaaaacatccaaaaaaatgtttaatggacaagactaaactatagtatctaggggtgcacatttgggtgataaaatggggggaaaatgggttagaagttagggcagtggttacttatagtggaagagggagctgtgattaggaagggcataatgacagggcttttcaggcaggtggcagaattcttgtttcttgatctattactttataataaaagatttttcttaaaaaaaagctccaatgtaccattctttcatgtgtttagaaaatgtcctgtttcttaaacttgtgggagttcttaatttctacttttagcgcacactgcagaaaaatgcacacactgttgggatccttgagggagaattctgagcagtggaccccatgatgagtgcttcatgtcagccttcacacacactccagtcctgagaagcggaggggagagggacagcaggcttgggtctgcagaagcagtgttctcttgcaaggcagagtcaccatgtgtcccatctttacagattggctgcaatgccgtcagctgggcccctgctgttgtacctggaagcctcatagaccacccatcggggcagaaacccaattacatcaagaggtttgcatcaggtggctgtgacaacctcatcaagctgtggaagtaagtagggatgtgtggccttctctttgaggggacacttctaccctttaccctactcaccatgactcagccacactcacaagaaacaaggtcacctttctttctccctcctgccagtaaaatactgttttcaatctgttggaggacatccttgaaaaacaacacaacacctgttcacctaattcccaactgttggagctgactctttggctgtggaagcagagcattttctggagggttttttttacagctggggtgaagggaataaaatgccacaaactccatgaatgaaagaagaaagatggaatcgcttctccaccccaggcagagcctgttgggttggggaggagttgaggtgtgggaacggccccctgctgattctctttctgtccccactgttagggaggaggaggacggccagtggaaggaggagcagaagctagaagcgcacagtgactgggttcgagatgtggcctgggccccctccatcggcctgcccaccagcaccatcgccagctgctcccaggtcagcccagggccatgagtatcccttgtcatttagtctcgagtcaggcccatcagctcttagtctccttagcagaaagtcctctgggaaggtaaagggagagcaacaggcacctttggcccagagcacagggagtcaggtcattgtgtggggaagtcttggtcagaagccacaagtggcctgcctccactgagatgagacagctacaacagaaccggcaccaagaaggaggcggattcgggatgaattttcccttctgacccatgtgagactagggcgccgaggtgcccaggtgcagttccaagtgttcccaagcaacgatggggttggatgggaattatacgcttagctaccaagccacccttcccagacagcaaggacggccaagggtgagccttcagttatacaccaccaccctagagggagccagctaggcctttcacatcatgggaacctgtttggtttggttctaaacttgggatttttgtgcttttttacttgtgccttctcattcttggagcttggtttttggagagctctgcccattcagttgagaaggtatagacggccagtggaagtgacttggcaggcatgaggaaaaccccagagaaaatctgagttagcaatgcagacagagtccacctccgaaacccggatgagaaaaggaatccgggagactcttaaccagtgtgaagagacagaaacaaagctgtggacgccccagaggtcctcggctcccctttgaatcccccaccctgttcctgcagagaggtgccgggtggctctagactgggaggacatcacatcacaaacgcaggagtcttgactccacctcctgactctatcctgtttcttcctaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtacatacccattccccgtggcatggtggacacagcctgttggtcttcaccccgcccactagagagggcacttgacattcccatctgactgcaggctgggcaggagccttagccaggactgcgttttgagtgtgcctcttagttacatcattaatgtcacagcccctgaggtagtattaacacgtccccctttcacagatgaggaaagaagctgacagaggcgatttgacttgcatgggggtcccaaaactatgaggtggcagagccagtcaggcccatcaccctactaagcatttggtcacctcatggtgatgttcagttagctgtgccaaaaaggcaagtgtataagaacccataaacagaagaagattggggatattttttgtccataacactgaaaaggctttttaaaaacctttagagtttatgaatacttgttatgctggtaagaggcaggtacacagtgggtgcactggaagagtttgcattttgcagctgaaagagttctggagaccagctgctcagggacccaaatgtacttcacacaactggactgtgcagttaaaagtggccaaggtcattttatgtgacgtgtattttacaattagaaggaaaaaagctacccgcagaaaggaagcagtaacaagccatagccatctgcccagctgaattcccctataagacagaggatctctaacgccgcagggtcagttccacgtggagtggctgtgctgcgttttcaggcacatctgctctgcgcctgaagtgcgagttggtctggatcctgccagcccttgctgcttctctcccttgcctatgttggtcttttactgtttcccagtggccactttggctccatgtcttacctttcatttgtgtggctcacggcacaaccaacacaggcaaggcagagaagcagctggtctccagaactcttttcagctgcaaaattgaaactctgtacccattaaataactcccttccccattgcccctccccagccctggcagccacccttctcctttctgtctatgtgaatgtgactgctctagcgacctatctaagtggaatcatacagtatttgtccttttgcgactatgtcactagcagtatgcccttaaggttcctccatgctgtacgtagcatgtgtcagaattccttcctttgtaaagctaagtagtgttgcattgtatagacagcccacaccctgtttctacacttattcctccaccaaagggcacctgggctgctgccacctcttagctattgcgaatagtgtggctgtgaacatgggtgtgcagatcttgagagcctctgcaggcggcttttctggccgagggtccctttcatctacagtggtcccagaaagatctagcaggccccctctcaaagccatatttctagtgagtgccagagtcaggaccagaacccaggttgatggcactcagggcagaccaagggacccagattgcctcaagcaggcccccagtgacttttttacaaggctgtaagcaagtgcctggctgtgcacgcagtgttgtggggcccgtcactgtgcatttaggcttcttgctcttctttacaagcctgtttcctttcgctgtctccatagcacccttacctaaaggacttagtatgttttcaatcccagagcattctgcagtgtgttgagtgaatagtttgtccctaaagcaagagttcttaaaatcaaaatcgttattttcatttttaatcaaactaatatatgtacataggtttagattgtttttgttttttgttttgttttttgagatcgagtctcgctctgtcgtccaggctggagtgcagtggcgcagtctcggctcactgcaacctccgcctcctgggttcaagcgattctcctgcctcagcctccccagtagctgggagattacaggtggctgctagtttttttgtgtgtatttttagtagagatgagatggggtttcaccagttcaggctggtcgcgaactcctggcctcaggtgatccacccatctcagcctcccaaagtgctgagattacaggcgtgagccaccatgcccgacctagactgattttttttaatgcagcctcctaattttctctccaggggcaaaccttttcagctcttagctatttcttatacagtttacttcagtgtagaaacaacatattgaactgttaccttcctctaccacagtagttttcaaactgcagtgttgttaaacctgttaaaacagattgccagccccacccccagagcttcctaatcagttgttccaggccccaagaatctgcagttgtagcaagctcccaggtgaccgatgctctgctctggtctggggaccacactttgcgaaccctgctccccgccaccccatatcctctcgctgtagctctgtcacagtttgctgaaaacagtatcctgtgttgacatcatcatccacagctgctgttattgttactcctttttttctgtgagtttttattcctggactctcattttggtgagatttcagtggaggagggacatgctctgttcacccacaagcctctgggcagtggttcttgatgaggatgaggctcatatttaggggacagcagagggaagggcacagacccgtgataatctgcttgtgcactgactcgcaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataattcctgctgcgttatcctaaccaccccaccccaccagctcagtttgactcttgtcggtccacgcactagaacaaactattcacaaaggccacggctgtgatggcctggcttaaccccacgcacaaaggtggcttgtcactgcatgagcatctctgattcagtttatactgaaagcaccatacagagcactggactcagcctttggtgacaaggactgtagccctgggtctgctacttaccctctcggtacacatcctgttctgcagaatgggactaatacagtctgccctacaggatggctgcaagattcaaacacgctagtgcatctggtgacctacaaaatgccacgcaggtgcaacgtggtattaaccaaacaccaatagttaagatgctggcccagaaagtgggcacgattcatttagtttattgaccctgtcaggaaaaggagggccccatgatgggagacctaactgaccctgaaccaggtatcacctttcagcggaggccctgtgaccctgacaatcgccatagccatcagtgagcctgcggtgagccagaccctacactggatctttcacacattcgctaatttaagcaacacgagaaccccgtgtgggtgtacccagttcactgatgaggaagcgctcagaaggtagaagccctgcccaggactgtgcaaacgtaaagccagcgtcagggcctggcccatctcaacagttactccccactgtagaatcagggtgggagctggggggctctcctcagctgtaatacaaggatgtttctcacaccaaacctttgtatgaatagattcagataaaaggtcagcccacttgcctcaggccccctagtctgcctacttcttgtccttccctcctttttcagcagcaaaatcccctttaaaaaaaaaaaaaaatctttgatcatactatgtaacatagaagaaagtgaaactgctttggttaaaggtgaggacagagaggccatggcctggcccagtcagcctccagtcagtccacaaagcccaagccttctgagaccaacatgaaaacagctgcttccttccttcccttactcagaaaagcaaagcccaggaaggcaccttcacgtgcactactgagtgtcgagttctacagtgaatccttgaaccatatccacgtctgcctccctgatacgctctgtgctcctcaagcctgggcctgggcttcctatggtgccagctgctgtcgccaagaaaataccgagaaggaactagtcccgtgtcactctgggttggtggtaggttaatgggtccctgactgtgtgctctattttaactcccaccaccaaggattggttaagataattatgaagttggcaccataatagttgtttatacttagagtggcaacacattaaccattcctgggtaagaggagaccccaaaatttattaccacaaaatagcctagtcaaatagaaatactatctgtaaaacttgccgggcagttgtcaagcccaaatgagataaaagtaagggaaatttaaaaggcatagagctctggttagggccagatggcgctagcagccatatgtttttaatccttttgcaaaaacaaagcaactgggacagcaaaagaaacccacagaccctagaacatggagcaggccaaagccttcatagacacaatacctctgagagatcagcagggtgaagaaaagggagtttttatggtgctataagccagagaccccaaaaattgccatcaaatactcatccattctgagtgcaaaactcagcaagccactgtgaaaacaactcccaaaactagaagattcacaggcttccatttacaagtgagcccagaaacactaaggggagaccttccacttctgcatataaaggattaacgattgtaagaatttcccagccaacatggtggctcacaactgtaatcccacacttcgaaaggccaagacgggcggaatgtttgagcccagaaattcaagaccagcctgccaacatggcaaaaccccatctctactaaaaatacaaaaattaggtgcagtggtgtgtgcctctgtagtgccagctactcaggaggctgaggcacaagaatcgcttgagcccaggaggtggaggttgcagtgagccgagattgcaccactgcactccagcctgggcaagagagtgagactctgtctaaaaaaaaaaaaatttccctggctgggcgcagtggccagcactttggaaggttgagggaggaggatctcttgagcccaggagtttgagatcagcctgggcaacacagcaagagcctgtctctttaataataaataagaatttccctcacactatagacaactaggaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaaagaactcaaacaaatttacaagaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttactgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcatagatgggaattgaacaatgagaacacatggacacaggaaggggaacatcacactctggggactgttgtggggggaggggacgggggagggatagcattaggagatatacctaatgctaaatgacgagttaatgggtgcagcacaccagcatgtcacatgtatacatatgtaactaacccacatattgtgcgcatgtaccctaaaacttaaagtataacaataataaaataaaaaaataaaataaaataaaataataaatttaaaaaaaaaacaacaactaggaaatcatgaaaagtacatgaaacaactactgctttcagacataggacaacaggcagtgtttgggaaaagggaaacaggtaagcacaacaaatgcaccaggttactactacccagaagcagtttctgggccaaaaggtaaagagagactccagagtctagtagtctccaggagttgaagagacagaagtcagagttcaggaagaccaaggcaggccgggcgcggtggctcacgcttgtaatcccagcactttgggaggccaaggcgggcagatcacctgagatcaagagttcgagaccagcctggccaacatggtgaaaccctgtctctactaaaaatacaaaaattagccgggcgtggtgttgcacccctgtaatcccaactactcgggaggctgaggcaggagaattgcttgaaccagggaggcggaggttgcagtgagcaaagattacaccactgcactctgccctgggcgaaagagcaaggctctgtctcaaaaaacaaacaaacaaacaaaaaagaccaaggcagaactgaaggcagaagaggacgagaggaggaagctgcacagagcaagctcctgagagctgaagagtctcctggagtctttggacaagtactaaccttcatatatgaagggtgaaaccaatagaccaagcagctggagctcacataggggtgggaatagcccatgttcccagcaaccagaaaaaaaagagacattccatccagaagaacaaatataagagtggcagcaggccaggcgccgtggctcacgcctataatcccaacactttggaaggctgaggcgggtggatcacgaggtcagaagtccgagatcagcctgaccaagatggtgaaaccccatccctactaaaattagccagacatggtggtaggtgcctgtaatcccagctactcgggaggctgaggcaggagaattgcttgaacccgggaggtggaggttgcagtgagccgaaatcacgccactgcaccccagcctgggcgacagagcaagactctgtctcaaaaaaaaaaaaaaaaaaaaaggagcagcagccaacttctcatcagaaagtaggcaaaccataagaaaattaacatctttaaagtactgaaaaaattaaaaaaaaaaaaacctgtcagcctcaaattctatacctagtgaaaatatatatatattttaatacagactctttcaaataaaagctgaaagaattaatcaccagcagagctgccattacaagaaatgtcaaagaagtttccttcaggcagaaggaaaatactagatgaaaaacaggctgggcacagcggctcacacctgtaatcccagcactttgggatgctgaggcagcaggattgcttaagcccaggagtgtgaggccagcctgaccgacatggtgagaccttgtctctacaaaaaaaaatacaaaaattaggatttacaaatacgacttcaggcccagcgcggtggctcatgcctgtgatcccagcactttgggaggccaaggcagatggatcacttgaggtcaggagttcaagaccagcctggccaacatggcaaaaccccatctctagcaaaaatacaaaaattagctgggtgtggtggcgcatgcctgtagtcccagctattcaggaggctgaggcaggagaattgcttgaacccaggaggtatgggttgcagtgagccaagatcacgccactgcactctaacctggacaacagagcaagactccatctcaaaaaaaaaaaaaaaaaaaaaaaaaaaacaaatatgacttcaacatattgcaaataccttcaacaactccgatatccctttgcaaatatccctttacaggctgaggtgggaggatcagttgagcccagaaggtggaggctgcagtgagttgagatcacgccattgcattcaaccacaggtgacacagtgagaccctgtctcaaataaaaaagaaaagaaaaatggatctgcactaaggaataaggagcaacacgatagtaaatacctgagttcataagactttttcttaatttctttaatctgtctaaaaactttggctatttaacatgcattgtggggctcataccttaagtaaaaataaaatgtgtgacaataatatcacaaagaatagaagtggggaaatgaaagcattctgtggtgcagttcttacactatctgtgaaaggatatcgtagttgttgaaggtattctgcaatatgttgaagtcatatttgtaaatcctagagcaaccactcaaagaatagaacagtacagtatagctaataagccgacggtgaagacaaaatgataccattcaaaaccctctaaaagtggttatgacaagagaaagaaaaggaagaacagatgggacaatggaaaaattggtgacttacaaatagtctggagattaacagtaatgtgctaacactggtgttttaattttgataaatgtactacggttatataagatattcacgagtggaaactgaattgggttattcagagagaaagatttcatcttccatatgtttatattttctgctggaagcaagcatttataatcaaaatttacctgggatacttggtaatttataatcaaaattacctgagatacttgaaacagattctaaagcccccacgccagagctactggatcagaatccaaggatggagtcttataaacgtgcataaaacttatgaagctttcctcatgaatccaacacaacccaacacaggtctgtatctggaaattgagacgagatggccctccaagccacgtcccaccctgaggtcgtcctatggctcttagcggtccatagactaaaaggctggatgatcagcaacgctgagacaacagtttcagtacagcagtggggatgagaggcaaggtcaagttttgaggggccaggacacagcaaagaagaggacacaaggaaaggggaaggaaatggagatggtaacacgaggggagggtgggatcggtgcacaacagacgttttcaggattaggaacctgggtgtattttaaggcagaaagcagaagccactggaggggaacagaagacacgagagaggcaaagtgttagagctttggccccaagatggccggaggctagggaagccccagtgagagaggcagagcttggcgaagaggagggatgagagagcatggctaaggtcagggaggatttaagagcgatggccgcctatctagaatgagccgcatgtggctgctgagcatttgaaacatggctagtccaaattgaaatgcactgtaagaacacacactggatttcaaagactacacatctgtaatcccagcactttgggaggcaaagtcaggcagatcacttaagccaggagttcaagaccagcctaggcaacatgtcaagactctgtctctacaaaaaatacaaaaattaactgggtgtggtggtgtgacctgtagtcccagctacttgggagcctgaggtgggaggatcatcttagtccagggaggtggaggctgcagtgagccatgatagtgccactgcactccagcctgggtgacagagcaagaacctgtctcaaaaaaatatatatgtatattcatttagacatatgctgttgcacacttagactatagtatggtatcagcatacgttttatatttactgggaaaccaacaaaattcgtgtgacttgcttcattgtggtctgggaccaaagctgtaatgcctccaaggtatgcctgtatatttctattgcaaaatgtgaatctcgaaattataaaagctacaactaggacaaaaagcaaccccaccaaatagccctatatcaaagaataaaatctctttctagaaccccagaatttgcctctttcagactgaagtttagccaaatctatgaaaaaagagcttgctaaaccaactaattatcagtacaaataaaattataatgaaaagtctatgaagataatttgttctcagatgcccttcacatatagcaattaattcacaaatgatgagtcactcatgtgccttcatgaaggcaggccctcaagagacccgcaacagaaaggaaagccaccgactggagagaacctgcttcctgagccccaccaagttccaaaaaggagaatggggcttcgtcctcaccctcaaggagttgccaaactgggcttggttattattcacacttgaaaagaatgaggaaggtcagccagtcccctccaggtcgctcgggcttcctccaag

SEQ ID NO: 617 - DNA, 466056 bp, Homo sapiens
gggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggtaggtgcggggagccggcagccgagacaggtgcgccgcggcgggagacccactcttctacccagcaaggggcgcttccgcggagttgggcacctctctgtttccacgcctctccttccccctttccccctctcctcccggggatgtctgtcttctccccatcctatcattccaggctggagggcagcaacgcctgctttcccctgtggcaggagagaagcactgggtccctaaggtcagagcaacagaaattttgtctgtgtgtgtgtgtgtgtgtgtgtgtgtgtgtgtgtgtgtgtgagagagagagagagagagagagagagaaagagagagagagaaagggttgcagactcagtgatgcttagttttcttaagagaagtcgtcaaagttgcccctaagcaggtgtcatcttcaaccacccttcccccaccttccagatttcgctggatgaacctttggcactaacttgacagctgagatcactccgacaggcagaaaagaatagcactacactgaagagaaatccttatggaagttggacctgcctcgaaatcccccatgaaggaagagtgggtttatgtctgtagatgcgccactggttatgggggctccatgcctgcgtgctccttgcctctctcctggctggaggagggtgtggggagcccgctggcaagctaggggtgaaggtgagagtggggaccatatttgcacctaaggatgagtgtatgtgtaagacaaggacagtgtgggatcaatggcctttaaattaggataaaagataaccccacattgtattagaatccaacaacgaggaattaggatttattaaggtctctctcacccctcccttccgcaggcaagaataaagacattgacaggtttggagagttgttgacactaaccctactgcttatcgatgttaaaggtcgaggtgatatgcaagcataggtttacaaagatgtacacttgctggagctcagagggtttctggaaaaggggtcagtgaaaacattcttgtaaccctactctttctgagttagtgttcccttcccaaaaaccatataaagtattaagcctgtcacaccatgtgctgttatgtaagcaaacgcagatgacagaggtgtgtgggtttgggagggtgtgttttatttatgggggcaggtgtgtgaataattgggatccccatagacatcgcctggcctggaggccacagtcactagggcatgtgctctgtgtctaagtgttgacttctgatgactcctaaaacgccttcctggtgaggttgttgcttctgcgttcctcccatgcattttgttcgctgtgcgctgagggagttccccacctgagttgttctcttagttactcacacagatcaggtccaaatggatctttctttttatactttggtttctaaaaatagacagatggtggggagggggtagctctagggaggtatgctaggacactggcagttctacttcctagttatgatggcccgtctggcccctgggggaacagggactacattcagcctaatttaggagctgtgagttggaagggggtggtgattacatgaagcacagtgtaggctgctcctggcttattggtattcatcagagtcctcactgggtaggaagacaaagccagagtttgcaagggaaatcatttcagcttgcctcttgtcaggggtcattctctgagcctccttttttaaaatgtatgttgtgtggggttttggctttctgagttgcatgctcacacatgcacgtgtaagtgtgtacacacacaagcatagacatggacacagacgcagcatgtttctatagaagaataataacattgcgtctgctttacaatccttacatagaggtggattctacttcgtgaacatcatttccttttaaataaagctttacagtctccaattcctgcatcagtgtcacctcaggtgtctggttaaaagtgctcaccaccctagacttgcagaatcaaactgtctgtgggtgagaatttttaacacgctcctcaggcgatgtttatgcagactaatatatggggattgccaccctattttgcccccaagactaaacaattgatctttgaactcataaaccctccccatccaaaccaggccagtcagtctcaaagtcagaggaaagatggtgaaaaggaggtgcttccatctggagcatgtttgtgcctgggtaacaggaaattgtctccattttgatcactgttacttatttgttttggagtaatggtgaatggcctgcccactcgtcatggcggccattggtgctggactcctgcagcagggctggctgttttactgtgggatggatgaagggtgtgtaaaaaaagagcaggtttgtcaggagctgagggtcggctccttggtggggaccacaccacctcccttctgggggcacctgaggacagtgtctggtgggagcttatggagaggaggcaggaagacctcacagaatggagtctgagtgaaaggactgagttagggtatggagcatggctgcttgcgtgagggggatcatttgaggtggaggagtggagatttgcaggtaggcaaaaaatatcttttgaagaacatgtgtatttttggaatgaaacttgacaggcaaaaagaagggggctttgggagagagggtgtgtgtgtgtgtgtgtgtgtgtgtgtgtgtgtgtgtgtaggggggtctcatctgctccttctgttgctaaggaacatataagctagggtttaaaaataaatgaggagtgggtgggcatatgcagtgactcctgtctttttaggaaccagagccctttacaaaaagcctttaaataaccatttctggaggcagattattcattttgcttgacttttactttgttaagtaaaataaactgctttctgtactcctagatttcccctcattatctattctgtgttggctttttttgagaaccatttttcccatgagaattttttcctttatttcagaatctgcacccctagagcaaatagtctctgtcgactgtaaagctgaaggtttgaaaaggcagtgcgagtgagctggtacttttcttttaaaattactacttcgtttttctttgcaaattatggtgctgcaacagatacatatgtgtaaatgactatatactgtgtaggaactgtttttttttttaaactgctgtaagaattcccatataagtcagtacaataaaaaaaaaaagacttcagaaacacataagggaggggaaggagaaggtagctgatgtttattgtcttctatgcaacaggcactgggctaagccttattgtatattctgtcttaattaatctttgtgacagtcctgtgatgtgactatgactatttccattttattgaaaatgaacttgaggcatagagcttgggcaggaggcagaatttaaaacacagatgactccaaaggactgtctctttagaccgcatcacgctgcttccctaaacatttattttaggcttgagctctctgtccatgtgtgcatatgtgtatgcatgcgtgtgtgcagtgtgagttatcttccccctcatctgtaatacacggcaggtcattacatattattattattatatattattgcatacctttttttggcttgtggccctttgtctatataattttagggaactcttctactatctcagaaatataaatgaatataaattcatgattgcaaatatatcagttttgcttctgagaacaaaaccacctacatgcacctgctatgaagatatcctcgttagaggtttatatgccttaaaaaaaaatttacacagggttgtgtaggcgaacctaggtccaatgaagagctggcccatcggtacctctttgggcagcacagaatgagtgatgaagtacaattttgcttgtcagtatgtctgggcagaccattacttatgagatgttgatgcctatgatttagtttctctgctcataaaccatgctggtaatactaaacctttcttaaaggaagtttttggtatgagatagaaataggagcaaggagtattaaacgctttagtttgggcaaccatgtaaaaaatgatctgttattctttataggttgatgattagaatgtagtttttttgcgtgtgttttgtcccacaaagtaaggttgtgttattacaagaaagatatttgaggagttcgaagccacgtaggataaaatggatattggtcttccttgcattgtaatcaatagtgtatgggggaacttttctcctgaatatcagtatgtatcctcttttgtaaatccattttattttgtttttatccgtgttttgcacatctgttagatttttaaagactgtaggatcagattaagatcttggttctaatttaattcctttctcagtaatgacttacatactgactgttacttcctcagttaggatacacactgggcaagatttcaattcaaccactgtccggagtacttattctgctctaagtgatcttttagaggcttgatttttacctgggagattgacactattgggtcctgtggaatctggggatagggaagttgaagagaggtctttgctggtgttcaattctgctgtggcaacaaacaacagcattgcctcatggggccaaattcaattagactagagctagctctttccaacaccgcactttctagtctgaggaaatgagggttcctagtgagagcccaggctgtctacaccctgtatgttcgtctggcctgggatctgagaacatgttccctacacaaccccaaggtatccttgaagttgagtacactgtgagaccagaagcatctggaagaactattgcctacacgttgggctgtgacatttgctttcttccatgggtatgtgttggtaacactgatcctgtggagactaattatttttcctgaggtcctgtaactagttttgggacagtagttactgcaaataaatgatggcatgtgagcttttcttacagtggataactttgaaagaaaggtcagaagtaaaatgaaatctaagccataaaactttttttcattaaaatttaatttgctcaaaatgcctataaaaatgggctgatttctaattgttggaactgattgaaacctatttcaaggcacaaaaacaatgcagataattggagaaataaaaataccaagctaagtctgtttgcccataatgcttccacaactcattgctggcttgttcaccaggaaaactcctcgattggtatgagctcaaaagcgtccacttggggtgatgggtggctggtgctcccctgttctttcaaatagctttgttgagacaagtgtcattttctggtctgggacttagactagggtttgaacttggcatctttctgctaatctcagacaagctatgtaactccttggaggcccagccaatgtgtttctaaaatgagataatagtaatacaggtttgttaggaagattaaatgagttactttatttaaaggacatggcatagtgccctacatagagttaacttgtgtacttattaccattccccaaactaagttgttagctcctttgaagacagaacttgcacctgatcatttgaatcgatgactctgattcttcttgcttggtaggtgttggataagtatttattgaataaatacatttcattggcattttaaaataaattactactgttattcattcttggttcatctcaattgtgagtttcttttctactaaagaaacctctgcctttttcttatttacactttgtccagcagcccaggactgcgttactgtttacagcttcctgtttgcgtacctgcatcagccatttaggcagctgtgaggctggagaggggtggcagaaactcttacttaaccagctatttgcagcttgtcaaagaaaaggccttaatttgccttctgagtagcactaattagctctccggttctctttctgtctgtctcatccctttccaaggggcagcattgattttctcctcagggaaatttctgttgacttttccttcagtgattaaaatgtaaaaatgcagaaaaagggctacccagcattcctggagtcctgaccattgtccagccagccggaggtcactccagccacctctgttctatattacttcactccctctttccttccagctcatctgattgactttggtgaaaaagttattttaggaagaatgcattagtccgcttagtgactctaagcttttgctttgtttttaacccacttaataaaatcttcagaaaagcaccagctactttttattcatgtaccatacagagcacttgaagaatggctcacgagtgtcctgacacccatagtgtttagggagaggagggatgagcactgcttgggttactttagagaaaattaaatcatcttgtgtgtgcatattagctgaaggagggggctgtgattgggtagaggtgggaagaaagatctttgcatatgaatgttaatgttctttccttccagccctgagttttgtgagcctttgaaataaagcaaacagcattttcttttaagggcaacagctttctaacaggggcttctgtcattcttgcatccaacctagttttgctgaaatggaaatttgcctttagatttccagactcataaataatgttctgataaaagaaccaattctggtttaagctgtaatatttatagcctggcttttgttagatgttgggaacaacattcgaaacagtaatatttaaaccacaattaaatttcatttttcttaactttcaattacttgagaggtagaggagagtactggtgaagagccctgctacctgggtccaaagcgccacctctgcctgctgtgtgcctgcaaaagttacttaacctctctgtgtcttaatttccctatctgcaaaatggtagtgatagtagtactcatcctgtagaattatttgacatttaaatgagtcacaaagtacatgctatatgtgtgtttgttaaagtggtattatctatactcaagtccagttaaggaacagatttgtctattattcttcaaaatacagaacatcatcaaatgtcagcagctggtgataaaattattcaggtaatatgaaaatgagatagacatagacttgagaaatttaactgacaggttttggcattctttaaggtatagaatatgtactttttctttcataacttattaaaacacaattcattgttactaggggatgtgaaggggagaaagctgcttcttagtgctttggaaattggagcagacagaaggcagaggtcggaggagagaggcacagtcagtgtgcggaggaatcaggtagcagcaatccaaactcccagctggtcatctgagagcaggaagccagccgtggaggggtgggtgagaggggtctcagagcttcacagtgtcaggaatggataagctgataaagaccgaggtactagaaatagaattgtcccctgtgattccaggacagaggttatttctcttctggcctgtcttgatgatgcctgctttgtacatacagacaatggccggctggcatgccctggcaatcacagaaagaagcttcgcagatgctacctgccctggattatttcagaaatggaaggtgcagccttctgggatgttccatcagttatttgaaccaggccaaacagcagaatatattttaaaagatgtagatggttattaaatatttgttggacaaataaaacggctcaggactgtgaaataaattttgaggaggtgaattcattttttttcccctaaaaaaggcaaagataagacagttggactgcttttgtgtatcatgtagtctttcaggaaatagccagaaaatagattccttgaaaggaccaaagtacattttaaaaatgtgtcattcctttgtacatgagaaagatgtcaggcttgtaaggaaaaatacatttttgcttttttaaaaaaaaaacttgaaagcaatttgttgaaagataaaaagagctttacataagcttatgtggaagcggtcggaaagggttccgtgtatcatttagagacaaacttctggaacattcctcaggctgaaaggcctcagatctcatcattgtccttatggatgtgtcagagtttgagacaatctctttcagactgaaagcattctctttaagagttttgaaggaagagcctgtaatcccagcactttgggaggctgaggcaggcagatcacaaggtcaggagatcaagaccatcctggccaacatggtaaaaccccgtctttactaaaatacaagaaaaattacctgggtgtggtggtgcacacttgtagtcccagctacttgggaggctgaggcaggggaattgcttgaacccgggaggcggaggttgcagtgagctgagatcaagccactgcactccagcctggtgacagagtgagactctgtctaaaaaaaaaaaaaaaaaaaaaaaaagtttctcccttttaaattggccccctctcaatgcaaagactaaggtgtggcatgtttcttttcctatgcaattgaagcaccgtcctcagtgtctgaagttacacaggaagctgccaagcatgggcttccctgacagcgcacaacctcggggctgcttggttttcatggctgtcttcattagcttgggctgctgtaacaaagtcccatagactgggcggcttctaaacaacagacatttctttctcatcattctggaggttggaagtctgagatcagggcaccaacatggtcaggttctggggaggaccctctttggggctgcagacagctctcttctcatggtgtcctcacagggtggaggtagtgaggctcctgggggtctctttctagaggggcactcatcccattcattagcgccccacccttgtgactgaatcacccccagtggccccaccttctagaaccatcacattgggggtgataatttcaacatgtgacttttgggaggacataaacaccagcctaccctgctttttctcacaatattccaggaagccacagacatcactcctcttgtccttcccagtggcctctgaaggccattcccagaggcagcaaaggcaatccatgcacttccaagctttttgtaagtgcagctcagagaaggaaaaagcttttcttggttcaaatactgaccgcaacgattaacttacctccctacctgtgaatattaatcattataagttactgattttgccaaatgcttacactgtgtcaagagctgctaaatattttacatttgggatttcactggaccgtcaattaagtagggactattattatttccattttacagagaaggacattgaggcttagagtttaagcagcttgcctgcaagtcacatagctgagtggcagagttaagatctgtgcccatatttgcatattgcttattacttccctattgcagcttttcttgtcctcttttcaccctttcccattaccctctctgtgtgcaaatagccatattttcacaatctagtggtttattagaccaaactctcttgaggagagagacccatgtgtttcatcttcatgggcccagccagacctcacacaagacatagagagaggccttgacaaaggttgattggctgagtggatgaacattctttttatgtctaagcataaaacttagctctgtgaataatcatgtgctactgtcagttgtagggaggccaagattgagctttccatggtgtttttttgtaaaaactatatgaattttccattgcacaagacgggggaataaatccagtttcctggggccaagaaatgattgcagggattatagactggtactgctccttttaaattctacagtacaagaccttgtgatttgttgtaatcacagtggaacttgaagggaggtgatggtaccatggattggggtccagtgaagaagctagggttaacttatgtgcactttacatgtctgaaatggcatagtcagccccatttgatttttacaaaagatattcttagaagagtctggtcttttacctttagctcgaggacctgtttgagctgcaagtctttgcaatatgagtttttccataacaacatccttcagaattcgtcagtatgttcatgagtgcagttagagacacctagaaagttccaaaggaacattttgaaaacctgagtcattctttctcatttgaagaaaactttcagaatttcttaggaaaataaacctctacttcaaaaataaatgcccaagctatttaaagattaaaacagaagctttctatgagccagcgtggaattacttataacaaagtctaagggattttttttaaagacaaatttctggagatttcttaaactgttatactgactaaatttaggtacttaataataataaaaatgtgtgtggtgctttcacagcttaccatttataaactcctttcacataattaatctaactactcacaaaacaatcttaggcaaccccgtattgttttcatagccattgtacatttaaggaaacagtcacagtagctaagcgactttcccaaggccatgtgccataagggacattgccaggttcaggctggttttcggatctgaagtctcatactcttttcactgcaggatgctgtttcaacacatgaatctatggaaaaatagcaccatttccctctcattaattttacttacttgaattaatctcactggtttatcacaatggacaaagttggaatcactagctggtattctaaatccatattgcattgacaatgaggatgacctcattgccattgtcattgcccttcctgtacacatgaaaacatgaaactacaagtgtgatggtatatgtttaacactcctcttactggggaaaaagaaaaaaaaacaggtagagatagagtcaggctctttctttgcattagttgctaagcagcagccatttcattgtaaaggagacccagttcaagtaatggcataggtattccaagaatagtatttcatttttatagcaattgcatttcaggtctccagaaagcatatgcttctgtagctcagtgatttttaggggaagaaatagccacctcaacatatttgttgaacatatggagaaaattcagtatagctgattacctaataaccagacttccgtgagccgcacacggttcacaggggcagcaggttcaggctacccacagtttgaaggatttggaagtctccagaaaatactgctaacaaacaggtacgttttgaggctgtatttgacattcaccgataccatctcaatgaaatactctgggtaatttagaatgctaagggtattgaaatgacatggtatagaacaaaattttgttgttgcagccaaggggttggatggtgccaagatttcattgtattgagctttcgctggcagctgaaagctcttcaaaatgaagatagaaaatacggtacaagacaagcataattcatggagctcagtttatcagaaggatctgagtgcagaggaggacgtatacttaatgtcccaatgggtatgtgtgtgaaggggcgatgtcaatatacaaagctgtcaggtgctatattttttgattgcactatcactattaattttgaagatggattgatctgtgtgtggaagccttgaagcccttggccctgccttttaaggcataaaaggcatttctgccatctctgttgtaatttgccaaactattgtgaaacttatgtgtatctatacaaatgtattttcttcagagaattgcttcatggagttgttaagggagcaaactttgttgttttctaagagtgtgctgcataatactgctcctcaccattcccctcctcaagatatttgagagaaaatgcccctttccaggagcagctgggatgctgggaagcttgtctttaatttccagtaagttgcccttccatttaaggcaaaatacctcttccaggaactaaaagtcagactcagaagaagtaatacatggatgaattcacaaatggtgaatggttattcccattgtggtgctgggttcattagtatggttggttttagcatctctcgaacaattaatgcctctcatatatgtttcatcatgcacttttacaatgactcaaaacagctttagcaaaagcacttgtgttatacgaacccaatatatagatggtgaaatcaagacaagaaaggctggggaggagagatctaaaacattgacttcccggcctggcataaaacccatagaaatgcaagatcctaagtgtctctcagaaaaagcatatctgggaggtgctcaatgatataccttcaacattaatatgaggtcctacttgccaagaactgtgaagtgctttacatatgtggtttcagttaattcttatcacaactttataaggtagatgcttttactatccatagctttacagaaaaggaaactgaggcacaggataatgaagtaatatgtcagggtgtcaccaccagccaacggtggagccagggtttgaattccagaaccccctgtctagtgcacttaagcattattctgtgctatattcctatatgcatccaaaaccctgtttttccttttaggaatgacctctgtcctcttgtgtgtagccttgaggggctgtacatcaaggtgcctggctctccaccatggtaaccaatgaggcctttggaagctgttgtagggggcttcctctcaccaccctgatagcatcttggggcaagtgtatgacttgagcttggacgaccagactctcttggacttggactcaaaggattgtcaaagggattgccaatttgttcatatccactggcagtgccctggtaggacaattcctgctgctctggttcctgtctttattcaaagcataggttgtgatatggtttggctttgtgtccccacccaaatctcatcttgaattgtactctcataattcccatgtgttgtgggagggacccagtgggaggtaattgaagtatgaggatgcgtctttcccttgatgatctcatgatagtgaataagtctcatgagatctgatggttttatcagggtgagtttccctgcacaagctgtctctttgcctgctgccattcatgtaagacatgatttgttcctccttgactttgccatgattgtgaggtctccccagccatggggaactgtaagtctaataaacctcttctgtaaattgcccagtctcgggtatgtctttaccagcagcatgaaaacaggctaatacagtaaattggtaccaggagtagggtgctgctgaaaagatacctgaaaatgtggaagcgactttggaactgggtaacaggcagaggttgaaacagtttggagggctcagagaagacaggaaaatgtgggaaagtttggaacttcctagagacttgttgaatggctttgacaaaaatgctcatagtggcatgaacaataagatccaggctgaggtggagacaaggaacttgttggaaactggagcaaaggtgactcttgctatgttttagcaaagactggtggcattttgcccctgccctagagatttgtggaacttagaacttgagagagatgatttgtggtatctcataaaagaaatttgtaagcagcaaagcaatcaagaagtaacttggatgctgttaaaggcattcagttttataagggaagctgagcataaaagttcagaaaatttgcagcctgacgatgcaatggaaaagaaaatcccattattcaagctggctgcagaaatttgcataagtaatgaacagctgaatgttaatcaccaagacaatggggaaaatgtctccagggcatgtcagaggtctttatggctgtccctcctatcacaggcccagcggcctaggaggaaaaaatggtttcatgggctgagcccagggacctcttgctctgtgcagactatggacttggtgtcttgtgccccagccactccagccagagctaaaaggggccaaggtatagcttgagctattgcttcagagggttcaagccttaatccttggaaacttccacatggtgttgagcctgcaggtacatggaagtcaagcatcaaagtttgggaacctccaccttgatttcagaggatgtatgggaaatgcctggatgcccaggcagaagttcactacaggggcagggccctcatggagaacctctgctagggcagtgcagaagggaaatgtgaggttagagcccccactcagagtccctcctggggcaccacctattgaagctgtgagaagagggccactgtccttcagaccccagaatggtagttccaccgacagcttgcactgtgcacctggaaaatccacagacactcaatgccagcctgtggaagcagccaggagaggggctataccctgcgaagccacaagggtggagctgcccaagaccatgggaacccatctcttgtatcagcacgacctgaatttgagacatggagtcaaagttgatcattttaagctttaagatttgactgcccggttgaatttcagacttgcatggggcctgttgcccctctgttttggccagtctctcccatttggaatggctgtatttacccaatgtttgtatccccattgtacctaggaagtaactagcttactttggattttacaggctcataggcagaagggacttgctttgtctcaggtgagactttggactgtggacttttgagttaatgctgaaatgagttcagactttggagggactcttgggaaggcacagttggttttgaaatgtgaggacatgagatttggcaggggccagtggtggaatgatatggtttggctctgtgtccccacccaggtctcatcttgaattgtactcccataactcccacatgttgtggaatgagcccgatgggaggtaattgaattatgggatgggtctttcttatgctgttctcataatagtaaataagtctcatgagatatgatggttttataagggggagttttccacacaagctctctctttgcgtgctaccatccatgtaagttgtgactagttcctccttgccgtctgccacgattgtgaggcctccccaaccacgtggaactgtaagtccagtaaacctgtttttcttcccagtcctgggtatgttttatcagcagcatgaaaacggactaatacagatcatcagtctttctattcattgtgaactatccaacatcttcccgataaaattcctttttgtttaagttaactaggtggtttaaaaaaagtctaactgataaaatatcattggcgaatggcccagcagcctctgcttgtgaatgtcctcagtgccagagagctcttggatacattaggggcatagttacgccgttggtcaattctaattgttagagagtttttgttataggaaaaatgaatatattatcatttagtgaatacttaatatgtgttaggaactttcttgcctcctttttgtgattttcttgtttaattctcacaacaactctgagtagttatcactattgtacagatgagaaaactgtctcacacaggggaaataatttaagtcaaagggctataattgatggagtcaattaattggattcagactcagttctaagtcacccaaagcccctatcttttcccattacattctgctgtcttcatgttgagtctgaaactgactccttaatttttttacgtacttaatattacactgtagttctggaggacattcaggataataccctttccttttctgtataacaggtcttcgaatatttgaagtcaaatatcacatgcctcttcagctcttgtttctttagactgcaccatctccactttcattctatcccttatccaaaagtggttttcaatcaacttcacttttctggctctttctaatttgacagcatactgggttatccatggctttcttcataaaaatgcagcactaaactaaaaatgtggtccaaccaaggtcaccattagcacatatggtgcctttgttcaaattagaaacaggtttcaagtctgggatgcatgaatttacaaaaattctcttgcactccagagcacagtcagctccagctaggacctctcctgtggtggggggcactgaggctgggtttctgtccccatctgctcctcctttggattctctggtgcaggatacacctacataccataggcatagctttggggacttcattagcttgctgtggctgttggttgtggatagggattagtatgggtgtggaccaattgctgtgaaactcattccaaaagttgaatatccagactgccagtttaacaaattgctgataatatttccaaagttttgcttaggttgcagccatttcacttaagactggccattttagcttggctaaatgtttacttggcttgtttcctacttatttcagatgccatgcccttttagaatgttccacatccatcccttcctctgtccatccatctgtccctccttccctctctctctcatttttcctagataagaaggggcaagctctctcttaagttctatttactattatctctatttttcagacttatgcctgcatcgtcctccttttgaccctgctgctagtggagaaatgcctgtgaccaactcttccaaaaactggcttaagctatttgagaggttttggcgaactttctttcagtgagttgacacagagccaatgaagaaatccatgtggactttggctaaaactatatttggtggccaagaaaattacttatcttatccagaggacagcattttcctattttaagtacaaaggctatgccgttcaatacagtgggcactaatcctgtggacctaccaaaactaattaagtaaactaaatttgaaatccggttccttctttacactaatcacacattgagtaaataagggccttatgtagctagtagctgtcctgctggacagcacagttacagaacgttttcatcattgtggaaagttctattaaacagcacagcgttgtgggattagggtcaagatactaatttatcaaaattacagaagcctctagatagccatccttgaatgataaccttgaatgatgaagttcttgaattacgaagtctagtttcccaagttaagaagttgtactttcagggtgtaactaggaaggagagagaactgtagacaggaaatgtggggagagtcctctttggtgttccgcatcatccttactgtcctatgttcctctcctcaccacagtggtgactgaggataaggttaaagacagagagtttgtcttctctttcctttgcaaactgcatcttcctctgctttgccagacatattgagcattagatgtaagagaatgtgttctatagcttttgggtggcctagctgttttgccatctaaaatagttcagcttgtggtggctgcacttggaggtagaataaaggttatgggaagagcattattgcttctccagcaattaattcctaaaatttgggtaagaggatcattcaagatgaaggatatgaacttagaatgtggatgtgtagcttcaggttatgtctgtgtcacagaaattgtttcttatgctcttattcttatattattcttaacatcagttcccatcatgttaaataaatatttattgtaaattcacttgggaggcatagaagtaaatgcatggacttatacttttactgtggctcccctgattcctaggggagagaccttaggaagctgtgaaaagagcttcaaggacagagcaaaagccccaggaggatctgtgtgtgtttgtgtggattctatctggtgctttgaagtgccaatattgcacacaagggtgttctaaaaataactcaagtaatgtgcattctctgctgaagggagtgagataattcatgaggatgatgagaaatgaaaaaggaaaaggagagaagctttagaagatgagaaatgaaatacatgcatctcaatggtctctgaggctcttccacgcactgagtgctttctttcaagtcttggtattgaaagctgggaaaaagtacttaaaaaaaagcatcactgggagaacattggggttttctcacctgttttatagcatgaggaatcctctcgataaaaacttacctaagttgtaagaatagatatggaatactaatttgttatatgtgcaaaacactatttcaagcacttggtgaagaatccaaaattgaataataaatgatttttaccttaaagttgtttcaagttgcttataacttattggagaaagaaataaaaaaaatagccactatgtgccaaatactatgtgaagtgctagaaataaaagagaaataagagtctctgttatcaagaatttatggcttggtgatagagagaagcaagacattgacctgtctacaggctgataaatacaaagagagcgggcggtcagcgggcaggataggggagccctgagagagggcacttatgtctgagtggagagtggaggatctgcagcaagtgatggttaaatgtgccttgaaggaggaagagaagataaccaggtggagagaggaattaaaggacttgttcatgtcattgattgaatggagaaaacatactcagggttctaaatggcaaactagaaacagaattttagaacacagtccatttgcttctaatctctcctgaaaagctctcaaagtagatcatttgaatatttgaaggaatgaaaggctttaacaggttccactaacctagaattccacacataagtgagctttactagaagttgtatctattccgtgcttcttagacatcagcagcttgaacaaaggtaaagcagcgggcatagcatgatgcacatgattgtatctggatctgggtgataggaacacaaaagtgggagaggttagttctgtttgggagaagttttcttggagcactgactttaaagagttggtaggatttcaataggaggagatggggacacaaggagggagagtatggaaagcgttccaggcagcaggaattgcatgagaaaggatacagtggtagaaatgtatgacgtatttgtgcagcagtgtgaatggtgatgaagtagtttgggttgagcataaggatagagtggaagataaggcagggaaggttagttaaatgctcattatggaggactttgaatgccatcagaagaatttggattttatagttaatagggagccattggaggtttttgagcctataagtgatgctccatactcagctgtggggaggtccttgttctctctgaagccattgctggttaccctgcatccagagtcactgttatagctgcaagtcattcctgtgcaagtgacacctccaccctgccatgcctccagacactccagtatggacaataacttttctttctcctctagcacatgaagaaggaagggggacccctgttctgtctgcaggggccatggtggctgagaaccaggcttttctcatgccttaggaataataggaagtagggtgagtttctagtctcaagctttgggaaagattgagtaaggagaatttgagatgtccacagagtttgaacgtgaaactcatttttacataaaggaatataacggatggtgtttagatttgatgccattcattattactttagcaaaataacattgtcctaagttctatacaggtaaatacacagaaaattctggaacgtggcttgcctctgagctaggcactttccctctaaactgtttggataaactcgcctgcccccgccgcccccttccccctgccagatcacatcactggactttaaaaaacaaaaatgaagtggatagattttttcccccagattccaatacctagaaatcattgaacaaattaataggagaaatgtgtgttctgaatttattagaaaacagtagtcaagcagcttaaacattgttcactgtcagagggctgtgttactgtctaacactgttacatgaatagagattggctggaccagttaatagaaatacagataattttgcagctaagaaagatttgcctttagctgcaaaccacacactcttttcagacataatcttcagtaaatggagtgcaacattgtggaggaaagtcagtgtgaccaattctgactgctggctttcaggcctgttccagaaggattaggacgatggccggcttattctctgcattatgtacatgcattgcaatgcctgagagctggctcacgctctgcattttggagaaatcacctttcttctcatataatggaaaatagagaaacatagaaaagagagcaactttgagatcaaagtattattaacaggcaggaaaaaatagagtcttggtttaaggccacccagagtgatgaacagtcttggacccacaggcccacatgacctgcctgacttggagatgcaacctacaaactgatttcatgattaagaagttaaaaacttgatttttcaactaaatccaattgttaataatgtggagactactaagcaagttcataattctagtcaacaatactaaattcaaagatgtaaaacttcatatttttttcttgttacttaatagaggcagttttattttaaatgaaaaaaagtgtgtcccacaattttctttcttgatagccttcattcaaaaaggtttacttttcactgccctagattgacaaagacataaacaaattcagaaaacaagtctgttactgtgtcaccgtccatccatgttagaaaatactactgcctaccactgagtgtgtgtgtgtgtatgtgtgtgagtgtatgtgtatgtgtgtgtgtatgtgtgtgtgtgagtgtgtgtatgtgtgtgagtgcgtgtgaatgtgtgtgtgtgagagtgtgtgtgtgtctgtgtgttggggggtgcatgcctgtgtaaatgggcgtttttcatgtcacttgctaatcctcagataggtctcattctctgagccccaatgtcctcatctgaaaaatgaggctaatgatacctatttcccatcatggctgttggtgctgaatggaataatgtgtgcacattgtaaattttatagccctacagccatgcaagatattgctgtcaccaccaccatgcttcatcacatgtatgccgtctgccatgggataacgtgaagacattacaaacttcttagggtaatgaaatttcttaacaccagctctggagcctaggtttataaatggtacagattgttttggagacgtgcaaatgcagttatgtgagggttggccagcttttgggtttcgttgttaaatataatatttatttaaccaaagtaatatataagcaagacttaaggcatagctcatagttagaactacagagctttattgtggaagacagtgtggcaattcctcaaagaaataccatgcaatccagcaatcccattactgggcatatactcagagaaatataaatcattctattatgaagacacatgcatacatatgttcactgaagcactgttcacaatagcaaagacatggaatcaacctaaatccccataaatgatagactggataaagaacatgtggtgcatatacaccatggagtactatgcagccataaaaagggatgagatcgtgttctttgcaggcatatggatgaagctggaggccattatccttagcaaactaacacaggaacagaaaaccaaatactgcatgctctcacttataactgggagctaaatgatgaaaacacatggacatacagagggaagtaacacacactggggccttttggagggtggaggcggggaggagggagaggatcaggaaaaatagtgggcactaggcttaatacctgggtgagaaaataatctgtacaaccaaccgcttgtgtaacaaacctgcacatgcacccctgaacttaaaagtgaaaaagaatgacagggctttaaataaaacccaataattccattttcttttctttttcttttttttttttttgagatggagtctcactctgtcccccaggctggagtgcagtggcacaatcttggctcactgcaatctctatttccaaggttcaagtgattctcctgcctcagcctcccgagtagttgggattacagacatgtgccaccatgcccagctaattttgtatttttagtagagacggggtttctccatgttgctcaggctggtctcgaactcctgacctcaggttatccacccgcctcggcttcccaaagtgctgggattataggcgtgagccgctgcacctggccaatagttccattttcaaagtctctcccatactttcatttcttcagcgttgttatgatatattaactgttttttctgattctgcatttgtatttatacatcacatgctactaaccactaagtgctgtttggtaattttttttaactgtcccttctgaggtgaggatttagtagttctctttttatcccacccttatgtgtttcttcttccatccttccaatacatattacaattttatttaaatcattaataaatgcttatattatcatgactttgtaaatcttatccatagccgagtcacccagtgtgctatgaaaaccttttctttcttgtattattggtcttattttaaaacttattctcatatggacttactcatgattcttccacaaagttcttaacaagacaataaatgttttattgcatttaattgtatcaaataatgagtcagtttcatggtttttcttgtagacagcccttctggttccttccatcatcttgccctgtctgaactggtttttacatagcttccgttcttctccaatactttgacatccttctgccattttcctcaggcggatcctctgacttccagatttcctaagcgtcacacctccttttctgacttatgccttgtctgatggaacaaacaattttaagaaggagaagaacaacaccagcctcctcaatgaggttttttccccaggaactctcttcctatttttagatgaccaagttgaaaaagtttttcaggatgtgaaacatccgcaggagcttctttgcagagggtacatgggagtcagatatttagagtccttttatgtctgagaatatatatacattttaccttcacacttgactgagagcttttcaggttatggagttctagatgggaaataattttacctcagaaatgtgaaggcatatctctgttgctgctgtgcttacagagtcacagctgagaaaaattccattctaattctcaataactttacatctttttctttctttctggtttatttttaacatttttccctttatatacattgtttaggaatttcaaaactggtgtactttgtataggtacatatattcatgggttttgggacctttttagatctcttcgctctaaaaacttttaatgccaagaaattgtctggtattttttttttttgggttgggggagaatattttcctcctccccaatttaccagttgcttttttcctggaatttatattaaatagccaatgtatctactgaactattcctctgattttttttttctattaaagttctcctttaccttttattcttctttctgggagatttcctcatttgtttgccatcctttcactggatttttaaattttttgtgatcatactttttatttctatgagctctttcttgttttctgaggttcctttttgttttattttatttttgttacatagctttaatatcttcttttattcattgagggtattaataataatttttggatgttgtattcaccctacattaattctgttttcttcaaaaattttcttctcttcatgctgatagcttctctttacattggaggctgttcaaatgtctgatgatccagtaatatttaagagagaggccccaaaaggctgaatggaagctcggtgtgcatgtctgtgacttatgcttcaccgtggggtcctggtttgttttattgaaaaaaccctaaactttagcattttctgtttagttttctcagagaagaatcctccactttccttaagagttctacatctatcttttttctgaggctgaataataataataattattattattttggagacagagtcttgctctgtcccccaggctggagtgcaggggagtgatctcggctcactgcaaccttcacctcctgggttcaagtgattctcctgcctcagcctcctgagtagctgggattacaggcatgtgccaccacgcctgactaatttttgtatttttagtagagacagggtttcgccatgttggccaggctggtctcgaactcctgacctcaggtgatccaaccgcctcagcctcccaaagtgctgggattacaggtgtcagccaccgctctgtgccctgaggctgaattattattattcagtggataggctttcatttgctctctctgcttttagtagagggtctcacactcaaacccagctgcggttgtattttctagttctctctggtgtagcttttttagaaactaaatctccagtctcatagctgtgtgtggcacatgggagtagtcagaggtcctcagaatgggggtctaattactctctagaaaggattcttcctgtttttggctcctcctcacaccctcaccttcagcactacctgatgcctctagtttctgagcttttctggaactctgtggggtgaccccacctctttttgtttgctgcttccttcttaacacatttaatttctggatttgtctactctgcctgcattcagctcacttcgcagcttccaaaaaggttgtcatctgtctcttttattgtcatctcctgttttctttcttttctttctttcttttttttttttctgatgtatgtcttttatttccttgactttcatcttactgggagtttctggagagagctgggctaaaagtatgtgtccagctcaccatagtgacctggaagttgcttattctgttttgctttacaacaatagaaaagttaacatattcgtgtatttcttcagaatttttaaacaatgttgttcttagttcctcttacttctaaaggacttttaagagtttttttaggtatttcatctttcccaattctctgtctgtgaccaggggtgaattggtaattttacatctttttttcaagcattccaagtagaggaggcaccccctgtgacttccagtggcattctgcagcaattaagtcgcattcattcagctcatcatttaccttgcagccatcaactcctttcaaaatatccctttgattgtcagtaactacggacgtgaagctgtgggtttcttccaggaacaatgctcttctctgtagcctgtgttctcccagttttctgggaagccctgagacttgtcattctcctagcagctcagatgtcattctcctcaaacacccagatttcatttagcaccaacgaggtgctcagtctgggatttctgagggactgtcactggggagaggctgttgctaatgaggtgcaaattggcagcagctggggaggagctgctctccccctctagggctgggccccaggggaggaggggagggttgctctgacattttcagaggaggttggtgaggggccgaaactagagactcctcaccctttagcaaggcctgatgccggctgggggaggcccttgcgtcttgctgagaggctggtctggtctcacacagccccacctccagagttgctgccagctggctaatttcttggctgccttttctggctggctttacttgcaagcaggagaggccatgatcagacacggggttttcccagacattggagagacagctaagaagacccacagcccccagagacactgtccttgggattggtgttctagaaggttatgaggttggggtttggtggtggaagaggggttactgtagcaactgttgaaacaagagagcccatccatctccccccagcatttgcccgcctgttttacatggaagagcctcttatgcattaaactgttcacctgagtgctcccaccagctgcgcttctctgcttctgcaaggtgcagggctctcacagccattttcatctgcaagggtctctgccagagctgtggcagagttttctgtgggatgaatcagaaactatgttctgatgaagagaaaatggagggcagtgggtggatgtggaatgtcagtaggtagttaagtggctttttgtctcctggtctgtctgacaaagtgtgctgattggggcctcctgctgtgagattcatttgggtgatcttgagcaaatctcttaatttctctgactttagcatccttcatcttttttctctgtatctcattttttctaactttttaaggagcacactgagtgctagcctagatgcaaggatgagtgaaatgaataaaatgcagtccctgtcctcacagaactcaccttctggtggaagaaggtggacatatgaataacatagacttacacatgatgagaaatgcactatgtcgaaggcatgcaagaagtgtcatgggatgatgaaggaaggggcaacgatgctctctgagagggtcagagaatgccctacagcggtagtgacatttgaactagttgttgaagactgattctgtagggggacaaggaatagtaatggaggtttgaaaaaacatggtgtattctagaaaagacaagttgtttgttgacactagcatgcatgtgcaggatgaactggcaggctgtggggctggcagtggactaggtcagatgatgtagagtgcttgccatacaatgagtttggatctcaccttcttggggatggggagttgtgctgggctgtgcagagaaccatgatcaaatatttgctaaatgagtaggctgggccatatgatcatttaagatcccttgtagtctggctgggcgcggtggctcacgcctgtaatcccagcactttgggaggctgagacgggcagatcacaaggtcaggagatcaagaccatcctggctaacacggtgaaaccccgtctctactaaaaatacaaaaaattagctgggcgtggtggcgggcgcctgtattcccagctactcaggaggatgaggcaggaaatggcatgaacctgggaggtggagcttgcggtgagccgagatggcgccactgcactccagcctgggcgacagagcgagactctgtctcaaaaaaaaaaaaaaaattcccttgtagtctgaagttcttggattttctgtgtgggtacaaagctgtgggtctgggaacacagcttcgttgaggagtgttatctggtgtaacgtctgtgagtaggtgtttaaatgtgggctgtactcaatagctatattaagaggtagcatcaagcagggagtggagcaccaggttcccagttaagctggagtttaaatatgcaagtcttgtttcagcctttgatcgtgcttttgaccatggctaaagcacttaatctgtcgaagagccttaggatcatcacctgtaaaatggaaatttccacttctgtgcagttgggagggctttttgtagaagctttatttgacaatgatttttctgttgcttaggtcatttgaggggaaaaacattattttaaagtttaacgttatttctaattgtcttaggaactatcaacatacatggaaatagaaattatctgtgtattgatttgtgtgtaatacacttatgctgagtttttcctgagtttttgatccatagatagataggaatctggtgggagttggaaatatgggcaaaaaatggtgggagggccaggtgcggtggctcacgcctgtaatcccagcactttgggaggctgaggcaggtggatcacctgaggtctggagttcaagaccagctgaccaacatggtgaaaccccgtcactaccaaaaatacaaaaaattagccgggcatggtggcgcatgcctataatcccagctacttgggaggctgaggtaggagaatcccagctacttgggaggcttgaacctgggagtcggaggttgcagtgagctgagattgcgccatgcactccagcctgggcaaaaatagcaaaactccgtctcaagaaacaaacaaaaaaattgtgggagatgggaatatgtgccaaaatggtgtgacaggagctcagttcatgaatgtacagatacacaaagcttaatggtccacttgagccatctgaggagtgcacttgtgtggttgatgacacatttctggactcctaaatattagtttatgcttattgaacttttgacctagaggattattatggaatggaatcacatgatgagcagtttggaccaacttcagagcaattctaaatctctgagttgcttgtttgctttcgggttgggtgtatttccttcaattttgtcttagaaggtttttagcttggtagcctgccatcttctcaaaatattcccagttagctcatctttgtaaccaaatggaataaacggtttctatatgattctcatgctgtaagacaatgtcattgatagtgtgtagccaagtaatggtgaagccaataagaatattcaaaatatggagcaactggtactggttgtggatgactgataagttcgtactagtacatagtgtctgatgttagcccctgctgtggctaagaaggcctgggacacatatgcataggaataaaacagatgtggcatattaaagactgggtaagaacgggtaagaaaggcatgggaaggtaccttttagcattggcctcactcagatacagtttgcattctctacattcataggactcttatcattgaaataatccactggtatctgcagattgattttccagtaggagtgatggtcagtgtgacctaccaaatatcctcacatctggtctgcaagggctttattaatcactagtgaaattatgaccatggtctgtgactataggactgtattgggggaaggtgagtcacaattcgacagcaacagtctttacttgttctatacacataagaaaagtactcattgaagagtatgttttcctcattctgaactcaaataaacactttgttattattgaatgtacgtcacttatcacctttagtattatttgagagttataggtatatatatcttgtggcctctaaataattgtaaaatcctgagggcaaagtagttaattcattcaataaatatttattaagcaccgagtatgtgtcaagcacctactgtgtgttatagacactgaatacaaatgaattagacaatgagacactttgaactgatgacactttgaatcgaattgatgaaaggatgatggggaattgttcagctgaagaggggtgggaagggtcttctacaaaggtcaagaggtcagcataagcacaggtatggccatgggaaatgacttggctgattaggaaataaaaagcaagttggtaaccgagaaatataacatgatcagttgggtcaagaagtgagacgagaatgataacagtgtttatcacttaaattgtcattttagtgttgctattcagtgagggagattttgtcataactcctgggatgctactggcatctagtggttagaggtcaggctgctgataaacatcctgcaatgcacaggatggcccctcacaacaaagaactctctggtccaaagtgtcattagtgccaaggtcgagactcccttcttcggatctttttacatttggattgcatcattcaggtcttaactcaaaagttccttctttagcagcttccttactcaccccctattgtcatataaaaatttgcctctccttctctgtcactctctattacaaaacaatgttttttgtctttataccttttgataccatctaatgttatattatgcatttgtttatttttattatctgtctctcctcttttaaaatataagcaccacaaggtctttgattggttcactgctgtatctctagagcttagaatagtgtgaggcacattggaaaatgcatggaaaagttcaatatatgggtgttctgagtggaagaatgtggtaagttggacatagactctgagttcctggaataatcacagtagttaacattcatttttaccattgatactaggccctgttccaagcattttgcatgtattaactcaatccccaaaacaacctcagggggtaggtatctgattatttccattctacatatgaaccaactgagaaagagagttattttcccaagatgtacatctagcaaggggcagtgttcaagaggtaaattgcccaaggtgatcttgtgtgtttattcacacatgctttttgtggctattagtctgagaatgctatggggagttgggggttaagtgacttgggaattggatttgaggggtttcaaacaatgcatccaaaacatagatggacgggaaatataatgaactaaatgttggtcatatcgcactcaagggacctgtgagccatcaaggtgaaggctaacatgaaaaggattctctcattcaagagaatggtttcagatgaagtgtggaatttgtaatgggaactgaaatcaggagagcagacttgattatttagggacaggttgatgatgggaacagacccagggaacaccctgacatcacaaatatataagggcctataatataatataaaagggtacccataatgaaaatagaaagagcagtagagtcacatttcaagttctgctttgggcacaagcttctatctaaagtctcttttctcccttgtagaactaatcttttctctctctgttctacctacagtattttatattttcaatgtattaagtgacataagagaggtgttagataatagctagtactacgagtgtcacctaagcccgtaaacttccacaggcctacatcttcatctttgttcatatccatgtccctagcgtgaacatccatagctgacatctagtagtctttcaatattaataaatagatgatgttgaatatgtgaattagaaaatgtttattgggagaataaatgtatcatttcattagaaaatttgtttgtaacccacatcaaaagaagaagaagaaatgtgtagatcagtgaacttttctgttgttttttctatttcaaaatacactcaacccccgacttcttaggcaagccatttagctaatttctgaaagggagcagctaatccagcaccaaagcctgtgcagaagctgggccagcaactcaaataagatgattttctgagaatgaccagccatgttggcttcacatatggaagacgagtttctgaattctccctcctctcgggtggcacatggtgtcttctctttctagctgctccaggacgaaggaggggggatgaatttttaaaagattcaggggaaggaattcaggttctagaaatatccaagaaaagtaataataaaaccagtaattctacttttatgagccaaaggtcaatattatttagtttttttttttattttttcctgggaagaaaaaagagagctgatcttttgggtaattattgatatttccatgttttcagcaggattcaagttagccaaggagaagcataatctttcattatccaaactggagatgtcttgagtaatccagtggcaggaattgctgctgaaggagtgtattttcttttagttcatctgcctttttgacctaaaaccagcgtaccatttttttgttttaaaatatacgtgatatacatacatggtttgtctacctctggaatatttataggctcatattcctttctatacttgttctctagcgggggtgcttataacatttaataatacttacagagtctgtttcttagtctcatttcaaacctcaatgtttgtgccaggttgtttggagcagctcaagtctctgaggttattttcccaagatgtatatctagcaaggggcagtgttcaagaggtataatacccaaggtgatcttgtgtatttattcacacatgccctttgtggctactagtctgagaatgctatggggagtgggggattaggggccttgggaattggatttgaggggtttcaaacaatgcaccccaaaacatagatgggtgggaaaaataatgaactaaatgttggtcatttagtccattattagcctcagagaagctagaagctcttaaaatattcaagagtatgagagattcaacccttcgaagagaagaggagttgatgatggaatttgaatcgttttttggcatttctttactttataagaacacatgacggtgttccattccagtgcagaggagctgttcttaactcttaaatggagagccctgctgttagagaaaaggcttcgtgaaggctcctgtgtgtggggtcatcctactctccgggtggcttcctcctcccattcctcaccttcatccatcactgtacttgcacatccatcctttcattctgctctggagatcctttggaaagggagaatagaaaggacaaaccattgatcgatagaggcagtaaagctgtcctttggggtttcacaatatgtcctgtactatttttgtgtttagcaaaaatccattttgcctcattatgagcctgttttcccttgggctttcacttctgagattatttcaagggaaattatgtctatatattagtctcatttgcccacatctcactcaataactattagcgttattagatatcctgaaccaggaagctgcattttgccagcactaaatgcagcttgaaattcaaagattcaatttggagaaaaatcactacatttgagtgggttaaaatcttgccaaaaatgcatttttccatctgtctcatggcaaaagctcttttaagatttgaaatttatagctaaggacttccagtcatctttgcaaagtggtctggaactagagaatatgataagactggaggtacttgggagcattcctctgaggtggaggaaggagttgacatcagtttctttctgttttaagtttattgaatggtggacatcctcagtatcaaatgctgtgaagtcagcaccagcacactcaacacccaagggggtggttcacaaagtgcatccatagccctgccacgcccagtgtgacatgactgaaagtgatgatcatggtcactttcattctttcttcctgacctgaatctgcctgggaatatgaacattgggttcatccttactgacctactctaatacatacaaagaaggctgtcagcttgccaaacccaaacaagaaatcagaggccaagtcaggagttggttttcagcctcttcactgatgtgacccaggagaagtgatgctcccgagagtgactgtctgcactttgtcttagcagtgctgatgagaccagtgagcactagcaccatcaccagtgagaactgtacctggtccccctaagtctgttcctgtgtgggtggaccctgcctcttagggttgttcctggtctatttactttctttaaacagaggaactcccttccttctggttgcatatcaacttgtgtctctggcatactttctcagggtcattgtttggggctctgctctgttgacttcttgaccatttctgctgttctcgcaactgatgctttctgtacttcggtgcattgtgcagcaatgatttgagaggttcagtcttctctcttacacatataagacatcctgtattgttattgcctcaaatatgactatatacctaattagtatcacacaaaggcgcaacatagcttagtgagtagaacacaggctttaaaagtcaaccttcttgggactaaatatttaccactttccaggtctgtggagtcaggcaagtgatttaaaatctcttggcctcaatatccttctttgtaaaatagagatattagtatagtctgtcacatagggttattgtgagtgatgattaaatgaattaatatatggaaagggcttggaatactgccatttatgcattaagatatcaaattttagttacagtgatgatgctaggggctcagcataaggacctcaaaattgcgcctgaaagggcagggtttctttatcagtcatcctgccttggcaccttactgtcctctaagactctagggaaatataaaacaaaactaattaagaggttgagtgtaagctttgctacagttaaatgcctcccgtctttataggatatagaacctagatgatgatgatgatgatagtcaacatttattgagcaattaccatgtaccaggcctgtcctaagccaaatatgtaatcatatttattcctcataaaaaccatatgatgagaagcttatctctgttttttagttgaggaaactgcaactcaaagacttggagctagatttacacccaggtctaactatgaataatcattatgaactttctcctttacactagactggttctcctcaaaacaggaagcccgagggaatggaaagtgaagggcatctccctgggatctagtcctttgagatgttggactttgagcaagctacgcaacttccccaaagttcagaattttaatctgtaaactaagataacagctatttcacaggttgttgtgagggagacaaaacaagctaaaatatataacaaagcaggcaaagatgtatacttcaagagtcactacctacctaggctggggcaattagaaattctaaatatatgtacataagtatttagcaaagttatatacttcaagagtcactacctacctaggctggggcaattagaaattctaaatatatgtacataagtatttagcacagatgataaaggatgggcaattcattctgagattaggctgtagttcttcttcagtatggaatcagagctcaattatctttaaccattgtgatttggggaatagttttggtcctaattgggtgtacatgatgcctttgtcttcagaagtctgatcaatcaggggatgctgcaccacaacccttatactacgttttagtgtttctcaatgtcaagagacttctgtaacagatttcagttctttctgatggctttgaaaaatgctagtaattctctgtctttctaatggagtattttgtgtttgttgtctcctgaggtcagaaaattactttggggaagttgacttttgtgagctgtgagtatggtgtgtgtgtgtgtgtgtgtgtgtgtgtgtgtgtgtgagagagagagagagagagagggagagagagagagagagaaagagagacagacagagagaattaaatctgtattgttagttcttggttagaatagagcttaatggatcttcccatttgtgaaaaccccataactcttcctgtgtaatatcattaaagagcctcctgacagcagtaggtaaggagtagctctggggtgttactttttaatcactttaagcccattttcgtgtgttattacagaaccatccctcttctttatcactgcatcttccaatagcacaccattgctccaggaccagaattcagcaacaattttagtttttctgttgacaataaatatgttagcctgactgatcaaggctgatgcatgagcttgatctttgggattatttccattctacatctgagtacatacgtagaatgtactacataagatagagccagttctgccaactgtctgtggttgtcataggtatgcttcatcaaatattctggcgcatggtaggtgtacttcctggctttgtatatttgagtggggccacctaaccagttctggacaatatgttgtgattggaagtgatgtgtatcacttgtgggatggaatgtttatttgccacaaataaataactaaaaaaaaaacttctccagggatctcttttccttctgccacagttacatcttcttaattgtcagcctgggtccagaaagccccagccaattctttatagacaggcagtgctagatagacataaactgctgttattttaacaagtgagatatgtcttgtgttcctacagtataacctacttcatctcgactaacacaatgatccatagtcagggacatgtgctttttggtgagcagtcaaggtgtggccttgatgtcccttgttttctctgctttgcctttactgtgaagtctgtctagcagtctgagaaaatttaagaccctaataatagatgtcttggggcaatgaaacttagtacctttcatagtttcgttttcttttccttaatttttttttctgtatttccttgtaccagccattaatgttttgcctgtcacatagcagccactcaataagtgagtgatgaatgaatttgtacagaaatccattgattggtagggaacaattagcattagcattatagaagtgttttgattctccctgaacttattgttgtcaattactcttttactcaattcaaccctaagtcatactattttctatttccagggctgccctgatgagaggtagctttggcctatcaataggtgcattggcctctctgagacagcagcacaggggacctcagccttctactgcctacactcagcaaacagaaatatatgaggctcttggctgtgaaagcagaagaacctcttactcctgcaccattttatggccaaggccgtagcaaactgctgactccagagaattttttcacctttttttttaacttatgtggatttttttttttccaactgggttttgcgctgttgctcaggctagagtgcagtggtgcgatcatggctcactgcagcctcgacctcctcagctcaagttatcctctcacctcagcctcttgagtagctggaaccacaggcacacatcctcatgcctggctaatttttgtattttttatagagacagggttttgccatgttgcccaggctggtcttgaactgagcttaagcaatctgccttccttggcgtccaagaatgctgggattacaggcatgagccacagcacctggcttgtagttttaactaaactaaaacttctctggccctggagaatttccctttctctaaacttacgcatatcaggacatgcctaaagtgtctattttatgataaagtgatgagaaggaaagagacaagggttaggacagcccgagactgcaggctgatacctggtggcaaaatactagtctcttaaacactaggcacatatcctgcccaattagagatctccctggaatcaattccttctctccattcctcctgtcattgcttcagatcaggctttcaaatctgttgattacactattaaattagaactgtgcccgagacatcaatgagtatgagctattattatctttattattgctattctgtagcctcctgttcccgtctccagtttttcttcatttcaatccatactgtgtatcttttaaaaatagatcagattctgtcatttccctgtttataaagctctcttgcctccactgcctagaggataaagccctaaagtctgagctcattgtacctcttcagccatgttctcactcatgttagctgtatctgaatcatcaaggaagcttgtcaaactctctgtgccccaattcttttctccaagagattctgggaagcttttgggtgatagggaagggagatatgacacattcctgggggggtgtggagtttgagaaagctcccccagtgattctgaggccacttcttccttacttagccatccccacgtccacagctagaacctctaatgttgccatgtgtaatgttggttccagccacgccaggcttctggagttccttagtctcaccatgatctttgacatcctcatggtttgcaggtgtattctcatcactctttatgttcttcttcctttttctgctcgggtctctcccatggttttttaatatttcatttaaatgttagttcttaggcctttcctgatattcccagatgactgtctgtctcctctcatggcatgttgcattgacctacattattatccttgttatattgcagcctcattatttgtgcctgctactgcctggacagtgggggctaggggaggcaggtgcctggttctgtaatcttctgccagatttgaaccgagtttggtgcatagcaggcacttaatgagaagcacactttatgaggcagcactgtgtgatggttgagtctgggctttggagtcttccctcttggggaccttgtgacaagtaaatgaaatactgtaaacaaggcacttagcctagtgtctggctcttaataaatgcacaataaatggcacctaccatttttttgaaataaatattttatgattaagtctgtatttataagattaataagtctctcatttatatactaatttccaggatgcatagatttttcatccagatagtttatataccagcaaaatgggaaataacaacacctgacttttttactggaaaaatattggttgctgtggagattatctactacgttgtccttactctcaaagagattacagttaaaacacaccaatatcaacatgaacaactgggaaatagcaatgagccaatcacagcagagatcttaattggcttcataacaaagtgtggtctgtaagccaatgggaatgaaaggagaatcaataaatcccaagagacgagagttgcctttttgggggacacagtcatacacacacctatattcgctctggaggaaaaatggtggcaagagggtgtatgacttgatgagtgggggagacatggtcaaggggacaggcaggcaggtgagagtctgggctgactctgggttggtcctagtgttagggccatgccactcaaagtgtgtttatggacagtagcagcagcagcggcacctgggagcctgctggaaatgcagactctcaggctggccccattattttttccagtttctagtttcagggcttgcctgatgggagacagccttggcctatcaatagctgcagtggcttctctgaaagagcagcacagagaacacggatggactataatctgcattttaacagggtccccagatgatttgtgagcacgtgaaagtttgagaagtgctggcccagggatgtgcagtgacttggatgggccctatttagcgctctcctgtgagctgctggaacaaaatagagggtacttaaaagcatatgcacttccactgtaggcttaaaactgcagaaacgaggtagctcgtgcataaatgtaataattctttgttccaaatgtacctagatgtcattatgacaaaacataaaatccatttggaactgttactgattcctagcagctttttgccattagacattttccaggcatccaaacctaaaataacatggatcttgggtgaaggtttttgaaatgccttatattaaaaagtccttgtatttgaaaaccagtaaagaagtatttgggaaccattatgcgttctttcagtactgcatatgcagaatattttgggtcttcacagatagacttgtgacgcaaaaataaaataaactatctcgtaatcacacagaacagatcactgacatatatggcaagctgttgcagtgacccaggattaaaagtttagcatagttcttaaatgtgtgcctcatactgcatcagctccttatttcgagggctcatagtggatgaagcaattacctggatggccctgtttcttgccctttccctggtcttctgccacgtaggttggtggtgatggttgggaaatgggggtggcaaaagtgtcctttatggattttatacagttcttattccactttttggtgggtcactggcctggttgctgtcatgcatggtggggaggtgggcagatgagaagcccagctctattgccaatcttagtcctgagcatagatgcagaggttcaggccgggtgcggtggctcatgcctgtaatcccagcactttgggaggccgaggcgggcagatcacgaagtcaggagatcgagaccatcctggctaacacggtgaaaccccatctctattaaaaatacaaaaaattagccgggcgtgttggcaggtgcctgtactcccaggtactcaggaggatgaggcaggagaatggcgtgaacccaggaggcggagcttgcagtgagccaagatcgcaccactgcacttcagcctgggtgacagagcaagactctgtctcagaaaaaaaaaagaagcaaaggttcagtttctgatattttgtttccaatcatgtggcattgacactggaatcagctagacctgcattcaaatcctgactccatcacttaagctgttgtgtaactttgggctggttacctcactaacctctctcagacctctctcagtttcttcatttgcaaagtggggaataacaacacctgatttagatgcaacgcaagttgcaagtcattcagcatttactcatgatcagtgagagtcactgatatctccgtttttctcgtttcccctgccttctaaagccatcaggtggggaccttcatctaccaaacagacgctaaagaaggatgggcacggtgagtggaaaaaggaggttgaagagttgtttttgctcccaagtgtttcataatgaatgaggttaagaagagaaaataaaataccctgtccccttgctcttatctggctcaaatacagcctgtattatttagcgtcaaagaaattatcttctcatgctttgttcagaccactccaactcatggccacagttctgacactggcttagccttggctgacctgtatgaagtcaaataagttccttcacctttcttaacctcagtttctttatcttgaaaatgagagcatgaacctttgtgatctctaaggtatttccaattattcagttctaagagattatgcccatctgagaacaagtggaattaatgttatgaagggtgccttcaaaggagaaatgcttgagatgggagcaagaatagatgcaaatcatgcctgtttttgagctcgggaaagctttcatatggcagggttttatattcatctgcctggttgcatgcttatgcactgcccttgtttggccttgaagaacatggttttttccattgtttctggtggagataatcacaatgactatgtcacgtctgcttgggaaaccaaccacggctgctgatctttggatccttgtctgggaagctctcaagccagtagtagtttgcctcaaccattcaggggtagctcctctctggccaggaccttgttatgccttccctgcagacagcgtaagggatggtaggcattctttctccattcgctccctcgccagaatcagcactggtgattgtcaggcaggtaaggagaacactgtcatgctcaatggagatgtcagactaatgtgagtcagctctagcttccctcaagcacagctggaagacaaagaaacagatttactggagatgtgcacaaactagtgcctattatgttaaaaaacataaataaaacgagggagaaggcatacagagagaaattatcttttaaaaacatcttggcaaaatagcactcaatacacatcagtacaatagtggagtcatccatgtgtgtcaacctgtagttcttaatgacagggatgtataaacaagtaggtaataagcagcccagctgcttctggggtttctcttaacttactttctttgaaaatgagttggtggaaatacagctgaaaacacagactcagaaaatgaatgagtcatttgagttgaacataaaaaaggagacctggatgaggatttagagagaagatccattcaactccgtaagcctacaaagtaagattagactaaatagatagaaattttattctactcccaaaggataaacatcattttccatttctttttgtagacaggcaaagctctgccgtgaatcatggttttaatgcagacttctttacagaaaaagaaatatatccatttcctttcctttcctgtgcccatccaagcttgttatcgagaggagtgcctctgtaccctctgtcagctagaatcaatgttaaacactgagcacacaaacaccaaaaacgtttacatctttttatttttcttcaaagacttcaaaactgccttgcctttgttcttacagataatttttaatagctggtctagttgtatttatgttaaatgggggcacaggggtcaaagagacttattaaaaggacggaatgagtgaaggacttctcttctgacgaatgaacagggcatcgagccaataattaaatcttattgaagcagagaaaactagcctatatttatatgcctagaatgttctgagtgctttcttgtaggatctcttttcaataattgtaaagtggtaattttcttcattttcctgaagagaaaactgatgctcagagaggctaaataactgcacaagctcacatatccagtagagagggggaagagatggaagtccaaagtcaatgccacactgcttcctatttaacaatatcaaactcaggcatcaagctcctgctctatgccaggcatttgctgggtactggagatgtgaagagagaatggtctaagcgcttactgttgagtgcttcccaaagcatgtgctcagtgtttgctggttgtcacttactctcacaaaggagctccctcagtctagcctcagagaagataattgtgcaaagtgggcatgcttgttagcttatattttcagaaaatgaaaaacgcatgcccggactatttacctcacgaatctaagatgatatagtgagcgggtgttagggatgggacctgggccaaatccaaataggttatgcatttagccttcaaatccttgctgtgttccaatgtccgtttaaagcttgttaaattctccaggatatttgatacacacttacttaatatgtttcatttgcagaaatggttgtattttaattgaagctcctggaagtgaaactgcgcttttgtaagaaattcttaagtaagtggaggaaaacattgtgctcaggaaaagttttccagagacttcaaaatgacatgaaatgttaaggccgtgtccagtcaagatgcctgtatataaatgtgaaaggtgcattgtcttagtagacatcataaagaaaaatagcatcaaaaagaaagaaaatatcatacagctaaacaggtgatctaaataatatacataacttagaaaatgtgaaatcagtggataggattcatatgaggatctttttaacatgtttcctatatcagaatcaaaaatacagttccagtcacattactttcttgtttgaaaacattttttggctctttgttactgacctgtaatttgtctaaactgtatactggaatgtaaggcctctgaagagtgatcacagccccctttttcaaacttacctccatcttctctacaacccagcaaaactggtctcctcactgtgtcctgaatttccttgttttgtctcacctgcgttttctctcagcttgcacccctccatcccttctctccaaatgtagaaacctttaatcgctcacttgcttctccaggatgcatttatggatctttccttaatgcaagcgacctgccctggcctttcctctggattcccttttgtagtgttaatatttgcatagtgattcttattttgctttgctttgtattcattatttttagtgcttgtcttattttacctcctaaactataattttcttgagagtttttctcatctaatttttttgtctttgtagcatttggcatagtgcttcatgaattgtattaatgaacatcagtaggtattagttaaataaaattcaattaaataaaggccagagtaagatgtgcagttggaacagccaggtgttagattttctctgactcagagatgaacagcttcccagcaagggaagaagttcgaggagagaggccggtaggagaggaagccacttctataatttggcactaataagaaatttactctggaaaatctcagtttttcacaaaccatctttcacttttctcatgatggagaatatccctttattagtcaggaccttctgcaaattaatgggcaagtctcatgtcctcataaagccataaccctatttatgacattacaattggttacttagtgataattataatgtcacaaatagaggattattatgatttgaggtgcaaaacagctgtaacaaagaaagtcagcaataagtggacatgatgtagtaaatttgcagctggaaaagaataattcccagaaagatattaaaaatcattttaatagtttttggggaacaggtggttttaggttacatggatacattcttgagtagcgatttctgagattttggtgcacctgtcacccaagcagtgtacactgtacacaatgtgtagtcttttatccctcatccacctcccacccttccctctgagtccccaaagttcatatattatccttatgtctttgcctcctcatagcttagcttccacttagagaacatacagtatttggttttccaatcctgagttacttcacatagaataatggcctccagctccatccgggttgctgcaaatgccattgtttcattcctttttgtggctgagtagtattccatgctgtaattataccacattttctttatccactcattggttgatgggcatttaggcccattttatatttttgcaattgccaattgtgctgctatgaacacgtgtgtgctcgtgtcttccaaaaatgcatttttttgcataaagttttccactgagtgatggggcaggggggcacatgctaaagttgaagcttttgccaaggagagagagctgagggctgcaattcttttggaggatgcttttcccagccacaaacccatattgatttcttccagaacatttactaatcctctctccccagctctcacccccagtgggtgcaagcctgtgcatataaacacactcccttgtttcccattcaggatatggaatcttatacatcataaaagagactgatctccatcctgattcataggactgtcagcagatggcagagagagtgataatgccacttactatcaggtcactccgaattattatttattctgtggagagtgagactgaggactgaaacctgatgtttaatttttcaaaatcacatggttagaaactggagggtcccaagctttctggtcctacatctaatgaactaatgcttttgttgtttatttttgcactatactttatagctatgtaatgatgtaaaggacacagttgttttatgaaatccatttccccttgctccttccttttgaaaccttgatcttttttttctctttctagtagctaatgagattcaggaaagccgatcccatttccaactccagggagcaagaaagtataatatttgaccttccagcctcttagcatcagctggtacttccttcttttctcttcctgagccatgagtcatgcttcatcaaaagtttcccaggctcctgaagtgaaaatgacaaatcagtgcataagagtgataggaagagaagtacaagattgtattagacagtatagaacaaaacactttgcagaatgaaaaattgcagagtgctgacacttgttctacagaaagggcatcagcacttagatcactgttgaacaacattcattttgggatgaatattgtctaaggtgaggctgaaattctttgcttcaaattctacaaaattcttattctacagaatggtggattatttagctaccaaactttactgagtatatagttattgaggatcaactgggagatgcataattgggcatcatgagcattggatggagcattgggtgggggcagaaaatgttaaggtcatacttgaaatatcaaagtgcacaacctaggaatagacttcaatatcaacaagatttgactcagctgaatctctgttttgccagtcttttctaggtctagttttatacctgttaaacatgaacattaaaacatttcactctgtgttagtcagttcttgcattgctgtaaagaaaacctgagactaggtaatttgtaaaaaaagatgtttaatgggctcatggttctgtagcctgtacagaaagcatagccctggcatctgcttctggtgaggcctgaggaagcttccaatcatggcggaaatcgaagagggagcaggtgtctcacatggcaggagaaggagcaaaactgagagttggggggaggtagcacacagttttaaacaaccagatctcttgagaactcactcactatcctgaggacagcaccaagccatgagggatctgcccccatgacccaaacgcctcccaccaggccccacctccaacactggggattacatttcaacaggatatttgggtggggacaaacatccaaaccatattacactccttgcctgtaaccagtgagaacccatttggctggtatatcactccagtttgttctaaggatgtagtaggtatttgccaattctgttgagcaacaatctcaactccaaccttgccatattctataggggggaaattggaatccccaaatctcttgggtacctgagatttctcattctccttaaaaggtcctggttgtcctaaagcaaccatgcctcctatccctgccacccctggtatttgcttcctgttttatttctaacagttgtctagagagaaccgtactgaaaaactgaatcaggtgatttctaatgccattaaatacttaaagttagcatagaactaatcattatagaagaagatttcaaaagcttcaaatacatggttcataatctcattgaattaaaaagctggctaaagattcaaaatggacgcacctaatgggacagcaaacaatatctaagttgtatgggagatgttgtaattaatctctcatttaatcatcctttcattcaagcattcctttgattggtagatgaggctggctggcttacatcagaagcagattttgatcagttttccttaggaaagcatgtgattgacttcttaaccaatccagcccaaaatggatgaaccataatatcaaaataatcacttttaaaagagtaaattctaggcagaataactgttctcagtatgttcttatgaggagttggactggttttgttaataatgacattatgagatacaatttatataccataaaattcatccttttaaagtgtacacttttgtatattttagtgtgttcacagagtttgactatcatcactactttcttggcaatcttttaatcatcctcagaagaaattgtgtacccattaatagtcacttccccgttccccacagtccctggcaaacactaatctactttctatctgtatattggcctattctgggcatttcaaataagtggaattatgcaaatgtaagtttttgtgactgtcttctttcatttaacataataatttcaaggttcatctatgttatcggatgtatcaggccttccttccttgtaattgctggatattattcaattgtatgaatataccagtactgtgttgaatagaagtgatgaaagaagacatcttttttgccttatctaagagagaaaacattcagtcttttactattaagtgtgatgttggcagtgagtttttttaaaaaaatagatgtcctttattaggttgaggacgttcccttatattcctagttttgttgagtggtttttaatcatggacagatgttgggtttttacaaaaatgctatttctatgtctattgagatgatcatgtgggtttggtcacttagtctattaatatggtatattatattgattgattttactgtgctaaactaaccttgcactcctagggtaaaatctccttgatcataggtataatcctttttatatgttgctgggttgggtttgataatattttgttgaggatttttgcattgatgtatttaaaagagtctggacacagtggctcatgcctgtaatcacagcactttgggaggctgaagtgggtggattgcttgagctcaggagttcaagactagcctgagcaacatgataaaataccctctctacaaaaaatacaaaaattagctaggcgtgatggtgcacacctgtggccagctactcaggaggctgaggtgggaagatcacaggagcccaggaagttgaggctgtagtgagccatgattgtgccactgcactccagcctgggtgatggactgagatcctaactcaaaaataaaaaataaaaataaaaaaagcagatatcggcctgctcttttcttttttgcgatgctttggttgggttttaagatcatgataatactggccacgtagagtaggttgaaaggttttccttcctctttcagttctcacaagattttatgaatgattggtatgaattctttaaatgattggtagaattccccagtggagccctctgggtctgggctttccattgtgagaacttttaaaattactaattcagtctctttggttattataggtctcttcacattttctgtttttttctttagtcagtctcagtagtttatgtctttataggaatttttaaatttaatctaggtcatctaattagttggcatatagttgtttatagtattcccttatatttcagtaagatcagtactgatgttcccccatttagtaatttgagtcttccttctttttttcttggtcagcttagctgagtttttcaattttatttattacacttttcaaagaatcaacttttgattttgctgattttctctattgtttaagtcctctctatttcatttatttaggctctaagttttattattttcttccttctgtttgcttttggtttagtttttcttcttctagtttcttaaggtgtgaggatatattatttgcttgaaatctttctttatattttttctccattctttcattactgtcttcttttgtgttaaacatctatttcctaatgtatcattttaattatctcttccacctatttttgagttactttattactgcttttttctgaggattacatttgaaatcctaaaacaatgtagttcaggttaatatcaacttaattttaatagttttcaaaaacttagttcatatacagctctgtttccttctcttttgtgtaattattgtcatatcaatgacctctttacacattataactatatcaacattatcttataattattggtttatgctgtttccatttaaatctgatagaagaattataaacaaaacttattaatactgtccttcatatttacctatgtggttacctttattggtggtctttatttctccatggatactcaagttactgtaaagtgttccttcattttagcagaagggttctttttagtatttcttgtaggatggatcttcttatgatgggttctctcagtgtttgattatctgggaatgtcttaatttctcataaaatttgaagaatagttttgctagatttggtcttcttgctgacagtccctttctaccagccttttaaatatgtcattccttctgactctggcttccatgttttaggataagtcagctgttagtgttattgaagattgctggcatattatttttctcttgctgatctcaagattctgtctgattcggtttttgacagtttaactatattaaatgtataggtatgaatttctgagtttatcctacttggaattcattgtgcttcttagatgtatagactaatactttttattatttaggatattttcagactttattttgtcaaatacactctctgtccctttctttcttttctctccttctggaactctccttgcatgtatgttggtatgctggctcatgtcccacaagtctctgaggctttgtttattttccttcattcttttctgtttctcaaactggatgatctcaattgccttatttccaagtttgttaattctttcttctgtccgcatagttgtgctgttgacctccttcagtgaatttttcatttacgttattgcactttcgaactctagaatttctatttggctcttttttaaatgatttctatttctgttgaaattgtctatttggtgagacatcattctcatattttcctttaactctctaggcaagatgtactttagttctttgaacatacgtaaagcttttttttttttaaatggagttttgctctgtcacccaggctggagtgcagtggtgcaatcttggctcactgcaatctccatctcctgggttcaagtgattctcctgcctcagcctcctgagtagctgggattacaggcatccaccaccatgcccagctaattttttgtatcttttagtagagatggggttttgccatgttgatcaggctggtcttgaactcttgacctcaggtgacccacccgccttggcctcccaaagtgctgggattacaggcgtgagccaccatgcctggccttaaagctttttatttaaaactttgtgtaaccccaatatctaggctttctcagaggcagtttctgttggctgtttttccttcatgtgtatggaccatgctttcctattttactatgtatcttattttttgttgttgttgaaaactggactgttaaagtaatataatagagcatccttggaaatcatatccttactttttgtttttgttgccattactagtagtagtagtagttgttgatgctgtgtgtttgtatgttttttagtgacttttaaaattctgtaaagtctgtgttctttgttgtgtgcagcatctaaaatctctgcttggttagcttagtggtcagctaataattggacagacatttcctcaaatttattcaaccaataactttcccactacttttttgtgatctatatgtgtgagttagagtatgcaataaatactttggtaacttgataactctaccttagcctttacttcctgctttgtcagccaaaagtgagagattggggtcttctcagatccttcctgggaatactcacagcttgcgcatatgcatggctttccagattcccaagaatatgtcagaactttccaaagctcccgtggacttctcatttcccatattttgatttttaagtttttcgatcagcttcttaatttgccgcaacagatagggccacctcaggcagctatgatattaaacaattcctgattcttttggaaaaatcccctgggtacagggatttcctcactgagtaatagctgacttaggtcaaatgaggataattccatgtgaatgagaatttcccagggagcttccaaacaagtacaatagtgataattctctgaggatgggccttttgtggcggatccaaacctattctgctctctccaatagctactaggccactggttttcacagctaccatctttctaaagctgctggttttcaagggtactgcagagatagggaaagggagatgggaataggaatagggtaggtttaagtatcacagagctcactgttctgtagaataagccatttttatttcaaccttttggttaatttttagaattctgaaaatgttgattttgacaatttttgcaactgctctcatactttcagggagcatcattctgtctggagtgcttctttttcctaggtggttttcatatcaggactgacttcttttgagacacaaatatcagactaggaagttgttttgtgagtacagaatcagaaaaagggaaatagatgtgttaaaaaggacgtagctggacgatgaagtctgatgcttgtctcctctttaggaagattgatatctgtgtctccaaggggaatggtatatctaatatttctgtgaacaataaccaccactaaatatttatcttaagtcttgagatcatgaaatgaggatgttggtggtatttgctgctgataaaacctgagtagatatctgtctcaacttagaaacctgataaagccagcagaacacaactgaggcagtaaagctttgggattgactggggactcttgagatacacttgctatccacttgctacttgaagtatggttcaaagagtgcagcatcagcatcacctgagaacttgtcagaaatgtagaatttcaggtcccactccagactttagtaagttagaatcttcatttcaacaaggtgatttatgcacacattaaagtttgataaatacatgcctgtagcatgtttacatcttcatgtggttgtcctgggaggattcctgcaatttgctagcttcatctatttaatgttcatttgtatcaacttaaatttcagaagtatctgctcctaaagtcttggagaatattaatctttgtacagtcttgtccttcttgtaactctttatggtaagaataaatagttgagcttcaagaatatcagagagggagaaaatctgtgcaggctggaatggtccaaaaggcattatttgagttaggctttgaggaaaggatggggagaaagtgaatgcgtgtcatgcagatgaaagaacatgggccaacctacagaggtgggaattatttattatgtgcagtagaggtctaaactgtaacatttttggggacatgcattatgtcttgcttatatatgtatcctcagtgactggatttcatagatgctctataaattattttcaaactgaatagtaggaagattagtttaactcaaggtgagggtttatataagaattatgggaattgatgcaaatttattagcatatggctagatgatggtgactttgaaaacttggtaggagtttgtatttaaatttgttgggtaatcttcagtaagttacgtgggaatggaaggggactaatttgtgattattagaaaattattaacagattaaataactttattcaaactccagaaaataaagtccttcaaaatcttcttggctcttccagatatgtggatctttgaatgagaacatattgtaggaatcacattaaggagaaaaaaagttgaagaaatatggtaaacattagtagcccattttaatgttttatataagttcttaagcaggggaatgacatgtgaaaatggtgtttgtaagagattaaaatgtaggccgggtgcagtggctcaagcctgtaatcccagcaccttggccaggtgaggccaaggcgggtggatcacctgaggtcaggagttcaagaccagcctggccaacatggtgaaaccctgtttctactaaaaatacaaaaattagccgggcatggtggtgtgtgcctgtgatcccagctactcaggaggctgaggcaggagactcgcttgaacccgggaggtggaggttgcagtgagctgagatcataccactgcactccagcctgggcgacagagtgagactccgtctcaaaaaaaaaaacaaaaaaaaggcagcaaaatgctagatggattggaaggggaagagaatgggtcaggtagactaactagggctttttttcgttatctagagatgaaggcagatggacagagaccaaggtaatgtcaggacagaggaacgaacgttgctccttgaagtccctagtattacaaagtagagacatctaattaagcagtttagcttttacacaaaaagaaaaaagaaaagaggaaagagataaactatctgatgcaatagcaataatagcaactattctttaccatcctcataagacaatggtgagaattaaatgagtgaatgcttgtaagttgctgtattaatctgttttacattgctgtaggaatacctgagactgggtaatttaaaatgaaaagaagtttatttggttcacggttctgcaggccatgcaagcatggcaccagcctctgctaggcttctggtgaggccctcagggagcttttactcatggcagaagcaaagggagatcagacatgtcacatggtgaaagagggagatgccaagttcctttaaacaaccagctcccatgtgaactaatagagtgagaagtaactcatcaccaaggggatggcaccaagccattcatgagggatccagcaccatgacccaaacacctcctgccaggccccatctccaacaatgtggatcacatttcaacatgagatttggaaggaacaaatatccaaaccatactagttgcctagaaaaatgcctggcacatggcaagcactcataaatgttagtgataagctattgttaactggaagaaagaacctcctggtgctatcgagtagcacttctgtttctcaaaatcagcacccaacacagtgcttatttgtaatagatgcttaatagatgcttaatgaatggatgaaggggaaataaaatatctctcaatgtaggaatgaaatatgttgattatagggtcacattttgctgttgatttctattatacatataatcccccaatggaggattgggggaaagtagttattgatttctcatattctgttctccaaactaactttatctctatctcattctctttctctctttgtccacacccatcctaagggatttccatctctatgcttgtgattcttggaagccggctccccctgtctgtgtttcatagcacaggtgctcagtcgacatttgtgttcattgctaaaccaatatattctagacctatggctcatgcctcagagcagtgctctcagggaaaaagacactctcttttctctgctgtatttaattcagtccttttcaatagtttatcctttctgaatggccactgagatgtttgatacagccaacttaatgagttgtggctaaactgctttattttatgtggctgaaatgtattcaactgcgcatgtgtacataagacttaatctctagacatttcatgataatttgacagcataattgaagtgagggggaaaggattgagtggtttgtttcacttacatttcttcacccacccctaaaataaaatattctctgaagcaaatgtcaggaacttcttccaccactgtcaccatgtgacaatgagttagggaatggaattaaattcgttatctagcgtctctttccaaagagctaaaaggtttttttgttcattaccagagcatctctccaacagaatagagaccttcccatatacagctgcagctgagtttcacacttaagaaatcttataggatcttataaattttaagggacatagctctacctgaaaaagtctgtagaaacctgaggtccagctcttctgattgccttgggtccttttatttaaagttggcttgccttttgtaatgaaacaagccttttctttagtgtttaataccaatgaatcttttggagaagatatgctagaaagattttgagcaggggtagagaatcttcctatgtcaggaccactgacccaccaaaataatcaggcacatttaagaaaggacaacctttaggtcacttgcaaaagaatgcaaacccattaaataagtattcttctagttcatattatggccagctgaggaagatgagagaagagatataggaggagaaatagagtggataagaaggaaagagagaaaaacaggagaggtagacacatacacacagaaatcaagagggatagagaggaggaggtttgtgagtactgaggtgagagttactgagatgtggtgcttgtcacatgccattgctcacttgggctggtttccttgctaatgagttgcttaagccttgctcacagctccttctacagcagtttttcaggtgaaaaaaattatcctttggactgtagcaacactgaccccagtggtgcctctctgagagaacagagaaaattaagccaagtgctgaaggttgcctaatcctttgaggggaatgcaactaacattaattgaattcttattctgtaggaagtgctttatagaggttatctaatttaatcttcaacaaatctaacaacaggcactgttatacccattttccaggtgataatacagtcattaagtgctttgtcaggtaacaccaccagttagcagggagagaatgggattcatgcaccagccatcttctgagtcctgctctttctgtttcaccagccgcatccacgtctctttctagagcttaaagaaatttcagaaaatcatccaagtttgcaaattggtagaaattgctccacgcctcagactgataataatttgctttattgattagtgcgtcattgggccccatgccaggcatctgagctttttatctatttaaagtagagcagcagccagttggttggaagtattgtacctacccttctttgacagatggctttctatttggcttttgaaattccataagaaagaatttcacagtttctcacagtagcttattgcagtcatatccagagtcagtcttcggatcatgaatacattgatcccttttctctggctttgaatgcagcatactgtcataggcctgggcgaaagagtggttccagtgtgtgtgtgtgtgtgtgtgtgtgtgtgtgtgtgtgtgttggtaatacacaatctgtaacatagtcaaagaagaaataaagagtcggcaaactatggcccatggaccagatctcgctggctgtttttgtaaataaagttttactggaatacagccatgcttattcatttatgtattatctgtggctacttttgtgctacagtgacagagtggagtagttgtgactgagattgtgtggtcttcaaaggctaaaatatttattttcttgttcttttctgaagaagtgtgcaatccttgctatagattaacatatcaactagagaattcttgaaaagaacagagcatgaatatagcaaaactatggtgttacctaggtaatagtactatgaggatctactacagataatattttccaagtgccccttgttgtgtttgggggaatacaaagaggaggttctcttacttgtatgttgaaataactccttagaataaggttggagaatttctgataggaatgttgcttgtgtatcaaaatacagaattgcgcttctccgttctgactgtggttcttgtccaggcaagtttggaaattgtgactccttgaaaccattcaggcagccaagtgttccagctgatgttttgtgtgtttttttttcctccttcatttaaaaatacactttgtagaatgttttctttttcacggctccctaaatattctgttttgaaacatttaattacccaggttatttatatggaaaggtttgataatgtttctatgggagtctgttatttatttcttttgctaaatcttatcttatattaggggaagggctgaggttggttactatggcaacattctcaaaactgcaacaatcccattacggatgctaaaactatagtcatttcagtgggagggtagcatggggagtgggtggtagtctttttatttttattttattttttttaaaaaaacctctcccacttccaaatcttttgcattcatttattttaagctttgcagcttagggtactaaaatgagaaacaaaaagtaaaaaagagtgtcatgtctctctccattaaatttctgtagtcctttatcagctccctttgtggggatacccagttttctacctactcttttattcatttatgctttcagttattccccaaactttcattgagacctgtgttatgggtgaataagagaatccttgttcttgtttctccttttaaattataaattctttgaagccattaattcacttcactgtaattcatttaaacaaatacttattgagcaatttgctttgtatcaagaatcatacttgcataagaagacaaaaaagaaaaaagggattctgttgaagattaacattttgttttgttgggcagcacagggaagggcacatagtgaagcacagagatgattgaaataaaatttgataaatgcttacacaggggcacttaatccacttaactccccagcctagaaagcatagaaatgactgcagggaggtgacatttgggttaccagataggcattttctggttagggcctagatgtgtgtgtgtatggcagggggatggaggtgtgtgtgtgtgtgtatgtgtgtgtgtgtgtgtgtgtgtgtgtgtatttatgggtttgggtatgcagggcattccaaccaatctagaccaacaagaatagagatatacaggcgaggagtccttggccatgagcaggagaatttagaaaacacatggatgattggtagaagaacagtctggagacgtagccatcaagagaagtcatgtctgggaggttggatttcgacattgggaaccattgaaaagttcagaaggaggagcaattgagtgttccagtttagaagtggaagacagtgaagggaagggaagggggaagatgggattgggaagagatatggagacttgtaaaaatggcaagattcaccttgggacatgatgagttttaaatgaaccccatcaagttggaccgtccagtaggcagctggaaatgtggctccagaactgacaagaagtgtggatgggacccagagatctggatatgatcagagaaggctttgaaggaggaacaggaacctcaagagaaattacacattatcgtatccctaatatgctgtctcacttttagtaaaatattaagtatttctaaaaagatttttaagtgttgatgtgaccaaaatatttttataattttttattttttatttcaataggtttttagggaacaggtggtgtttggttacatgaataagttctttaggggtgatttctgagattttggtgcaccatcacttgagcagtgtacactgtacccaatgtgtagtcttttttcccttgctacccctgacagtttcccctgagttcccagagtccaatgtgtcattcttatgcttttgtgtcctcatagcataatagtgtccagtttcatccaggttgctgcaaatgccattatttcattccttttcatggctgagtagtattccgtctgtatatacaccaaattttctttatccactcattgattgatgggcatttgggctggttccatatttttgctattgcaagttgtgccgcttaaacatgtgtgtgcaagtatctttttcatataatgacttcctctgagtagatacctagtagtgggattgctggatcaaatggtagatctatttttagttctttaaggaatctccacactgttttccatagtggaactatgtactagtttacattccaccaacagtgtaaaaatgttttcattgcatccatgccaacatctattactttatggttttttgcttatgggcattcttgcaggagtaaggtcgtatcaaaatgcaattttgatttgcatttccctgataattagtgatgctgagcatttttcctgtgcttgttggtcatttgtatatcttttcttgagaattgtctatgcctgtccttagcccactttttgatgggatttttttttcttgctgatttgtttgcgttctttgtagattctggatattagtcatttgtcagatgtatagattgtgaatattttttaccactctgtgggttgtctgttaattctgctaattatttcttttgctgtgcagaaggtttttagtttaagtgctatctatttatctttgttttagttgcatttgcttttgggttcttggtcatgaagtctttggctaagccaatgtctagaagggtttttccaatgttgtcttctataatctttatggtttcaggtcttagatttaagtatttgacctatcttgagttgatttttgtataaggtgagagatgaggatcaagtttcattctgctacatgtgacttgccaattatcccagcaccatttgttgaatagggtgtcctctcccctctttatgttgttgtttgttttgttgaagatcagttggctgtaagtatttggctttatttctgggttctctattctgctccactggtctatgtgctgatttttataccagtaccacgctgttttcctaactgtggccttatagtatagtttagagttgagtaatgtgatgcctccagattttttttttttttctttgcttagtcttgctttggctatgcaggctcttttttggttccatatgaattttaggattgttttttctagttctgtgaagaatgatggtggtattttgatgggaattgcattaaatttgtggattttttttggcagtgtggtcattttcacaatattgattctacccactcatgagcatgggatgtgtttccatttgctgtggcatctatgatttctttcagcagtgttttgtagttttccttgtagaggtctttcacctccttggttaggtatattcctaagcatttcatttttttgcagctattacgaaagggattgagttcttgatttgattctcaacttggtcactgttggtgtatagcagagctactgatttgtgtacattaattttgtatcctgaaacattgctgaattcatttaccagttctaggagctttctggataactctagggttttctaggtatacaatgatatcatcagcacacagcaacagtttgacttcctctttaccaatttggatgccctttatttctttctcttgcctgattgctctagccaggacttctagtactgtgtttaatacaagtggtgaaagtgggcattcttgttttgttccagttctcagggggaatgctttcaacttttccccattcagcataatgtaggtggtgggtttgtcttggatggcttttattcccttaagttatgtcccttctatgccgattttgctgagggttttaatcataaagtgatgctggattttgtcaaatgctttttctgcatctattgagatgatcatgtgatttttgttttcaattctgttagtggtgtatcacacttactgactcatatatgttaaaccatccctgcatccctggtatgaaacacacttgatcatgtggattatctttttgatatgctcttggcttcagttcactagtattttgttggggatttttgcatctgtgttgatcaagggtattggtctgtagttttctgtttttttaatgtccttccctggttttggtattagggtgatactggcttcataaaatgatttagggaggattccttctttgtctatcttgcggaatagtgtcaataggattggtactaattttctttacatgtctgatagaattcagctgtgaatttgtctggtcctggacttttttttttgttggcaatttttacattactatttcaatcacgctgcttgttattggtctgttcagagattctctatcttcctggtttaatctaggagggttgtatattttcaggaatttatcctgaaatttatctcctccaggttttctggtttatgcacgtgaaggtgttcatagtagccttgtatttctgtggtattagttgtaatatctcccattttgtttctaattgagcttatttggatcttctttcttcttttcttggttaatctcactaatggtctatcaattttatttatattttcaaagaaccagctttttgtttaatctatcttttgtattgtttttttgttgttgtttcagtttcatttagttctgctctgatctttgttatttcttttcttctgcttggtttgagtttagattgttcttgtttctccagttccatgaggtgtgaccttagatcgtctatttgtgctctttcagactttttgatacaggcatttaatgctatgaactttcctcttagcactgcttttgctgtatcccagaggttttgataggttgtgtcactattatcattcagttcaaataattttttaatttccatcgtgatttgtttacccagtgatcattcaggaacaagttatttaatttccatgtgcttatatggttttgaggggttcttttggagttgatttacagttttattccactgtggtctgggagggtacttgatataatttctattttcttaaatttactgagacttgttttgtggcctatcatatggtctatcttggagaatgtaccatgtgctgatgaatagaatgtaaagtctatagttgttgggtagaatgttctataaatatctgttaagttcatttgttatagggtatagtttaagtccattgtttctttgttcattttcgatcttgatgacctgtctagtgctgtcagtggagtattaaagtcccccactattattatattgccatctatctcatttcttaggtctagtagtaattgttttataaatttgggagctccagtgttaggtgcatacgtatttaaaattgtgatattttcctgttggacttgtctttttatcattctataatgtccctctttgtcttttttagctgctgttgctttaaagtttgttttgcctgatataagaattgctactactgctggattttagtgtccagttgcatggaatatctttttctacccctttgccttaaatttatctgagtccttatgtgtcaggtgagtttcctgaagacagcagaaacttggttggtgaattctttatccattctgccattctgtatcttttaagtggaacatttaggccatttacattcaatgtcagtattgagatgtgaaatactattctattcatcatgctatttgttgcctgaataccttgtgttttttacactgtgttattgttatataggtactgtgaggtttatgatttaagaaggttctattttgaggatttgtttcaagatttagagcttcttttagcagttcttgtaatgctgacttgggagtggcaaattctctcagcatttgtttgtctggaaaagactgtatctatccctcatttatgaagcttagtttcactggatacaaaattcttggctggtaactgttttgcttaaggaggctaaaaatagaatcccagtcccttctagtttatatggtttctgctaagaaatctgctgttaatctgataggtttttctgtataggttacctgctgcttttgcctcacagctcttaagactctttcctttgtctggactttggataacctgacaactatgtgcctaggcaatgatcttttcacaatgaatttcccaggtgttctttgagctgcttttatttggatgtctagatctctagcaaggccaggaagttttcctccattattccctcagatatgttttccaaacttttagatttctcttcttcttcaggaacaccaattattcttggttttggacatttaacatagtctcaaacttcttggaggctttgttcattttttaaaattcttttttctttgtctttgacagattgggttaatttgaaagccttgtctttgagctttgaaattcttccttctgtttgtttgattctattgctgagactttctagtgcattttgcatttctgtgtgtccttgatttccagaagttgtgatggtttcttatttatgcagtctatttcactgaagaactttcctttcatatcctgtatcacgtttttgatttgtttaagttggactacacctttctctggtgcctccttgattagcttaatagtcggccttctgaattctttttttgtcaattcagagatttcatcttggtttggatccattgctcatgagctggtatgatttttcagggtgttaataatcttgttttgtcatattaccagaattgtttttctggtttcttctcatttgggtagactatgtcagaggaaagatctgggcttcaagcgctgctgtttagattcatttgtcccacggggtgctcccttgatgtggtgttctcccctttcgcctaggaatgggacttcctgagagccgaactatagtgattgttttgctagccacccagtggagctacagagctctgagctggtactggagagtgtctgcaatgagtcctgtgatgtgatccatcttcaggtctttcagctgtggttaccagcacctgctccggtggaagtgacaggggagtaaagtggactctgtgagggtccttggttgtttttgtttagtgcactggttttgtgttggttggcctccagccaggaggtggtgctttcaagagtgcatcagctgcggtcctatagggaggatgcaaaccttccccagggatacctggttagtattcaggtttctcaggtggtggacggggccatagagctcccaagagattatgacctttgtctttggctaccaggctaggtagagaaagaccactaggtgagggcagggctaggcgtgtcttagctcagcctctccttgggcagggctccctgtggctgctgtgggggatgggggtgtggttcccaggccaatggagttatgttcccagggggattttggctgcctctgctgagtcatacaggttgtcagggatgtgggggaaagcggggagtcacaggcctcacccatcgtccacacagcctgcagtcctaatggccggtctcactctcatcatgcccccacgacagcaccgagtctatttccaggcagccagtgaccagggctgagaacttgtcccagaccatgagccttcccattgagaaagcaagcagactcacagttttttggtgtctcaaggagtctgcagaggtgatctagttcgttacttgaaagggtctgtggattttctcagcttttctggtatgttcctacagtagttcttggagcaaaagttcatggtgtgagtctccacatgctgctctgtctgtctgagcaggagctgcaagctattcctgcctcctatccaccatcttaattgacagtggtaaccaaaatgtttagagccattttgacagattgaggaatcactgctatgattaaaatgtagcacttgagatgaccatgctcaactcgtaggatgccatcatcaaacagctttgccttctccctccatttattctttaaacctgcacagtgggacatgtccttccctggcaattccggtcactcttaggcaattaaaaaacaaaacaaaacaaaacattcaggttaaaaacaccagataattcagtacctgaaacgtccagcattatgtactagcaaaaacactggagttgatttagaattgagctttcttccctcctccaacaggggcctgccccagccctgcagtcatggaaggagagtggtcagcttccctctttctcctcagtattccttcaccccttttcttctctaggctagcctcagtctcagaccccattaaattgggttgagagagaggaggaggaaggaaatataagggaaacagtaaagtgcttacttaactgctgatgaattgttagtctagtttcagtgctttctgaatctagcagatatgtaagtttacttctctgtggagttcttttgtgtattctttgcccaaaaagaacataccctccccccattgctaagggtctcatatctgtagttctctgagacaaaaacaatgcgttgctactgggctacacctttcccgacccttaggctcctggccacacctccagctaatttctgctatgccttttgagtagtacctgaacagtcctgatatggctgtctcagatgcacagcccacaccttgttcatggaagacactcaaataccctttgcttctgcaaactctgggagtgcaaccacctctcctagatccaccaacaaaacagccagcaagcctagatgctatcatgtctgatgtcagatgtggttcagacacaaatctatttgttccccaaactgcacagactgctgaggacagatgtgaagccctctgtctgcctttttaaagtccctctttcttgacatgaggtgaagcggcaagccccactaaccactggctctccttgattgaagggttgtggactctcaacacatcaatagcttccttgaacaatccctccaaaactgtccaattcttgatccttttaaggaattatgagttttataaacagtttatagcaccttttttggtaaattttgcaaaacgtctagctcttttaaaaaaattatttcttgatgcttgaaagaaaatattcactgaaacatcatgttatgtgagcatcatttttctacccccatttagaaaaaagcatttctgactagttgcagaaggaattttgttacatggatatagaattggctgcatctagggatagattgaatggatgacaaagtgaaaccacgctttctttatgaaggttgtattttcaccttccttgtagacacccttccttttccagggtgcccttagataaacagctgtgcatcttacaggaattgcttacaatgatagatttcccctaagctcatgactgccaaatttgtctttgtagcccagacctctttctgagatgcagatccatatatctgatagcttactctacttctctgatcaaagtattacaagtttagctcacatcatcattactctaaataccattcctcattctgaatatctatttgccttcatgtaatttatctttagtcttaagaaatggtacttagaaacccttagttgtttaaatcagaaagttgggagtcatcaacagattcttaagttcttgtcaaccatgccactttagcaatctggtgatgtctctgaccgcctttcaaaacagtgtttgtaagaatacaggactactatggaaaccaatgatatggaaacacagttctgttatgaatgacttggaattcatgaattgttttccttctcatctctcacattgattcagtatatcattcacagatcatctcctgaatagcagtcagactcattttattttctctatcttcactgatgctttcttacttcactccttcatcatctctcactgaatgactgaagtttcatttaaaaaacaacttatactgataaatttcaaatatagacaaaggacacaaaataatataatgtaccccatgttgctgttacctagttttacattcccactccccactctattataatgacgaatttatagactttattttaagtaaaacttataaactgtcttagtctgttttgtgcagctgtaacagaataccacagactgggtaattcttttgtcaaacgtctgttcaagtttttatttttgactatttttaattgtttaaaaatgtttattagtagttgcaggagttaaaaaaatctggatacaaatcgattatcagattcatggttggtaaatatgtttttccaatctgaagcatacttattaattttcttaatgtaatttttataagcaaaaacttttaatttttaaaaatgatattatgttctatgtccttctgagaaatctttacttatctgcaagtcatgaagatcttcttctgttttcttctaaaaattttatgtgttagctttcacacttaggtctatgtatgattcatcttgaattaatttttatgcttgctataagatagaggttgaggttcattctttttttttccatatgaacatctagctgttccagcataatttgttgaaattattgcttgctttattgaatttctttggtggctttttcaaaaatcaattgactatagacttgtactatttctggactctctattctgttctgttaatctatttttctatctttatgccaataacaccctgtaggtttaaagtaaatttcaagtcatgtggtatgaattctctatcttttttctgttttcaagattaatgtattctggatcctttacatttccaaataaattttagaattaacatgtcaatttttattttcagaagacctgctggagttatgattgggatttcattgacttagaagattaacctgtatgtatagtttattttttagccagtgatttgggagagagatttatttgcagattttagggatcactgcctttgtgacttctctctatttaacatattccccctaactttctgcagttttgccttcccctaagttatctgatactttgatcaagtaaggaaactgaggctttctgcaaccccagctatgtgcaaattgggagtgctaacagtcaaatatttgcaaacttgcaaatttcattcattgcagtttgtcttttaatgggggtctctgctccagattttgcctaaccatgttcactttgtagtgcctttgagtagtttttttttttaattgtccagatctaaaaattgttatctgtggaacaattgttctgacctagctactttgctattaacagaagacagagcacctccttcttgcctcctctttcatctccctgtaacacacctgcccattgtcccctaagtaatctttcaaaaaagcaaacccaagcaaaccattttctggttgaaagcccatcaatgactcttcattgctttctctctgctttcttatcttccttttttagattcctcctcacttatcctatgcactctctggctttattgaaccatttggcatttcctagacacacccttcccttaaaagtctccccttcttgggcttatatcatgatcctgactaaaatgcctctatgttctttgtagccgggctaactcctagttcttcaaaagtcagctcgaagtaccaactcattggtgaaaacttctgggcgttattgaaagtgggctactcatactttcatattttcctaatgtttttgttatgttttagtatcacaaaactcatcaacttatatttaattgtttaatcacttattacactgtgagctgtgtacgccttggtagggtccatgtcttacctgtgattgccaatcgcctagtattcttgttgaggaaataagggaaggtgaacggactgaatagccacatgatggttgcattttaggtgtatttatgacgaaattttaggtatctggtcattcccaaatattttccctttgtcttctcactcatggcactgaatatttaaataccaatatgcgattaacaaggtaaagttagaaccacagaaatgcctcagttatccagaggaaagctttccaggagcctcagaaaatgaaccagatgaagacttaaaaatctatgtatataaatagaagaattctttaaagagaataaaagacattgatgagtcgaaagcagtgacatagtaaataactaaagagccaatgatgccaatatttcatctgttgagatatgacttaaagttttatgaacacaaaggaaaaggctgattctgatttcaaaaattaagcagctcttgaagctttaattggcgtggctacagtatgacacagaggaacactgagggagctagaccatagccgtcgctgctgtgagacacagggagccagaatcctttcacattttcctggacatgtcaacctttctttgtttcttttttgactgctacataatcatataggcattgcatactttttatggagattctttcttggtggaatcccagttttaattactgtttccatgtaagttattgttggtgagcagacaatgccttttccactttttaaaataatgccatagaattccatattactaccatgcatatatactaaagtttctcccgcctcatcctttttttaacagattggtgggggtctcactctgtcgcctgggctgaagctcagtggcatgatcataattcactgcagcctcaaactcctgggcttaagcaatcatctgctctagcctcctggttagctaggactacaggcatgtgccaccatgcccagctaattaaaaaaaatttttttttttggtagaaacagggtcttgctgtgtttcccaggctggtcttgaactcttggcctcaagcatttcttttgcctcagcctcccaaactgctgggattataggcatcagctatcctgcctggtctttttaaaaggccttttcttacaattgattattatctcattactcctccttttctcatgtatttttcgtctcttctccagtccatttttgctttgagcctctcccacatacacctgccccctcaaatatctgtcatttatcacaaaggctttctcatactgtcatgctttaagacactgataatccacttcttccattaagttgccctgtaccaatcatagatgatcgattgcgtggttatatgaaatagataatacaaaatgaaaaatgaacgtttcttctttaagtacaccttcctcagatacacctcttcccctaccctcagaggtaaccacacttaaccattttctgtgttgtgtaatccttctatattttttctaagcatctatgaataaacacacacacgtaaagtaagatgatggtcaaaatgtttaaccactgcatggtaatataaaacttagcacttaaaaatatgttctattctctaggcagaccaaactatatataattgcctaccaggtgatctatgttagaggttaaatcattcatcaaactattccaataattttcaaagcatttattgatttttaatgggtataatcttttgtttgatgcagctgtcggtagttaagtgatgtccctgtatcaaccatgatttgaaacagggaaacacatcaatctattccaatgattcactcattgcataatactgccacttgcttctttcatttaagaatatacttttagctgggcgtggtggctcacgcctgtaatcttagcactttgggaggccaaggcaggtggatcacctaaggtcaggagtttgagaccagcctgaccaacatggagaaaccccatccctactaaaaatacaaaattagctaagcatggtggcacatgcttataatcccagctactcgggaggctgaagcaggagaatcgcttgaacccaggaggcggaggttgcagtgagccgagatcacaccattgcactccagcctgggcaaaaagggcgaaaaactctgccaaaaaaagaaaaaaaaaagaatatacttttgacatctttccctgtgagactataataaatctactttattgtatctaatgataggatagtatcccataatatggatataagtttatctatcgagttccctactgtttaaatgtttccagtgttttgctattacacgtaatgttgctaaaacattctcttacatctttgtctgcttcggtgcatacttttgtaagatagacttatagacgaggaattgttggttcaaagtagatgtgccaatcaagaatttgcccacttataagtaactacacacatcttgtgtgcacatgcaccgacatacatattatcacctgaaaatataaacccagatgcaaacacaggtgagcactaaattaattctaaaattcatttgaggatttggcaccatgaagttgcatagccacataccctcaggtagacaagacaggggaatggcagaggtaccttggtagaaagtgaaggagaagaagaaaggttggtggtccagagaagtcagtatttccttgcctggaatgagtgcctgcctatcgaattttgataaaacttcttgattgtcatccttgtttcattacggtcctcccaggaatattttgcttttttctaagctttaaagatcatagcttcgtgacttaatctttggactggatttccccacttatatgagaagaactaataatgccacatggagcacaccttttcaggactcaaggagtctaaaaaaaagaaaagaaaaatgagtcagaacttctgcctgtgagtctgagtcagcttagtgtgttaaaaaaaataataataaaaaaagaaaagaaaaaaaaaaccgtgtgaggagacctgcctggaaaaactgctgaatggaaagacttgagaacagcttatagatattgacggcagatgaagaattttcatgtcttttcagaaatggttagcagccactcataacagtcctgtgacgtcacagaaatcttgactcctgcttgtctttctcgttctcctttaagcccttccctcctccttttcatataggaccttaacacaagagggtcaggaagagaagagaagggttgctcacaggaggaaagaaggcaaggggtagctgttactttacctggtgggccatgtgtcgctacaaatcaggtggtctctttggaggagatgccacttggtaagggaggcttcctgagcactcgaatactactagcaactcagaatgtgggaccgctggaaggaaaaacacccctggatggggcgaaggttgagttcaattttattttttactctgtgtgtgtgtagggggagggtaatgggaaatgtgtgttttgcagacacattaacataaggagaatagcggatgcgactttattatcctcattcacgtaaaggtggacatttaaatttttttttacagtagggaaaaagaaccttctgagttgatttggtatagtggaaattgcatggaaatgtttagcttcctctgttttcacaaacatgtaaccttctaagaaaatctctctttgacctatttcaaagtttgatttttttttttaaaacagttgggaaaataggagctaacatgaattgccccttttccaacagtgaaaatgtttgtaatgtaccttttcatgttgctctaattatgaccataacttcttttttattcaatcctgaatctgttatattttaaaattatataaaattataaaacactggccaaaattagtcacccaggaaatagtataagggacccagttaagaaagtaagtgtaagtgactgaaaaagtttggtgccttctcattgaggcagacttgcttatttgtttgttaacctcagaagtattaccatacatactgtctatggatttagatacatgatttttctcaccttctagacatccaccttgttgtgatagaaggagcatggatttagagtcaggcagccttggatctgaatcactttactacttctgtggcccttagcaggctatatagcttctgtgagcctcagtttcctcatccataaaatgaaaataatgtctacaggttagtattgtaacaagggatcactcagattaactttggaaaagctttctgctattaagcatttggaaaacatgagtttctattttttttttgtattttggttatcattattggcttggttttctttctaggccttggattctccttcactttatgtagaatatgatcttcttgtagtagatagatgtgagtcctgccaacagaatttttctgaattggcttcttgtcttttctttaccaatagctgcctattcagttcagctgcctgatcaacatcttgtctctcaattcctgtgtgccctcacagatctattaaagcatcctgagaagagggtccctcagagtcaccaggtttcagggctccagcttttcctggggatcagaataccccttcagaggccaacactctaaggcagtaatgtgtttctctggccaaacgcctgatagtatcttcttggcaagttcattatttattcccctttactggtgtgagggttttcccaaagtgtcatgtctttgcagagtttttcctacccttccgtgctatacgtgtggtaccattttatgcatttgtttttgctaatatgaaataaatcccattataaataattccaagggattttgcagatgattgtactgttcagaataagaggagtgttccgtgaatcatggagctgctttggtacacagtttgtagaagtaaaatgtggtataatgtaattgacccatgggtcccttcttgtacagagtgtcacttgctgagaagtaagcaaaaaagggagtgcattcctgcatctggcaattcacccccatcctgcaagagtaactcatagagcagcagcttattccattgtgacactgactcacccttcctctctccacccccattgtctagtgctgatgtgttctgtccccactaattctagggtcacactgacttatgccttcatcatcctaagtggagaagaaagcttgtctgtgttgatgaaagtatgaaaatagaaatgccataacttttaatgcaaacaatatatgtttgttgaatgtatgaatacaacaacttggaataactgctgacagtgtttccaaatattttgggtctatttaagtaaagagacatgaataatttgaaactggcattctttttcttcttctttttttttgaattagcaatacatgtgatgaaaccttaaaaacaaattctcatagttacgaatggttgcctttagtgagcaggatggggaacagatctgggggcttaggtcattcattataaaccattctgcaagctttcttttttctaaccagatgtgtgtattactttaatgtttttttgatacctcccttaagtaggcccagtccagtttaagtgcaatctcttgagtgccttgtgtcagacactgtgccggtcacccagggctccagggtgaatcacgaatagctctcacatgtgaattcacagtctagttggggagacagaacagaccaaaagcagataatatttaaataacatgatgctggctaagagagaggtagccatggagttaagtatcttcctctccattttattcagccttttgttttaaaattctacctttatgatgtatttcaacagagttctgtgtcatgattttggatttagtggaaaaagaacagaggagattttcttgttaccttaattttcccaacatggaagatttgggaatgaagaaggacactgcaaagagtgaggcctaaaatggaaaccagtcatgatttttattttgctactttctttacggacacgaatgcacacagtgtagagcagccttaactctgaattggaacaaggtcgtgtaagtgccaggacgttatttccagaagcccacagctgctgattcctacacccagtgatttccactgccttttcatgattctggaattcccaagaacagtgtcatcttattagaaggtatttcccagttcgagttggagacaaaccaaccttccctcacaggctgagtccttctggtttcactgccaaagcttccagactcacccagggtctgttagacatatttgaatgaatctgtcagattgttcagtcgttaatgaggtcacactttccatgaagaccatagtggcgtcattttgtgtaccaacaattgtatcaagtcatgatgattttttaaatatcattgaaataatcattaaaatattattgagataaagatgcatgtttattggtatctatttattcctttctcttgtttaagagagaatttacttagatgtgtacaaaactgctttctggcatacttaattttatgggtttctgatttccacatcactgaaagtatctggaatacctatgatgcaatgtgaatcttgtttccactaactagtaagtaaatgctttgttcgagatttaagaaagttggcctggcacggtggctcacacctgtagtcccagcactttgggaggctgaagcgggtggatcacctgaggtccggagtttgagaccagcctggccaacatggcgaaaccccatctctactaaaaatacaaaaattagctgggcatggtggcacgcacctgtgatcctagctactcaggaggctgaggcaggagaatcgcttgaacccgggaggtggaggttgcagtgaactgagattgcaccactgcactccagcttaagtgacagaggtgagatgccatctcaaaaaaaataaataaaaataaataaagaatgaatataattgcaaagataaaacgtaaacccagattgggaataagaagcagaattataccaaaatggaagctgacgattacacagattcactccttatttactcattcaaagcttgcctcacataccataggtaaagtgggtaactctttctgatttttttggttcacttcaagactatatgatcttgaaattttaaataaataagctaaaaaggccctaaaatattttattaaaacccactgagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaacccactgagtataatttattgatttttataaaactaattctttttttttctgttttacttataagttttgggatatgtgtgtagaatgcgtaggtttgttacataggtatacatgtgccatggtggtttgctgcacctatcaacccgtcatctaggttttaagcccctcatgcattaggtatttgtcctaatgctctccctcccctgcctcccacccccagacaggccctgatgtgtgttgttcccctccctgtgtccatgtgttctcattgtttcactcccgcttatgagagagaacatgcagtgtttggttttctgttcctgtgttagtttgctgagaatgatggcttccagcttcatccatgtccctgcaaaggacatttcatttttatggctgcatagtattccatggtgtatatgtgccacattttctttatccagtctatcactgatgggcatttgggtaggttctaagtctttgctattgtaaatagtgctgcggtaaacatacatacgcatgtgtctttatagaacaatgatttataatcctttgggtatatacccagtaatgggattgctgggtccaatggtatttctggttctagatccttgaggaatcgccacactggcttccacaatggttgaactaatttatactcccaccaacagtgtaaaagcgttcccatttctccacagccttgccagcatctattgtttcctgactttttaacaattgccgttctgactggcatgtgatagtatctcattgtggttttgatttgcatttctctagtgatcagtgatgatgagctatttttcatgtttgttggccgcataaatgtcttcttttgagaagtgtctgttcatatcctttgcccactttttgatggggttgtttttttttcttgtaaatttgtttaagttccttgtagattctgcatattagacctttgtcaaatgagtagattgcaaaaattttctcccattcataggttgcctgttcactctgatggtagtttcttttgctgtgcagaagctgtttagtttaattggatctcatttgtcaattttggcttttgttgcaattgcttttggtgataaaactaattcttaattgttatcactcagtgaatggtactagtttgatcttcccttgctgattaatccagttctttccagttcacttgaaacccatttctttgactcagatagctttcactttagttccaaattttcagggacatttggtaccaaactcttcttacagaactttaccctcgaccaccattgctggatctgccacagtcagagttcatctaccgggtctaacacgtctcggcttcttttgcattttctcccgtgtctcccttgggtgtcgcagaagcagcaagagattattatcatgtagtagggctccgtaatcagaatgcgaaatccctatgcataaatgctgtcttttctcagaatttcctgacccactttctattttttgagaagacaaaattgacttttttttctgacttcttcagaaatctcttatagtgactggtattttcatctgctggcacctctgacaatgactattacaacgtgcctcagaatacagagtgctaacacctcatcttctaaaagaaatgcttcctctgtaaaagtgttttctctgatgaagccgccatatagaccattgaataggaactgcagaagactccggaacacaatttgatagccgttcagccaagcggctgcaatttattttgtccctgagtgtgaaggaggcagcccaaagaatgttggctctggaggaggaaggcaaggatatggggaaacaggggccagagaagggcaggatggggcaaagattcagggcaccttatgtaatgaggcacagcgtgattctgcccggggcctgtacgtgcatgcagtcgggttgcctccctttcccctggaaatgtgccctttgcttactttttgtttggttttaaagcagctggaaaggatattttttgctcagaattggtgcttagcttttgcagaagctgcttcttgagagtcgtctcttgtcatccctctgggttttagctcagtgtgacgaagctatttaaaatatgtgtgtttttaaatgattctaaaaatgaagtattcacattgttatgcctcactccctccccactattgagtcctgctcccctgacagcaactttccatttctctagcttatccttctggtatttatttatatctgtgtttctaaatactatgtttatactatgatcatttggtttgccaattgtagacattatctgttaggttggtgcaaaagtaattttggttttgccaagatgatagtattaggtaccgacctaataccatcatctttctatgagatggtaccattttagatgaacatcttgtgtccacttaacatcctcccactttctgtagcttcctcatatatgtagatcaaagttcttggttagactcatgatcagattatttgttttttgtttgtttgtgtttgttttgtagggacagggtcttgctgtgttgcccagtctggtcttggagtcctggcttcaggtgatccttctgcctctcatactggaatattatataatatttttaaaaatagctcacctttattatgtattttctgggtgcaagacactgtcgaagagctttagacatgtattaactaatctttatagcaaccatgtaaagcagatactgttattctttccattttgcagatacggacattgagacctgggttaactaactttccaaagtcatgtaggtagtagctggtggagccagacttcaaaccaaagtaaacgaggctccagagtctacttttaaccactacactttttaaatgattaagattttacaaatactatttatagtggagccacatgtatattattatctcttctccttctcttctcttctcttctccttctccttctcttctcttctcttctcttcctcttcctcctactctactcttctcttctcttctcttctcttctcttctcttctcttctcttctcttctcttctcttcccttctcttctcttttggaactcttattagatggaagttgtatgtcctgaatttatcctctaattttcttacctttatctcttcattacctttgacctacattctgggagattgctttaactttatcttgtaactcttaccaaagagttttttttcccctgtgacactttaaaagcccagtagctgtttcttatttttgttctgttcttttatttttcagttctttcttcctaattgagtactttggccctgtctttcatactggtggctttcctgcaatggcaggagatctgcagccatcaggtcacatacatgaacaaggctctgaagagctgacaggataacttccgtgggtggcccaggctcatctggtagtggcccccccatcaggtcacagacatgaataaggctctgaagagctgacaggacaccttctgtgggtggccccggctcgtctggtagtggccccccactgcagagtggcctaggatcacagatctgttcacttggaggatcctcagatgtcagcatctggaagcttttcccttgggctggccagaatctccataatagaaccacccagacttgttcctggggctgtgcacctgctgcaggtgttgtgggagccaagtttggagtgggaaacagaaagatctcattgtgggtgttgactttcactcaattctctcttttcagactcacgtttacccatgcaccaccctcaccaccctgcaagccctccctatttgagtccctagttcctgaggatccctctttcagtttctctagaaaaagaaattcctcctgtcctgccctgggtgtgctgagtgggaaggagggaataaggaagattctctttgccctggaggaagtccatgacacttccaattcctcctccaattcctcagcttttctgaggggctccgtgcaaattggcttgctttttcttggttttgctctttgagatttgtaactttctttgtgctaataggttagtaataacttgtcaattcactttccatcttccagaagactgttaacatttatttctacctctccatttctctgtgtccttgtggaactttactttttaaaaaaacttaattactttcattatgttggaggttgggaagggagtagagatgaacatcacgttgacacaaccatatttgatggaagtccgattagatcaccattggaaatatttgtttcttagagtttgcttcattttcctgttaggctggaggatcccatgatatttgtctcagaataacgggagggttcacttttcattctgtttgagctttcctggtgtatacctttcttcctttcctcttaggatcgtaagtcctgaacaatcttgttctagctcttttctcctcttatcttcatctgtaaatgaaaggggctgagagctggtttcaggcaggaactagatctgacatttaggaaatctcctgttcaggtagcttctcttggccttttcctttcagtgatattttctgaaaacctgacttgccatactgatttaaatgcctgataccagtgtaaggtatagatgtgacttctcctaggaacatagataaagctttgggggtgaaattgacaatagagtgtgtctcctttctctctttagccagtgggaaggttgggtgacttggggctgcaggattccgggaggcctccgtatcgtatgctgcctgtccttagagtccatccagacctgagggctacttagctgaattgtttagtaaacgacgtgggattcagctgcatcatctctatgaagactctcatgttgacttatcattacaaagggctgatggtggcagtggttctaaaccttgacaagtgaacggtttctgcaggaaggctctttggaagactgtgacatcacagacaagacaaggaatatcattagtgaggtcattttaaaattctcagatcttggacttgctctgggcagtgactttgccagcaagttggaagagggcacaagaagtgtgctcatcaaatttgtggcagacacaaaactggaaaggatggccaatgtaatcgatgacaaaaacaaaaatatgtctcaaaatgatatagatatgctggaatgctgggttaaaaataacacaatgacatttcaaagggataaatgtaaaatcttattttggaataaaaaaatcaacgatacataatggtgggagaaaaaaatctactggcagtagttctggtagagaaagacactgaagttttatttgactaaaagctcagtataagccactaaatctgactgaggcaactaaaaagctgcattaatggaacgttaatgtattgaactcaggaagtaacacccctcttcaatggttggactgcacctggcgcctcatgtttgcccagagaagggcaattagcaggtgcctgagggtctggaagcatgtctcaggagaaaccatggaaggaactgagtatattcagatggaaaagaaaactgtcttctccttattagctgtgaaactttaggcaagttaccctggaagcccctgtagcctcttgggtaaaatgtggaaggagaccatttctctgtggtataggtagggggcagaaagaaggaagtactggaggaagagattggagaggtaggaggtggggatgggattgagaacatattcatagctcagggtaaggcattcacagtttatcctgagctgcaggaaaataatatgggcactgtattatctttcaaaccaggacattcagagtgaaagccaggcttattcaataaaacaggacaaaaggtaccaactagggctgttgcaggtaccctagacaaaccaggaggaaaggccatactgccgaagagcactgtcagtagaggacatctgccttttggggtggtgagtggtctgcctttggaggcatctaagcagggcttgaatgaacttctcttgtggaccagcacaagagaagtcgggtggaaatgaacgaaatgaactttcagatccttattgagtactgctacaagggatgctatgttagagaatatatgaaacaaattaaacaggagccatcctggctctctgcaaattcttttagatgtgtatatttggcaaaaagagggcagaaaaaggaactctgaccctttctcaatgtaaaagttccttctgaaggatgaaattaacttaaaggttcagaatctgttcacctggaacaataattctggtgtgctcaggaagctttttaaaaacacagcttcccagggtgccaccctggacaaagagtcagaggaggggaggggcactttaaggaatatgatctgtcctagggcaacaccgttcacatctagggtgagcatccacctactgcatatttagtaaatattcgtgggctctgggcctagatctgtgatagtgtctgatcaaagtccatgtgggagccatcacttgacacttttaggggcttaaaataaatgttgtgacaatatgcaaacactgaacaaatgccaaagcaggtagacgacctgtcccttatttagcggtctgtttttcaggcctagactaccctatccttactggttagaagtattacagcatgctttgctaattattacaagagactgaaaattgctctatgtggaggttgagaccttattggagacttggagcagacaggcatggcctgaaattctctctggatgaggaaggtgtaaggaaacactggcctgagctacatgagtcaaaactttttagcccagatgaattacattctagatacagagagaagctatagaattactgtttagaatctttggagaatcgtggataataaatgggacaggagctggaaagctgagataggcaaacattttctaagttttcaaaaatgaggatactttggatttcacacactgtagatgagagaatctgacataatttccataaaacattcttgaacaggttatgaaacaagcagtttgggagtcgttggacaggagatgagtgatccctaaatgcaaacactggcccactgagaatgttaagccaaagcagcatgatttctttttaggaaaattaaagttgcaaagccttaaatagagcaaatacagcagatgtggcatatctaggatcctgcgagacatttgaggtgtgtgtcagttcacacccgtagcttcctggacaaggctggtgcatataaactgtataataggacagtcagatagtcagatagcatcattcttgtttgaatggcctctccagtatttcacaggcaggcagacatttgacggtagtcattctgttgcctataaaaatataaaagtgtccagtcctttgcagtccttaccataccacttgagtgaatgagtacctaaccagagagaattctcatgtggactctgtaccttggcccctgatttgaaacttttcatcagcaatttagatgagaataaagagaacatggaaatcaaaatgctaagtgatatgaaattgggagggaaaatgaatactttggatgaggccataaggttttgaacagatatgaatagctggacaatggagctaaagcctactggaatcattctttgtcactcagtccacaatattaaattccctatttgtctggaacaggctaggtgctgagatcaggagatgtgcacgccatagcaaggagagcaggaggcagacgtatcctgtaatactttggtggaggtcagccccggatgctataggagcacacaatgaaccagatctcatgaaagcttgaggtgggtaagggcttggggagagctattgaaccgagcaaggagatcagatatctggagaaggtgatacttgaatggttttgaaaaaaaggagttagctgtgatccatgctggggtgagggtgttccacattcaggcagcaactataatgatgtcataaccaggacctgggtgtgagacaacatggaaaaccaatttgcaatgctcatcaatggcagagaactggaagagagagaggtgttacatatttttctcactttagcgttccctgctgctggagtatagaatgtgagaaagactctagggatactctaaaaaggagcagttgtaacataaagggcatgctcttttatcttagaggccagcattttccaaacttacctgatcattagaatcacttggtccttgttacaaatgttctcaggccactttcttggcaaatctgatttcaggtgtgtcagagtgtttcccaggaatctattaagaagatcgctagttaagtttgggatatactgttatagacatggggaactattggagatttaatatcgggaatgaactggtcacattggcattaaagtgggctgttctggctaccgtatacggaatgatttgagaggggtaaatacatttgacactctaggccagaaataatgagaaataattaagaaaatcagtaatagtagacagctgttggcttgagagagactgaagtggaaccaagtgggtttaattactacctggacttagaaaatgagggatgaggacgaggtgattgacggcaccagttttcaggcttgggcttttaggtggtgccatttattgggatagaatcttgcttcggtcaagttgagtttaggctgcctgtgagacattgaggtggagatatacagtaggcagatgtatgggtctggagtctaggagagaagtctggaggaacatagagatttgtgggcccaccatctactgtggtagttaaagccttgggtataactcagattgcttagtgagaatgtttagttgagaggaacagatggtccagaacaggaatctgtggaccattctatgaaagaaagctaatgaggctttcaaatgggagcccaagggggaaaatacagggaaagaagaagaaagaggagaacatggtgaagagtatcaagaggaagagatcgctgagtgctgctgagggattcaggtaagaaaatagtcattaatgatttctgtgtactttctttgagtgagcactgctgtggttgttttacaaatgttgtcttatttaatcaccacaataaccaggtgaggtagcccctgctatttacgtcaaggaaacatggggaaactgaggcagcagaaagggtaaataacttgaccaaaggcacaaagttgataaatgccagggccaagatttgaacataaatgaaaggatgccgaagtcctgtgtgttgaccaccacaatcacttgttaggaaacacagtggcaaaaaggctacaaagggcttgcagaatttaacaacagggaagttcttcataaccttggctctggcatggtcctgaagcaaaccaccgtgcagtggcttgaaggcaaaacaaagaaacagacagaaaggggagatgactttccaaaaaggtgagttgctggttatcaaagggtaatacgggccaactagggatgtcgttttaagatgggaaattgtgtttcgatgctgagaggaaagagtaggtagagagaaattggtttaagattcaagagaggaaattttggttgaattaagatctctaaggaggcatgggagaacagagtgcagaacagcctaaagggaattgcctggactagagatggaaatgtcgtccctctggactggaaggaaggagggatatgacataaggatgcaagaggaggggaaggattacctctttgaagcaggatgtaaggtcttattctgaggggtggcttgttgggtgaagtggtattagtggacctcagcagacccatctaataactttagccatcagcttctttttgccaaccgaaatggttcctattggacttcccccttctggctctcctctctccctttctcctccatttctggagcctgtgtagaaccttcattttcaatcactgcttgttgctgtcatgagtggtgcttttccattcgggaacagaaaagaaaccctcccgataaaatccagtagactagagtggggtagggggaaggaacagtgattgctgttctttccttttatccctcagggaaagaaggggacgaagatggggcgggagggaagtagtgaaggccacagaggtaggaagaaccaggaggtgggctggagcagagccagcttgtttagcaagcaaagcagataaagattagagtaaccatgacaacaggctactggcaaaggcgctcagcatttggggaggagagagggaggtggaatggcttggctgggtataagcccagagttttggaaaatgccgtttcttcccgcagggctcttggttgttagagaaatcaccatagtcaccaacagtgagtgcaagggaaagaaaggagagggcccgcaggaaagattagtaggtgaggtgggctctgctgattcaaagaaagagggagtgactcctctgtgactggaggcacagaagaggattaggaggattccctgtcgattgcctcaattgcctcagtctatctgtgtgtctcagggtacatatatttttctgtttagctctattttctcactcacgctatggtagcaaaggcgccacaactagtatgcctttttgtttctagtttttcaggataccacattttttacttctggagaatgaggcatgagaatatcaagactctgtttttttttctgaggatgctcaaaatgtgtgtgagggagggagggacgaaaaggaggagagagaaacagagaaagaaagggagaatgagttcatcttggtgtaaactcttcacccagcctaggcctgtaattagttaagaatttcttggaaatctttttcccttgttctattgccacccacttctatagctgcttgagaatctctatcaataagaatgtagaagggctgggcatggtggcttacgcctgtaatcctagcactttgggaggctgaggcgggcagatcacctgaggtcaggagttcgagacgagcctggccaacatggtgaaaccccgtctctactaaaaatacaaaaattagccaggcgtggtggcaggcgcctgtaatcccagctactcgggaggctgaggcaagagaatcgtttgaacctgggaggcggaggttgcagtgagctgagatcgcgccatcgcactccagcctgggggacaagagtgagacttcatctcaaaaaaataaagaaaaaaaaaaaagaatgtagagcagccatagaaaataatgaaattatgtcatttgcagcaaaatggatggagctggaggccattgtctcagtgaactaagataactaagtgaactaagaaatagaaaatcaaatattgtgtgttgtcacttataagtaggcgctaaacagtggatacacatggacataaacatgaaagtaatagacactgagagctccaaaagctgagggagtaggagagggagggggttgaaaaattacctgttgggtacaatgttcactgtttgggtaatgagtatacttgaagcccaatccccaccagtatgccatgtacccatgtaacaagcatgcgcatgtatcccctgcatctaaaataaaatttaaaaaatttaagaagaatatacatacttttaacatctgtgaatatagttgttcctttgtgagtaagcccaaagcgcctatatgggaaaagtaaaaaaatggtatgattacaaacaaatggtgctttaggtttgagtatctatctcctgataacacccagtgtgatcttgcccaaaaaagcaccagcactgttggggaaggacatatcacactcttccttagtctgatacgtcagactgagatatatatatatataattttatttatttattattatttttgagacggagtcttgctctgtcacttagacttgagtgcagtggtgcaaccttggctcactgcaacctctgcttcccaggttcaagtggttctcctacctcagcctcccgagtagctgggattacaggcactcaccatcatgcccggctaatttttatatttttagtagagatggggtttcatcgtgttggccaggctagtctcaaactcctgacctcaagtgatccatccaccttggcttcccaaaatgctgggattacaggtgtaagccaccgcacatggcctctgagatatgtttttaatataaagtgtatcacaagcatggctttgagaggagagtccactcccttccttttctaccagactactacttcgttgcctacagaaatggatgctggagctaccacttgggccaggacctgagtcccagaatgagcccatagctcacccaggggctcatagaaccccactggttccataagtgtgggtgtttcagatatcattgctgagacttctccgttttgattgaggaggaggtagtaaagtggattcatttccatttccaaatctctttccttccaaataagcatgtatagcccaagatattggaaaaagaaggttcttttgcacaaaggaaacttaaaccaggagatacaggacttgagcttggttctaaactgtcataaatagctgtgaaaagagaaaacattaagaagactgatttccccagggtgcagaggggaacaagctctctcaaagttggaaagagtgttacgattctccaatttcgctatatgtcttaaactactttttagagaaatatctacttctgccaggtggatatagttatcttgttcttctcagctacgttctaattcatgaacacatagatttggccagcagtgatgtcaagtgcccagtgccttggggaaccggcttggcattgagattttattggttaagagagagatttcctgaaccaatattgagctgtttgccaggttctggcttgagtaatttttttttctaataggaagtagaggtggagggacaggtgttgagggtcagataatgggtacggttttagacattttgaatatgagccattcccttccagcgggtcaggagaatggtctctgacagggagagaatgttgggactccttaccgtatgggactagctggggcatgaaagtggatgacttctagggaaatcacatggagaggaagaggggctgaacacagaatcccagctgacaccaacggttaagaaatgggaagatgagaagcctgggaaggagagggtgtaggaaaactgggaatgaatcatacacaaaagttagattaagaaagagtggtaaagagaaggaagtggttaccagtgtctgtggctgaagagcaggactgagaaatactaaggggttctgtctccatggggatggtattgctgactctggggagagatttttcctgaagtggggtgggggaagcccgatgacccaggtttaagaagtggatgcagcgttaagtggagcagaacatagtgttggtacccagggcaccagtggtgctttgaaaagtcaggggcggctttcatgcctttattttggagaggattaaaaaaaaaatcctggagaatgtttactgagaaattccagagaagaaacaaatacaaaaaggaaatattaaaaaatataaccaaacagttatataccccaaacacatccaaaatatatggaacccacatggttgagagaagaaggcagataaatatatctggatgagaaattgaaaattaaattgtgggtaggtattagtggtccttgtgtggttaggagagggctttggaatggaagggcaagggaaatgtgttgggcagttagtcttaggaacccagtactaatcaactcttaaatctacacaatgtagtctctgaggcaagttcattttaaaattggaactaattttttttttaaacccacaagtcaaaatacttagtcttttagatcgtagatatggatgaagttaaatagctctttaagaacagcactgcatggaaaataactaggtttactagctaagtttagcatataaagctctttactgaatggcttctttgtcaaccccaggctggaggagttcaattcctttttatttggtgaattccttaattggattttgtttgccgatcttactttctcacattgtaagattttaataaatcattataatcattccctcatgtcttacaaaaataacctttctgacggttcccgaatgactttttttcttctgtgtttgcatcatgggattattagtgtagcttacaaatgaatcagaaaagggctgtgcagctgagggtatatttccattattttctaggtgtgaacttggagcctgataacaaggaacctgtgaggtcacgcttggctgggagggcacagcaggtcttggcatattatctcctgtctggattattgatgagatccactgcttggaaacaggagagagatctcctatctgcttggttattaaagcctctgcaggaaacaggtttattggtgatgtatgtacactggggcttctgttgcattctcagctcagattcttctgtgtctgttactgttgatgactgcataaggaagaacttattttgttcaactgacgtgtttgttgaatgtctggctcaaaatatacctctcctaagaacttccatgactgaccttttgcaaggctgaaggacatgcttggttacccattaggaactggaccaggaacccaagtctttttctttcaattttcagagttttgcagtttgctctttggcttgtggatgccaacacttagagtttatatagtcagtttctgcgatcctgagatgtatttttttttgcaattgcagttggttgtttctcctcctacagtttgtttagcctcttcctcatccattatcctccaggctgtatctgaagtgggcataggaggagtgcccttcccatgacctgcacaatgttcacagcccctttcctgttggtggggcttttggagaagttggggttcccttgggggattggcagttacaagatttttcagatgaggactgtggtttatttggcaattcaatgccctaagagacttaagagcattcaggtcgatttgtttccactttgttccacgtgtgagtgaccaaggcaaagatctcaatctagacctagaagcaatttttaagcctgaaaagctcacttgtctcgattctctgtttctccctcctccctctgcccttaaactaaagtcaaccatcttgaggccatgtgaaaaaataggcttggatggaaaggtgcacccttaatctaatctttgccatggattggccccctcgtttggtggggaactcttcatgggacatgttgaaaaagacctcacatctttatcattttttaattcatgtttcttaccatattgaattggtttttgccacttgtaacaaaaggattcctgatgaatgcctcctgtgtttggagtcttattttattcttcctctctgtagctgcagggtctaatatatacctaatttataatctgtgtaggtgccaattacatatgtaattgtgtgagcatatgtatataaaaacttagaagcagatatgcccctgagagcaaaataaagaataaagttcctaaaacatacagagaaaaagataatgtaggagaaagaaagcagacgttttaaagtatgcgttgtttgagcttttatgcgtctgtcaaacaaccctgaaagttccatcacgtgtgatattttaaattttgctcccaaatggagaaaggcatcttcccacccctctgctgtgagtcaaaccactcaagcagggctgtggctgtcagtgtgaagccagctcttccaaggacccaggggaagctgccatcgctgccgtttctgcctctgcctttctttgctcaaaagttggcaaatgctggtcatgtcgtggatctatttatagtaggcacacgtctacccaccttgttcttttcttagcatcaacttgacatgctatcaattatccatgaggtgaatgacaacacaagggaagttatttgaggcaggtgccctgaggtgagagatgagggggtggcagaggtcgcacagtgacagctccgaatgaaaagggtaaaacaaacgtcccttgctgcatctggctggtgaatgattgcagacaggttggtgggaaaccctgagctggtcacgcagcagtctcccactgcccttcttccctgtgcctgctgatgtttgaaaagcccatttgaaacagacaaggggcaggacctgaagatgtgatctccctccagtggaggtcatttttgttattctcttaagccacaggaggggaggacacaaggacctcctggggacagggggtggatgtggcagaggctgatactcttcctccacgtaggagcatttctggtgggagtgaagcagccaccgggggatgaaaacagggtgccccattcctcactgcctttgaaccagcagggaggctattcctggcagcagcagtgcacctgcccctggcccacagtgcctcccaccttctttacataaccccccatgacccctcttggattctagactaccctgtttttgctcctcctcactgacaacatagttcccagttaggggaactactacttcttcttctcctccccctccacgctcctcctcctcctcctcttttttaatgttgtaatagaaacattgattgcccatttcagtgggactggctaccctggtgtcctttttttatttatatgccattaatttggggctgctctgtaggagctggtggcatttactctcaaagctgctctaacgatgatgctgatgttattgttttagctccaggaattgaattgctcatggcaatagaggcgacttctgctttgtctgtagcctcatagatcacccctcctgtctatgtcctctgtccaccttggattttgaatgtgaagagagagagaaagattgaattatggtcaaagagagtggaaagcaaattaattaaacctctatcagccttgccttcagatataaactgactcagactttacaacccgttcctctctaagtttgctcaactcccctcctcctgctcccactctgttccgttcctttgggcaatgaggtactaaactacctctgtgataaatgtgtgtgttgattccttagggatagagcggctgtgccctgaaaggccttggaaccctcgcaaaattcctaaatacatgtggtgggcactccagcagttgctggcagactctcccagggatcccggctgagtttaatactgtctgccaggctaatccactttccggggcagtgtctagcaccagagactctctgtctggaagtatcctggccatttaaatgactccaggttcctggggatcagtttgcagcctttgttatcttttggcagagccaccttgcttttcctttctcatcttctctgtagtcagaccactcaagtgtaactttgtttattatttagggacctcatggggagaagttgagatgattatcctgagtacagaatagccaacttccaagtgggtattgtgggtgtgcgtgtgtgtgtgtgtgtgtgtatgtacattcgtatgtactagcatgcactagtaacacgtgtatgtttgtgagtgatactggctgtctaggaaggatgagtagggtttggatgaatctcttttgcaggaaccaaaacaggtgcaaaatacccgtgtcagagtcctcagatggctggtgagtggaggtgtagcaggacaagccgcagacaaaacccctcagacactgagttaaagaaggaagggctttattcggccgggagcttcggcaagactcacatctccaaaaaccaagctccccaagtgagcgattcctgttccttttaagggcttacaactctaagggggtccatgtgagagggtcgtgatcgattgagcaagcaggggttatgtgactgggggctgcaagcactggtaatcagaatggaacagaacaggacagggattttcacaatgcttttccatacaatgtctggaatctacagataacataacccgttaggtcaggggtcaatctgtaaccaggcccaaggtgcggcgctgggctatctgcctgtggatttcatttctgccttttagtttttacttcttctttctttggaggcagaaattgggcataagacaatatgaggggtggtctcctcccttagcggaattccgtacattttgttctaagttataaccaaaaaactgaagtttataaatatgaggccttccttttccctctttgtagactaaagtttgtgaaccaggaccccctatcgatacctttttagggattgtgagatctgactttttttttttgtattgttgattttgctatttctcagggatgggagttcaccacccacacttttgtgctgttactatttgaccacctcttcctctttgctccccccacaacttttattatccagggagaaatcttttggaataggatagaagaggtttctggggataagttttggaaataggcaaatttttagtctgaaggacattgtagtaggatttatgattctgaaatgtagtgattgtatgtagttatgtatttgggtacacagccttatgtacattgcgttaaatacatttaaataattggataatgcctagacataattaataaagtgatgctgctttgtttcttttgttattatcatgttattattattttatatcatcttatgcttgctttttggttctgaggttgattgcaagggttagaaaatgacagcgtacaggtcaatttttgtaaataaagttttattggaatgcaggctggctcacttgtttatatattgtctatagttgcttttgtgttacaatagcacaggaaagtagttgtgacacagattacctggccaacaaagcttaaaatatttagtatttggcctttcgatacaggtttccaccctcaggtttaatttagtcttttcctttacatactttcaaaagtgctagaacaatgctttagaaagtgctagtgtctttaatggaagaatgagtcattatctatactcaagcatattctaaaccaatcagaagagcttgagagacacgtctgaaacgtgtgtaggaacacatatgataaaaatatatgaaaagatactcagcagatgtttgtcagatgccaccaagtacaaggtagcttttcaggtgctatgagaggtactcggtgaatggaataccatcttattctcagagagttaactgcccaataggaggaatctgctaacataacagagatgtctgatagtggctatagacaatatacatttttataaaactgaaaggaggtagaatggcttttgtagccaagtctatgtgtagaaaatttggaatggaaattaagaaactgtagtgatgactgctgcttctaacagtaaaggaaatatttatgtgtatcttccagatgtttactgaagtagaaccttagtaagttatttgacatgaagcccaaagttataatagacacaaagatgcttcatttcaagccttagataggaacaaaaatatgattgaaaccaaaattagcctagaactagaagtggcctttacagatcatctactaatatcctgctcattttgcagctgaaaagacgggggccgagagatctagttgtataaaattgtctctgaaacctaggacttctgacttccaggtctttactaaattccagtgtaatttttaaaattttcaagccagattctctgtggatgtggagaatatcaacatgaagtcttgcactgccttaaagatcttcattagcatgctattcctttcctttatcttcctgagtccccaaggtcacagatgtaggagtaaagtattgaaaagccattcaggactctgtcttctccccgttgccttgttgaactgcttatgggggtgatgttcaggggctgggctagggcattccactagagtgcccaatatctttatacagatgctgattgctgccctgaatacccacagcaggaatttttttgagagaggaaggtgagtgtgggcaattgggaaaacagcccacaggtaatggagggagggaaccttaagtttccttttaactgccaatcagtaattctttgttcatttattcaagtatttattaagcacctactatgtgccaggctttgttctaggcacttgtgatacaacagcgatctacacaggatcctccccttgagggctttgcattttggtgtgcttcatggtggaggagtgtgtttttcatggtgaagccatttggaatctgccaggttgaagcactgaaccaggagtaggaagacctgcatctaggcctcagcactacctactcaccagctctatagccctgtgcatctcatttctctgcagccgagtcctttcttgttagaaccttcaccctggctcctctacgacaagggtatctttcttctttattctggtgcttgcctccttatctggtttccccacttcttcttgcccttagtttctgctgatatgttcttttgtccagttgcctcttactgggtctccctgatgccagttgtgtgtccctgtgcaggtctctgctctactgtgacaatatgttctgcctgtttgcactttctcagtctttgcacttctgctcctacccaaccccactgagcaggtctagctccatatcctggatcccacccataggcttatccacaccagggagagttccacccctggctatgtctggaatcaggacttgctgcatgttgattcactcattcagcagtatttattgagcaccatttagggatgtgattggaagaagatctagtctcggtgctcatagacctcatgtgaaccaatgaggaatcagaattgaattttgattaaactcagggaccctgattcctcaaaaaaaatgataaatttggagtaaacttcaacaaccctttaagctcaagcactcagtccacaaaatttctctatttcagacatttctccctagcccttaaatcctctgtctacaagctgattgactaatatattcagctaaggttataaaagcaaccagggtttcttaggcagccaaaaagaagtcagagagcgaagaggagagaaaaagccaagaatgccatagatcctggatcaggtgggccagctaggggagcaaggtgggaagtacaagctttttgatgcctgagaccagtggtttgagtggggagcttgcttgggaaaaatcagcagggtccacagaaatgaaaggggatgtctaccaggagcagctaagaagagccgggagggaggtctggggggctcctggtcctcaccttgttttagggtgctgcccttgcctttttcaattaaagaaacagaaacagcagctatttggggttttgagcatggaaaggtggaggacagaggagctgtctgagttatcttaagaatctggttttactgtttattgaaataaaatggtcagagcttgaaggaaaaagtaatttaatttataaatagttgctgatcactcttgtgaatagtatattctgttgtcttcagaaataatcctgtagacatcacctgcatgtcaatatttggttcagaaaatataatcaccagttgctgttattgtctataaggcacgatactaaattatcttgtcatctaactcagtttttatcattatctcttggtaattttattgaaagaaaccagtaacttgtaaatcataaaaagatgaataatcccagttataaattcttttccttaacagatgtctttaagacaatctgacttaagttctcaattctgactaatttttttctaatggtttttagagagctgcatcatgatctgtgtgatgggatatgtttgggaatggtggatttaaaatggatttctgatagtatatgaagggtatatatctttgaaaaaattgaaggcagaaaaatatacagaagaaaataaaagttccccatggcttcctcttttccaagaactaatactagactgtaagaggactgtgaggggcagatacattgtctgttttatgctctgtgcctgtgtcaaaaagtgcttggcaaatagaagggactcaataaatagttgtaggatgaccaaatgaatattttgtgcgtttccttcaaaccttttttctatagatatatgtatgaatactatgtaataatgattacttttatatctttaaataatattctgtatttcagttttatattccgcccccattcttttttttttttctttaaccacaatagatgtgtttatatacataagtttttcgggggatcagaagaaagtataatacaaatagtattatatgtggagtgatttaaaatgttttgtttatattttaatagttagtgactaagaaatttgaagtcagccttcctcctttgccttagtttctcagctacaaaactgtgtttgtagaattagcacttaggtacagagagccaatgttcagggatgataatgataaaatgatgttatatagataggattgagagcttatttactagagtcagaagagcctgaatttgaatcttttccctctcatagtattagattatgtgaccttgggcaagtgaccttggacaagtgtcaacctttataaatcttatttccttgtcgtaaaatgtgtttgcatttgttaggattggctagctagagtgtgttgccataacaagtcctggaatctgatcaatttagcaaaacaaaagaatgtttcttgctcacacaaagtctgagtagagcctggatagtgagtggcagtaggggtttaggttgcctactctttgttgtgctgccatcccatctaaacagatctttaatgtctctgcagcaaaggaaaaggaagcttggtgatggtgttaccagtagaaggtctccaggttcttggtgtcttgaacaaataattggacaaaacacacgtacaaagcaaggaaggaatgaagggttttattgaaaataaaagtacattccacaatgtgggagccggcctgagtataggggctcaaagaccccgttacagaatttttgggagtttacataccccctagaggattccactggttacttcggttatgccttgtgtaaatggagaggatgaggtaaagttacaaagtcatttacggattatgccctatggagagggtattttctgttatagctgaagtgtgaatcggccttatgttccctgcctccagaccctattttcctgcctcaatggcacactagctcttgctgccttgacaatgaagttacacattacatattacttctgctcacattttgttgtgcagatctagtcatatggccacacttgagtacaagggctgaaagtaaactttttaggtgcttaggaagaagaggagacccagaaataggtaagcactagtagtttttacaacagaggtgaataatagtaacttcaatcaaaattggtgtgatctaatcccctacccgcttgtgattaaaaaaaataggattacactttttttaaaaaaacctaaattattaggccaaggagcttcccactagcaaatcgctagaaataaattctcctcaaaatggcttttaatgattttgaggaattcccagggtcctgactcctgggtattttcaaagagatcttttaggtttccccattctagtcccttcatcttgccccaggctaactctgatgttttgagaggacttctttgttgtgcctatctgtcccccattggtggccaatgctctccctagttcttttcaggacacgataaggctgagttgatgagaacatattaaagtcttgaggataaagccagccaaacccaaggaacagcttacacctgataccaggtgggtttggactcacaacctcagatctacacctaaacttcagagtctccttttctgctagttcttagctcggttccatcttttccctgccatagggaataaatcaagcctgtgcatgcttgagcacctagacccaaatggtttgccctatttctaggcttaaaaaacaaacaaacaaacaaacaaacaaacaacatctctggattacttcctcccaggatggctgccagtgggaaattcattttcctccagaagagatttcacagtgtggcttggctccctgtctctgaatatgtaatgcgacgcttgacagcactttactctaaatctagattattcatgcgcaaatcatgccaccatggggaccaatagcctatccagattgtgctttgtcaagtttgtatcaccttcatgtgacttttcttccagcagttgatgagggaaaatagggctttacctctctcttgatattctaggtccagctccatcacccaaaagcagatgcctggacaacttaagcacagtctctccagaacaatccagaatgtcaagcattgatcaattttaatttaagctttgggaaccaaaccaaaccaaaaaaacctccaaaacaaaaacaagaaacacccctatctctgcacatacagttctgttagtgcagccaattccatcgttaaatagatacagtatccccccttggaaagccccccagtagatgcctgaaactgtgaattgaaccaaacttgattcccatcaattgtagcacatttctgtttgtctcttccaccgacaaatttaatgccttttccatcttaactaagcacttgtcatagactgtggccataatttttgcaatttgaggtgcaacagtaaatctagaacgaatttatttttccttcttcacgttttcaccaatgaaattggtcttactgtagatcttagtaacctcagcatatgtttttttttctatcctttttaagctgagaactctcatctattcactgaaagaaagcactttatggcttctctttggcatatctgagttgccaccatcactactcttgcattttggaaccattattaagtaaaacaagggttacttgaacacaagcactgggatattgtggtagttgatctgataattgagcccactactgagtgactgagggacaggtagcactgacagcatggataccgtggacaaagggaggattcactgcctgagcagaatggagcaggacagtgtgaaattttatcatgctagtcatagtgatgcataattgaaaacttgctgtttatttctggaattttccatttaatatttttggactgcagttgactgggtgtagtaactaaaaccttggaaaacatgtctgaataaggggggactactgcatttaatgtgtttgtctgaaggttttatactgggtgatttctttggacgtagtcttccccaaggaggagagagaggtactcactgccttccatctacataaacaaaggggtcatcaaagtaatcctttccataacaccggctagtttgtatctaacaacaaaacaaatacattcttcactttataaggcagaaacccacaaacggatgtttttacagctgcactacattttttttatttttatttttaaaatattattttagattcagggggcacgtgtatagatttgttacatgggtatattgcgtgatgctgagatttgggcttctaatgatcctgtcatccaagtagtgaacatagtacccttatcttgttccagttattagggggaatgcttccaacttttgcacattcagcatgatgttggctgtgagtttgtcatatagggctcttattattttcagatatttttcttgatacctaatttgttgagggtttatatcataaacggatgttggattttattgaatgctttttctgcatctactgagatgatcacatggttttgtttttaattctatttatgtggtaaatcacgcttattaattttcatatattgaaccatccttgcatcccaggattaaagctgactttatcatggtgaattcactttttgatatgctgctggattcagtttgctagtgttttattgaggatatttgcttctatgttcatcagggatattggcctatagttttattttcttggtgtgtctttatcagattttggtatcaggatgatactggttttgtagaatgagttaggaggagaccctccttgatttttttggaagagtatcagtaggattggtagcagctctcctttgtatatctggtagaatttggttgtaaatccatgtggtcccaggtttttttggatggtatatgtctatatttttttaattactgattcagtttctttacatgttattggtctgttcaggatctctgcttctgcctggttcaatcttcagaggttgtgtgcttttaggaatttattcattctctcaagattctctagtctgtgtgcatagagatattcacagtaatttctgataatcttttgtatttctgtgggatcggttgtgatatctttgtcatttctgattgtgcttatttggatcttctctttttctttgttaatctaggtagcagtccattaatcttatttatcctttcaaagaaccaattatctgtttttttgaccctttgtatggtttttgggtctcaatatcatttagttctactctgcttttagttatttctcttcttctactagctttgggattagttttttttttttttcttttttgagatggagtctcactctgtcacccaggctggagtgcagtggtgctatctcggctcactgcaacctctgcctcccgagttcacaccattctcctgcctcagcctcccgagtagctgggactacaggcgcctgccaccacgcccagctaattttttgtatttttagcagagacggggtttcactgtgttagccaggatggtcttgatctcctgacctcatgatccacctgcctcggcctcccaaagtgctgggattacaggtgtcagccaccgcgcccggccaagattagtttgttcttgtttttctagttcctttatgtgtgaagtttagattgttaatttaggacttttctatcttcttgatgtagacgttttggtatgttgtgtttctgttttcatttgtttcaaataattttttgatttttgccttaattttttgttgtttacccaaaagtcattcatgtgcaagttgtttagtttacatatatttttatggttttgaaggttcctcttagtgttgatttctatttttaatccctctatggtccaagaagatgctttgtataatttctactttttaaaaattgattgagacttgttttatgatcaagcatgtggtactttttacagtatgctccatgtgcagatgagaagaatgtattttctttggctgctggatgaagtatcctgtagatgtcaattagatccagttggttcagtgtccaatttaagtccagaatttctgtgccagttttctgcctcagtgatctgtctaatactgtcaatgtgttagaggtcccctactgttatcgtgtgtctgtcaaagtcttttcttaggtctaaaagtaattgttgtataaatctgggtcctccaatgttgggtacgtatatatttaggatatttaagtcttcttgttgaattgaattctttatcattatgtagtgtccttctttgtccttttttactcttgttggtttaaagtctattttatgtgactcaagattagcgactcctgctcttttttgttttctatttgtgacttcactataattttaaagcccagttcccactagaacttcgttttgttagatgctttgactgtaataaaacagccttcgatttttccatttttatctttttattcattatcttttgtaataaattccattatgcataaaattttagtggttacttctgggatcaagcctgttaacccactcacacaattaaattttcctttctgactttattttttttcccccggtagctgagtacctttcttgatgtaacattgagtaaaacattggctatttatacatctaggctttcattctcataagtgtgtgttttaagcatgggtattaatttcattatgtgggtccaaacctgtctctgacttggaaatgacttacgggtgcacatgggtctgcatattaaggtctcttgtggctgtgggagtgagtgggagtgacgggagctactgtgggcattcttgtgtacatctggccatagcagtgggtcccaggctagatcactggcacttctttaattaaggctctgtttctgcccagagcaaatttgaggttctctgcttcttttcctattgcagaaggggccctacctaggaaggattttgaagttctgtttcttcctttattttttttttatccttttggatgtaacagcgcaccaaccactgccagagctgacagaattggaatggaagtaggtgggtgggggttgggggtggaaggagggatggcagtcatcagtttgggaacaacctctgagccaaagaaatgcctttggcatatgagaacagtgtgagtttatctcttttcctgtttggaagaaggtacactataaatccgactctacccaggaactgtttatgggagatcgttattaaagaatagatatttgatttttccattggtttggagaaactaggagtcaggcactaaggacgtgctgtgtactcataacttttctccagctatccataaggctaatatacatttttgacaggaatttttttaagtaagaatttttttttacattgtatttatagatgtaaaagcactgagagcttcattactagaaagcagcccctatggttttcagcattgctagaatcaagagatgatattcttgttgactgttgaccatgcttttccagatcacccactgttgcacattcatgaaattggagtgagcatacaaatttgttgagagaattatcttaactagattcaacctctgtgcccatgaggtactgtcattctcagtgattcaaatagatatttgggtacaggtggtcatgtttggcgagctggtttctgtgcagattcagcacctgtggtttgtttcatcttatcgttcagacacagatgctcttagagcaccacaccatgcattccaatgaaatctttccactgaaaccataacctctgtgatcctaaaaggaaggagtcagtgtacagagggacatgacatattcaaaatcagaagttgggataagccagaaggaaccttgtgggattaattttcttctttaagtgtgggtaatgtttttcgcatgccctcttttcaaacctcagcacttcacttgtccatctgcattttctccaagtattgtaaatgtcaggtttgtgtgaagaggcatctgtaaaactgctggcatgaataatgactctgatgtttatgtacggaagagcgcacctgactttagcactcttattatcttttactaattaaaatcaagaagatgtttcagctagacattgcctgtgcatagcacctgctggattgcttttctccttttggtgtttctggtttggtggaaaggcaagaaaggtgagctgaatgacttggagcaaggaacagtggtgatgtcccatcactctcggacaagcactccttagcctatttaaatttatttttctagttctcaaaataataaaaaaaaaattaagacttagccaccctttttatcagtgaggaaattcaggctcagagaggtgagctcatttacctagttactcagcgtgtgacaggattaggatttggacccagagtcacttctgaagcttgttctacttccaatcttataattaccttaaaaatagggtgtggctgtatagaccagcttttgcatgagaaaagcctcattgttcatgaatttagtttatattggatggttattttaaattatagtcatgtgctgagcattatgtcaccagcaaatcatagccgttttccagagatatttccctggttaaatattcacatgacatttgaacatactgaacagccaagcatgttgcttagttgttatggttgtttttgtgcggggatatcgggtaggggaggggattaaaagtattgggctggtctggctaatttctagtctccatttcttgcagacgacctctgattctctggttttgaagtagggaagtgtgactgtggtgaatcccaagaaacagcttgatagctttacaccatacacctgccattgctgacatactttggaggggactgaagtggagatgcaaagcagtcaggctgtaggccccagggagcttatgaatctgacctcaggggtcctccctgtagagattcctcacaccaaacatctgaactcatgtcaggcagtactgttttaacctcactttttgcccagaatgatgggaataaaatcaaaattgacagacagaggaagctggtctttcctccagaattgataaaccaagatactttaaacttattcccaagaatgtggatttctgcatgtatgtatctcttcaaggttgcataaatggaatttgtgcttcaatttgtcagaatcctgaatttccaaatcctgatgtaaggatttaagtaggagagatacctggatttgaattgttgtgaaatacagtggtaggttgactagctttattccaacagagtgaggttgatagtctttgttgccatgagatgcttcaccttttcccctaccaaccttcaaagacatggtggagcggaatcactgggcaacaccagtgggaatagttcaaccaacagtagttctcacttagcagagacagacctcaggttcaaccttttcttgactgccatttcgattctgcaagtggcaaaaataaactggaaagtggatgatcactctcatatgctctattgacaaataagaaaaacagggaccaaaaacaactttctctgggcagtctggggaataaaagctgctgggaggatctagtgtacacatgcgtgtagcactttttacattcgctaaacccttttatagttactctgtcattggccattctgactatgttgtgtgcagggcaaatgagttttgttcttcccattggagaaaggctatctaaggaagacccatgggaaattagcaagtaagccagggctggagttcccagagaggccctgcatgaggtcccataggaagccgctaggatctcgaggtctagtcgttatttttcctctttggcagattacaccgtaactctgaaagagccagggaagcctaggttgtttgttctttagagtttttaacatggaaggaggtttagaatttattttgcccgtcttttcattttagagatgaggaaaatgagacccagggagatgtgatttcacaggtcaaatagtcctatgacactgggtagacaataggatacctgatgtgaatgttgaaaaatgtgccgtaggagaaaacagccctttaggcacttgacttggcaagctgaggttacttggtgcaaaggaagagatgcccttctttcaggtggatgtagatccatgctgagacacgtggctcagagtgctgagcatgggctggatttcagctcctgatccctctattttcagtccacaaactgcatactctgtgaagtggctctgcatggttttgctggttcacttaaaacatatttggataaaaaacatgactgaatgagggagtcagcttttcattaggtagaggaggtgtccatatgtctagtaattgccctcatttggcacaaatcaacgagacctgagggatgagggatgaatctgtgtcttcttttttatggttatgggcatgaacagttaggatgaaaccagacctgcgtgttctggtttggctgatgatggatactttcaaaattgtatcaaagaaaatagacaatggaagtctggcagactttacaatgagtatctagtaaatcggatatgaaaaggaaagggggggggggaacctcatcttctctgtgaatttctaaaaaagtgttcacataagacagggctagatagtttgaaggatattttccaagcccaaaactgtacaagaggaagttttctctgggagctggaatttgaatggacaaagtcaggttggtctcagtggttaatgcttaaagtttataaacacatctttttgtttttagcacatcctacaaatgcagtttattaatatggcattttatattgaaaggtaaatatcaccataccattgtgaataattctttggtagtgaaaatagccctatcttacagtgactagatccttcttataaatgctcttcaggtagcccaaagttctcctttgtataacccattataattagattatacatataattgtgtagaggtatgtatttaatatgtgtctctcctagtagcttggagtcagtatagcacagcagctaagggtccagccctcgagatctgctttcaaattctacttttgtcacttagtatctacattacaccgattaacttaatcagtgtcatgtggtcctgctaactgcattaatttgtctgtatttcattccgcatctacaaaatggtaataaacataggacatattttatagggctatatattgaatgtattaaatgagaaaatccttgagtattgcttagcactgtgcctagaacatgaaaactcttaataaagcttggctattagtcttgctaaacggtaaagactgtttctgtcttatcccttgtgttatccccagttctttgcacagaacttgtggcacgcagattaatcatagaaattattgaataaattaatggtcccatttttttcctagctccactgtggtgaagtctcagattcccaaggatgtggttgtgtgcagataggttccatgtggccagggctcttgttcagtttagtgtatttattctgccacactttgcttaattccagattgatttgcttttatatgaagatagtaatatatgggaggcattgattcttagcttcttaaaaactgacagctaatgtttagaggcatttcaaaatacagtatctaaataatatgtagggaaacaggagatgtaatttgggttgataggaaatgccttgggctcaagtaagaggttctgggttccattccgaagtctatcagagatgagctttcatgtcacctgcttaaacttaactttttttttttttaataaaacgaagggactaaagtccattatcatcaaggtttttgcttgtgtttgtattttatgacagtaagatgttagttacttttattaattccttaaatgcatggaacagatttgcctttatattatgaatagaatgcagattcaatttctgcaaataatgtttctttgtattccagggaaacttgctgttgaaagttctccttccatgagtatttcttgtaaatcaagaatcttttctaatacaaatagttatctcatgtttctgctttgaaaatttgtatgtattttttttttttttttttttttggtgaaatgaggcatatttgaatgctttgaagtaaaactaataccatttagtgagtatgcacagacccagcatagggaactaagtatttcaatgtttatgattttaaaacactgtcatatttcgtgctgtccaatcacgtttagctttaatagttttccgtccaatttttcggaacccaccagacttgatttttaagagttagttcaaagattgcccaaactttgattcaatctggcttataagagataacaaagattattatttaaagccacagtcattagtgatatgagggtagatatgaaaaagaaaaactgaatagactgcttatctcttactgtgatctgtatgacctctgattaatttaatcatggttctgtatctaatgttgagggcctgcaacaaggtcttgattgacaaaatctattttctcttcatactcattcaggcttcttggaagctaggggtttctgattaaattatgctatttttgtaacccacagaagatcccatatggtcaatttcaagttcccgttactttcagtatttttcctagatgttatttcacttaggacaaacaggatgcaatttgtggggtggttgtttgaccttctcgtattaaaaggttgtaagtgttgtctctttcagctgcccattttagaagttaaatttattgattgctgagcactttagtgcattctctcatttattcttcacagcaacgtgaagaggtaaggtctgctattaatcccattttgcctttgcaaaataagccatagaggagctaaataatttgcccactgtcacacggtaagaggttgagccatgtctgaaattcaggtttatttggctccagaacccctacattagccttacaataagatgcctcgtgcaacctagcttgatggagattgcatgctaaatatattttaatactggaaatggtttactgatgtttccagcattcataatgatcaggttgcaaaatctgtttggacatttattaagagattggaaccaaattaatgacatcttctctgaaatttctcttggcttatcttaggagaaattagaatgaactgaagcagggaaggataggaaagagctatgtgaaaaattaaacactgtgtttaccaatgttgagtggctttctacacaacatgtgtgatctgtgtgtggggccctgtgtccagtgctcaggttatggtcctactgtcattttcagccactgttcattgatgtacactcactgttcagggtagtagagtccacaaaagcatgcaatgtcactgacatagcggacggtagctagcacaggcgtttagtgtggccatgagcctcagctcttgctcctataatttcatttctcaggaattgttgttcttccctgttgctgggtcttggtagggtctgctctggtctatcctaatcggtgtgcttaactttacatttggagtactaagagttgaggttttgcttcctttcttcccagaattgctttggaatccttatgcagtttgctctgctttctttgtagtgaccaagtttatatactggcacttctgaatcccaagaaaatgacttgctattcaattgacatttcaaaatctaagatggtacccttgcaaccaagaaaatataatttattttataaaagaaaaaacccgtctacctcatcatatgcatcagatatacaactaaactgtggtaaatgcttgtacaccagtatcttcagggtcctggggagcacaaaaagggctacttggccaaatatgacagatgattcctgatttgactcttgggggataagtaaaatctaaccagatagagaaaggtggaaagagtattcaagcaaaagcacaggatgaacaaaagaaggaagcaatgaattgatgattagtaaagcaaaagcaaaatagattagcgttgctaaaacaaaagtatgaggcagagggtagcaaaagataagtttgaacatataggtagaagccctaaaatgcaatgccaaggagactggaatttattttaggttacagggcacccctaaagggtgttaaatgggacagacgtgtttttcacacagatgagtctaatttcagcataaaagatggatttcagggccagtagctagagtggaaacagggaaatcagtgaagagatgttaacatggtaccaatgtgaaatgagaaaggagccacccagggtaatggtaatagggatgcagaagatttttcaattatatagaagggcaaattgacaagccatcatgatcagcggtgatgtgtaaaggagagggagtagttgacaaatatttattgatcacgcactctgtgccaggcactttaaaggtcatgagtcacagaagtctggatttctaaaaatctacagaatgactgcaaggtctctcattgtgaattcattctctgttgctgcattggaaattgccctaaagcttagtggctagaaataatatttattatctcacagatttgtgggtcaggaatataggagtagctgagctcagggtctctggctcaaggtttctcttgaggtagcagtcaatttgttggctgggctgccatcatctcaaaacttacctgggtttgaagaatctgcttcgaaggtggatataggtccctagtcacaggggcctctctgcagagccacttaacaagaaggcagctggttctccccagtggaagcactctaaaagatatgacgaagagcacacacgtcagaaactgaagtcttttaaaatcttcatcttggaaatgacgtcaccagccactcctagattcctgacccgcaaatctgtgagataataaatgttatttttagtcactaagctttggggcaatttctaatgcagcaattgagaaagaattcacaaggagagatcttgcagtcattctgtagatttttagatttttatcatctcttccctgatctccctgctcccactctagctactggcccccaaatccatcttttatgctaaaattagactccccaatacttctgttgtattctgtttattagaagggagtcccaaagtccagctcacagttagaggagggaattacacaatggcataaatgccaggagacagggatctgcaggggccctttgagagactgcctaccacacctgtatgactgagtagatggcagtgcattaatgaagattaggaatgcagttgaaagagattttagggggttaatgaagagacttgtttcagatagaaactgttgcctattcaaatggatctgtgcagcagcattagtaatggagaagtagattggagggtggtcatcgttttataggtagcatgtgaaaccatacaagtgaccactaccttacctccttacaaatcattgctcagaggccaccctttcgatgaggtctgtcttcaccaatctcttaaaattttaactcttttttcactctaatatcccatctccaccttttgagttatgcatagcacttaccatcttctgtcacgcccatgatttacttattgttcattgtctgtttcttccaccagaatgtgagctcgattaaagcagagttctttgttttatacactgatgtacacttagtgcttagtagagtacctgatgtatagctgatacgcaatagttatgcaaagaaggataaaactttgtaaaagtagtacatctaagccaaaggtggaaataatccaagtattcattgatggatggatagataaaccagatgtggtacatacatacaatggaatactatttggccttaaaaagtaagaggattctgccacatgttacaacatgagtgagccttgaggacattatgctaagtgaaatgagccactcacaaaaggacaaatacagtatgatttcacttaaataaggtacttaacagtcatcaaatacatagagacagaaagtagaatggtggttaccaggtgctgaatggaggaaggaatgaggagttattgtttagtgactgcagagtttcatttggggaagatgaaaagttctggagatggttggtggtagatggttccacaacaatgtgaatgtagttaatgccacagaacagagcaattaaaatggtttaaatgatacattttatgttatatgtattttaccaaaaaaaaaaaatttcaaaggttgtggacgtagtaattaagataaggactgaagaatgcctattggatttgctaaaacagagacctcagtgagagctggttcagtgggacactgggagctgagatgatactgatgagtgattgagaagtgagggggatacgagctagaggaggcttctttataaagaatgggggggatctcagaatgtttcaggctgggagaagtggtagtggggtgcatgtgtgtgtatgtatgtgtgttgtggagactatgtggggcggggaggccacttggagatacagctattaaataagtgaacaacaatacaaaaggcgggctgggggaagggaggaaggaaaccgaaggaacctttcctgtctacttgtatggaggagtaatgtctgaaattttccaaatagccaaagttgtggcacatgaggaggtttggagcaaacattataatagcttgggttaattatcacagtctgcaccattcagacagtgtctatcagaacccaggaacagcctataagactaagctgtgccaaactgtggaaaggggtcgatggtttagggcagttagggctgcaggttctagggcagttatcatcatgaaaggctgtgataagacattaactgttgaacattcttacagcatattgtattgtaatagactctgaatttgaatattttattatagcaagtatgttgtatgcaaagtactcaggcattgcaaatcaggcaaagttgaaaacaccccagtattattagagctctaccacacagattctgcaacatggggaaactcaatttaatacattttcattgaatacctacctataagcctccgtggtatgaaaggcatacaaaatgtgtatttactatatatattgtaaagtgattatatatactattgtgaaactagatcactatttggtctactagctaatatttatatagatggtattagcatagctattgccacataggcaaagagatccatgttacagatgacagaattgcaggttttctcaagaacttctagtggattttaaagtattattggaaggtggaaacttttgttcagacacaaaagtgttgtactgaagtaaagattgctgcataaacatgcagtaatttatttaaaggtacatggtcctactagagcatgggcagttagtctagaggtcctgatcaagcatggtgtaggacagagagcttgtgtgggatttctatgtgggggcttggcaattctgggattaatttcagcaggttcctgaaggtcaagtgggccaagcttcaaacagaagacctgtggttatgtctattcagtggcgaggccagatttaggaagccgagaaatcaaacattatgaggaacaactagttccagaaatcaaggtcaggcaagggcaagaatgcaaggagaaatgtgagtcaagatagtgtcattgctgtcagaatacacatatgggcctgatttgaagaggaaagggtttgttctagggtttctttcagagtgagaggtttactacgtatggtggtgctaaggcacataatgatgatgaagaagaagatgacgatgatgccgtaatgataaaagctgccatttgttagatctgtgctatgtggcaagcactgttagttcaacaaatatttttagtacctagtatgtgcctacatactggggaaagaacaataagcaaaacagataaaattcttgttctcatgaagcttatgtttacgtggaaggagacaaataataaatctgtaggcaaaaatacaataatctagagaattataagccctttggaaaacacagaagaagcagagtgaatgaagacggtttggaagagggtaaatgtttcatgtacgatgcttaggaaaggtctggaaatttgaacagagatataatactagtatggagacaagccaagcaagtttggggaagactttgaacagagtgagatcaggtgtgaaggccccgtggtagggaattgcttgacaagtaaaaggaatagcaggagggccattgtggctgaggcggaatagtaggattctttagagcttttgcttgtggccatcttaccagctttgcctttgaacctagtgaaatgagaagcccttggaagcttctctgagcatcctgaaacttaggctgtattatcctccagatacttgtgtgagataggtaaaattattattgtaccttttacattaatgaaaaagctgagacatggagagagtttaagtgatttgcccaaaaccagctctaaagctttggaatgaggatttttaacgtggggagtgattttaggttgcacagaaaggatggcaaagggacacaaggacattttgcggggtgatggatgtgttcattatcttgtctggctggtttcatgcatgcatatgtatgtaaaacagtgtgctttaaatatgtgtcatttattgtatgtcactgatacctgagtaaactcataaaatacgtttcaaaaatgagggagaggccttgatggagtttaaagcagagaaatggcattcatattttgggaaggatggattagagatcaattagaaagccattacaaagatccaggaataaaccagtaaggaactgaaccaaggtagtgtagagaggaacaagagaggactttgactgtaaagatgacaagacttgaaaggtgatgagaatgaggcatgagagaaagaaggaattgagcatagttaccaagtcggctgtgttcagaggtgaaccacggtaccattaaccaaaacgtaaaatcccagaaaggcatcaggtcctgggaaaggtgatgacaggtgtagacagactgtgatctggttgttgtgggatatccaggacaggaggtagtttaacttagggagacttctggttgagaactagagatgtggagttggtgtgtaggcggcctattagagctataggcatgaatgccatgccagagataagaaggggtggaggagaaagctcgaaagctctggggagcaccagtatttaaaatgagacatagagaaaaacttggtctgcattgtgccctgtatctcatttcaaactcacaggaaacactgattgtcagtcacaacactctttccttcaggcgtctgtcaacacagtgttggtagaaaccactacgtttgatcagtgtcaacgagcaagatgaatcctcttttccacccctgattttagtagtgaacatggaaccattaaggagatgaaggagtgtttgaaaaagttagtagaggcccaggagataatcatgtcttgaaggccaagaaaatttcaagaaaaagacagagtaagatacagacctcactcttataagaactgaaacatatccattgtttttggccattagaaggttaataatgactttgtggagtgtggtttctatggcatgagagggtaaaggtcaaattatagtggatccagggatgaaagtgaggactgtgctccccggaagcacaacttggaagtgaagaagtaggaattttattgaaaaagtctgtgttctttttataaatttctttacaaatcaaagagttatttagtttttatagattgtcacatttatttcttaaatataggaatatccttggagtctctttgctaggagacttttgggcacaaagcagatgcccttatttctgggtagtttcctgacctgaagtgtgggacaagactacctgagccttagagccatctgggatggtttcccagctgctggtctaccagcctttgccatctcagagtaagagaagttgcacatggtgcaaagaaaagtgagaaaactgagttttctataaagagcactgctttatcctgagattatctttttttcttatatttgggttgaaatgtctttgtattagtaggcagtatttttttcttttaaataccccacctagcaaaataaaaatttggcacctctctgagttactctgttttttctcaatgattctaattccttaattccttatgaacagccatcttttttgtgtgttttaagtttttatcttctctaggccagaattaatttggagaacgagaactaactagaacaatgatattgttagtcctcaggagctacaggcagatggcctatcacccaagaactccaaaatatagtacatgagattatcctgataaggagattattcttcctaaaattagagctcaaaatcaatcatagtagataagtgtgtaaagtcaccttgaagatatagaatagctcccctgccagccagatttaactttcatgtgattaaaaatattactatgtctaaggaaagaatgtgttaatgaacaaagaggttgattggctatgagaacatgggaaaccatggggggaaaagctggtgatatctgtctgagcactggttagacaagaggaaatgatggcagatggaggcctgaggatagttaggtttcactggcagagaccagatggacccactggattggagaggcccggctatgtgagcctgatgtcaccccttaccctcaatgcatccagctttccttcatcttttcccatgcctactctttgcatttgacttcccaagtaggaggagaatgcagtagtgctggggctaaactattgcttctcatacagactgaaagtttaagtccctgtgtggatcatttctcgatagaattttttaaaccagcattctggatttatccctcagtctcagctctggtagaaaaattctttaatgtgctgacaaagtctggtttctgagcttgtggtgctgaggtctgattgagcctcttgtgccttcagccaggaggaccctggctttccttagatgggagcagactttgacgttaccactgtgttggaccacattgtgacttgctgtaatttttcttttaaagtttcctccaaaattaccattttaaaagaaacaccaaattaaaaacatatttattgaccagacattctgcagaaaaccatgttcaagaataacttttgccatttttcactagacaatttttagaattttgtcatttcaacatttttttctttgtttctcactccaaacttctgtaaattttttattcactaaattttgttcacacaattataggtagtcttgtgatgattgtctccaagctggttccactttctttgtttttaattctgctccgatggattatttgtcttgaagatcttgaaagaagttgataaagaagagcttaatcatagcaaaatttcttagattcttaattcggaccacaagcaaaatggtctgttttaagcttctgctatgaaaaattacatggagtttttctcatggtttcaaattattttattcctaaggctcaaggctcttgatgtgatggtgaacatctgggagaaaaacttaagaaaaaatgtagtcatttgaatgtttgatgaacagtttgagaagttcacaaatttgtaaacattctgattttagtcattcgggttcttcccctacttctttcatctgctcttgtcattatgtaaatagagccctacagaggggatggagaaaaattagtttttgtccaaatattcctctcttttgcatttgatcagaatgttctctgttcttgacgatgggtgataaaattatgggcaaggagaagctttgcagaagggcaaaaggagtaagctggggctctgtgagtattgcctaattgagtggctttgctcaaaaatctttttctttttgatgataactttcttgtgttgttgtcatattacatatttagaaatgaaaataagatgaaatatttacttattgaacatctgcttttctcctagatggggtcacagtctccaagttccctgtttatttaggaaagattggctggtaattcctgtcccctttcctcccttttgtattactttagatatctgattattcataccatctctgttaaggaaaaaaatacttatttccatggaaataacattaggaagtggctttgggagctaaaaatcttcttttcatgagaaaacatttttttttcttttgcagatcttgaaaacaacggcatccttaacatacaatatacacaaatagatgttttgataaagaaaatagatccatataagaactattttatctgagtttacattagacctgcaataacatagtagtgagttgatactaggaagccataaagtcataaaagttttaccagtatgcttaagagaagattctcttgaggaaattaaaacagaagaagtgatatatcataatctttcacaaatctgtataatcaatagcagagatcaatagtaatatagctaaaaatctttgaaccctaaagatattttttgaagggacaacgttttaggaattcttagctcattcttggctgacgtctccatgaaaccagggttgtttgtgattttgcttcataggagaatccttgatcactccgtggaagaacttgtagttccagaagaagaaagctcatgatcatagaatgtgtgatttattaaattagaatctgcattttgctcaaattttgaaattctcagatctttttaacaacaaacatcatgatccagtaccattatattttggttaataatttcggtctaacagagttgtttttggtaactacggaattatcttacctgattttctcagaatagtgaccatgagaaaaatattttggaattggacttggattggaagggaaaagtggaggacaggagaaatcgatcagaagcatttgcagcaatctatgtggacatggctcagattggcctgtggggcagaggggatgcagtgaatggagagcttcaagacatatgggagagagagaattgactgcattcattcatcattgattgtggaggttgagagtgatgaagtctgaaaggaagatccctagcaactgaagtgagaaaaggaccattgcctgagaggggagaaggaccaaaagttcagtttggtgcatggtagttataaaggatcttcagggtgagatatagagcaggcagtgggagataggagttggggtttaaaagagtctcttggtccccagacaaggcatgttaaaatagctgacatttgatgagctttgagtattctatttaataactaattttagatactgtactatatgacagctataaaaataggagctgatgtatctgaaaatatccaaaaagaaaacgaaagaaatcacgttgggtctaataaaaatcagtcagtagatttaaagagaagaagagagttaggctaggagagaaatgtaaaactcccaatttggtctctttcggtttcatttacatggaaatctatgcttgaaagggaaatacagacgactattagaagtcagaaaacaaaggtacaggaaaagaatggaaagtcacctgggtttcccaccacttgtagttttctaaggttaattaaatctatttgcattttataatgagaaaaatatcacaaccttttttttttttaaagaaaacaagctacctttttttaaagtgatttgaaatagaaatgcctctgctagcttctctttttcatgctgagaggacatttcccagcaagccccaaggctttatcgtcttgtgatgtctccaggtcacctcagggacatagtggtataataaggaaaaccaaagggagaatggtagaggcataaaaatgtaatgaattgggggaaggttgattggaccaggcaaaatctggttattttgaccctttgtcaaggcggtcccaggtgtatctctgcccagaagaatatatttcaaatgtcttcagctgtagacttctgaagctacagatgattccactgatttatcacttctcccgtaggttgacaacattttgatactcaaaatgcagggaggaaagaagcataagaagtaggtatgaaagagaaatcacaggctttgggagggagtggtattaaagagcagaagggggataatacccacagaatacctgggatgagttcctcagggaatccttttcaaaccttctcgccctccccacctcatccccttctcacctctgtataaagagctttgcccttttctcctctgcttttcctcctccatcactggctgcttctttttagtctttttgctagaaacgatcttaccttctcaacttctaattgttggagagcccctgggtgcagtatgagtatagcatttcttttcttctttattcccagctactccctacttggctttcatctgttcctgtaactttatataccatttatatgctgcagatgttcaaatgtacatctctagtgcttgcctcccctgcactccacacctcctacttgacatctctgcttagaagtcttgtaggcatcttaaactcaatttgttcaaaaccacatctgcctaattccaatcacatcccaaacacttggtcctctgtcaatgtccccatctcagtaaatgtaccaccatttgtcctgggaccttgagtcatccttggcttttcttttttaccaacaattcatcattagttcattaatagtaatccattagcaagtggctctgctttcaagatatacctcgaatcttaccacttcttaccaccagcacagttaccactccaatccaagccatcactttctggactgttgtagtagcttgttaaatgatttctctagttatacccctcccctttcaaactaattcagatatgttctccacataccagcgaatgtgacccttgaaaacataaagatgttcatatcatttcctggctcaaaaacttatgttggtttctttttgcccttagaaaatccaaggtcctcaccatggcctataaatgcctctggccccagatgcctctccagccttatctcctgtcacctcctccctcgcttgctgaggtccaacctcacccactttctggctgttacctgaacaagctaaaaatctaagggactttgcatttcaagttacctttgtctggaatgttcttctaccaaatattcaattgactgtctctctctctctctctcttacctaatgtaggggtctgctcagaggatgtcatgataccttatcaaaaggaaatcatgggccaggtgcagtggctcacccctataatcccagcactttgggaggccgaggtgggcggatcacaaggtcaggagatcgagactatcctggccaacatggtgaaaccccgtctctactaaaacacaaaaaattagctggatatggtgatatgtgcctgtaatcccagctactcaggaggctgaggcaggggaatcacttgagcccaggaggcggagtttgcagtgagccaagattgcaccattgtactccagcctgggtgacagagaaagactctgtctcaaaaaaaaaaaaaaaaaaaaaaaaaaaagggatatcatgataccttatcaaaatcagcatcccttgccctactcttgatcttgttcttcatcactgctgtcatgatttcactgtatactaagagtgtatttgtttgttgtttgactcgtctcccaggcagtaagctatctcaagcgggggcattgttgggcttttttgttttatgcccaccatccagaagacttcctgcacatgaggcgtaactattagctccataaatactagctgactgaatagcaacgtcagtaaccaagggaattggtttttgatttgcgtggctttttattttgacagccttggaaacaacagtgagtctgcccagttctcacaagtgtctagcatggcgcctggagcagagtttgcacatataaatgtgttgggtaaattagtgaatgaccaaatgaatgaataaagtcactttagtgctttaatcaccagtacatcttcagctaccctttagacccattcattacacagagttactatggcaaaggaacctaaccttgtctaagggttccatgaaggcctccctgaggagggtacttcatcatcatcatcatacctaacaggttctgagcacttactatgagccatctactgctttatgaactctaactgatttaatcctcacaacaaatctatgaggttgataatataattagtcccattttacagatggggaaaataaggcacagagaagtagattcatttatctcaggataggtaactaataaatggtagtctgtttccagagcctgtgcacttcaccactcactatgctatacttttttttttttttaacgtagtcaactatttaattaagttcttaagacatttagaacaccaatttgtgaggataaattccattcgtcagggcaaccacagatcacaggtagccctggagctgaggaatagctttgatttttggtaaaatttgtgagtccacagctttctgctcaatcttgcactgctccgtaatctcatatttctctttttctgtgtcgaagatctcaccttcctggtgtctgggcttccgcagcttcttcttcttgaagtaagcatcagtaagatgttttgggatttttacattgctgatatcgattttggttgaggtggcaatgacaaatttctggtgtgttcttcgtagaggaactcgattgaggaccagaggtccagtcacaagtaacaagccactagccagctgcttcaggaaaaccaccctcttgcccctgtggcgtccagtgaggatgatcagaatggtcccgggggtaatgctggctcgcagttttctcacgtgctgactgaagggttttttgctgtggctcaacagctttcgaggcacatcttcagtaggataatatctaggcattttgcgaagtttaaccacccgggtactgccgttcttgtcaccaccaactggttttgtaacagttgcaagaaccttctccttctttttcttttcaaccttggatttagcggctgagtacttcctcttgtacatggcctttctggaatacatagcagatcgggaatacctgccaattcctctgacaatgacagggttgcggctgcaatggggcttccccttcttgggctttttagccttgaggttaccctttttcaccttgccaccagcatcagccttcttggcttcaggtttcttctctttagtatctggcttctcaactttttcacccgccatcttgcaagatgggaaagagctcactatgctatacttctaagctgaggactgaggatggagtattagctggcttgatggaggattggaattaggcagaagttagcattctgggcaaatggaaccatgtgtgccaagggccagatcattgccagttccatgaaagacatgacaggtttagtgtaaccagggcacagactgggcatataagagggtaagagctgaacctggttattaagcaatggccagattgtataggcctggtaggctgtgctgagtttggacttaccttaggcaaagggaaacattaaatggttttaagcaaaaatgttaggtgtacagatttacttttttaagcagtcacattggtgaccctgtagaggatgagaggatgggctggaaagcaagcaggtggagggcagggagaccgttaggaaggtctcacaatagtccaagaaaggggtaatgatgacctggtctagggtattggtagaggcagtggagagatagtataggtttgaggtaaaatcaacaggccttgtgacttggggtgaagaagtgggaggtgtacagaaattgaggatgactcccagatctctggcttaggatggcaggtagaagatgttatttatagggaccaattagttgatcaattctcttctaggattttattctacagatagactagttactagtacagacacacaagcctttatacagaaagacattcattgtaggattgtttgtagtaggattagaaacaatgtggtgtagggccttgcacaactccaggatctgccattcacacagaatacaatgtggaggcctccctgaatttgcacaactgataaattaattcccgaattacaggatgtccaaaccatgggatataatacagcagttaaaaagtaggatgtgagtctttatggactggtaatggttgccaagataggttgttatgcaaaaaggtatcctatgatttgttttatgtaagtctattcatacacacacatatttacacttgtaaacacgtaacatagttctggaaagatacataaaattttgtaacagggctgcctctagggtagaggattaggagacgatagtaaaaaagcttttttgtcttgtctcatttttaaatttgtatgcattacctgttaaaataataatatgttaaaaatacatcatggagacttgataatgcagtgacaattaagtgattaaccaaataggaataaaggaagcgtgatactaatttataattacctttccattgaaacacttctgaaacaataaaaatttaagccataataataaatcccagggcaaaattaaatatgaaggtaataaatatggggctttgaaatagtgtatgggggatattaccaaaaatcccacctggcaaattattataaggactcaagactttttcggccgggcgcggtggctcacacctgtaatcccagcactttgggaggccgaggcgggcagatcacaaggtcaggagatcgagaccatcctggctaacacggtgaaacccggtctctactaaaaatacaaaaaaattagccaggcgcgatggcaggcgcctgtggtcccagccactcggggggctgaggcaggagaatggtgtgaacccgggaggtggagcttgcagtgagccgagatcgcaccactgcagtccagcctgggcgaaagagcgagactctgtctcaaaaaaaaaaaaaaaaaaaaaaaaagattttttcaagtgtgaaaaaccttaaagttgatgaattttagattgcacttctagttataatattagttgctcatgaagtatggggacctcagtgtctggcaggcaagtattacagctctagtgtaacttaaaggatctgctgtgttcaccagggcatgtgagaatcgtctgcaaaatgaatgcacactataagcaagaagaatacagtgaggcgggaccagaatattagatcaagtttgccattctagccttctttagattcttatcctgcacgtaatcatgctgttttgagaggggtcaggcttcaccagccctcacttatctgtgcagccatgaaaatgtttcaggaccaggttactgtctttttttattcagaacttccttggattttaggtgaatttagaattggaattagtttatagttgcagtggtaaaatttactattggcattacgtggatggcagaaaaccttaaaaaaaaaggcctgagtaacagaaatgacaaagtaaaggtaaattccagctagagagtacttatttctccttactcctgtcccatctgtagtaaaccagtaactcaaactattgaaagtataatacgtatatatctttgtgatttgcaagcacccaggtgattctgatagcaataaagtttgggcagcgtggtgctgaagagtgacactgccttcccaaccagcctcagatgaatcccgtcgagtacttcatttgtgaatcccttcttcaatatcattctgcttgggggcctatggaggagcaaaactctgctggaaaactctgatgattctgcctagaaaatgataggtttgtgttccagggggacgtggagatatattacttctaaattctctgatctgttgaccaaatgcggcaaggctaaccgagaaaatcatctggttttaaaagatattcctaaaaaagttgagacagttgcaactaattcttggctgctgcaaagattcctgctgtggaggggacttgaagcagaacatgcccctcactgccctttgtggctgtaattccatcaagggattctggcagcatacacctcagacacagagaatgtttgacttcagagactcctaggtagactgtgaaacattttaggacacgttcgacatgaactccagctttataccctgtttacatttcagagtcatctattaaaggtgggtatgagataatcagtggatacagaaaatctagttctccaagacattaaaatattatgtgccaagacctagatccttctgctgaccaaaatatcgatggcgtgaaagaccgtgccccttgtatattttacacagaagtccatcatactgaaaagtttgttccttttttgcagtgatcacattggccacaagtcccccaacaggaagagttttgctaatggcaggcagcctttaatcttacatcacatagtctgattctgcccttaaggagtcacctgggccttggagaggaggccgtcttctcctttgttgcccaggactgagagacctgctagtgtatcctggcaactgttgtgctcacctcaaggatgacaagtccctcagaactgtgacttttcttatgttgtccacatttcagaggcttctttttcacatgtgccagcaaatgactgcccacagcaagtctcttgttcttttgaggcagtgccactgagcctggagctgtgtgtctggagccttgcgtatccaaggagaaagcgcttgagtggccctgagtcagaaaaagcctttggcgttgcctctcccttttttgtaatagtgcctctttctccctggctgcggttcccttctcagcctcccctgtttggcatgcccattacacccctggcagggtgggcatctctcctctaaggggccacctttgggttcaaatcccagccccattgttatttacttacaatttgggacaagttacataacctccctgggtgtcattctcctcatccgtaaagctggtccaataacaataacaaccacaacaataatattactgcctagggtttgcttttaagaaacctcccacatgctgtccgacaaagtggatgccccgttgctcactgctgttgttctcaggaggctcacaagccatccagcccacccggctggtttttgttttaatcctcttgagatgctgtgagtgggcagcaccatttgggtgagtcatcactcctcattctaggtgggacggcactctaagcacattctgagaaagcaacctccgagcagtactcctcttgtcctggtagaaaagaataggtctcatgatagctccttccgctgggtgggttgtgtaatttgcaacaaggattctaaaaggaagtttaaatcaatcagaggctgtgtatgtggaaacagtgcgattcatgtgctgagatgtttttctacccaggaatagccattaggcactggctttttacgtaagaagcctttgtgagaaggtaaagcatgctcttgttccaaccccttgttagaacttaatctttttcttctccatgcctcacttccccgcccccacataatattcctcttttcattaatttttatggcaattcaacttaatatttccaaatatgcaaatattagaaataaaaatcaacataaaaatatttctatatgagtatgtacacacacacataaaaatatatagtgtaggcattactgagtgctacctgctttcagttgtaaacggacagacagacatatgtttatgccctgcaagaagctccatagcatcttctaaaatgttaatatcacttacaatgtgcttacttactcttagattttatttcttttttcattttcctgagaactgttccttgtagccaaaatgccaattactcactttaaatagagttctaatttcttgtaagtcacaaagaaaaaaaatatgcaatttttcctcttccttttccttcttgagagccaaaaaaggcgtgtctgtgccatttcttctcacgactaaataatgggccctcccacatcccaccagctctgaaccagtacactgaagaaagccactcttttgacattttcctgtgtacagggcaacatttctttatgcagttttattcacattaaccagtactattggccaccttctatgtgctggtcacttcgtggcccaaagtaagacagagtctctgtcttctgtaatccaatcagaagggtcagaaaagcaagtttaccatatagtacaagtagaataggatgagttccataagaaaagataaaagcccatctggaaggagagagtaaggttactggtgagtaaaaggatgttgatatcaagttctgtaagagtcaggtaggaatggagtaaaaaacacgggtggaaaaattttcttaggccagaaggtagagctggttgttatttgtttttcacagaaggagaggcaaaggaataggctagctatcgtactgtgaaatgtttaaataggagcagagagaggtaaaggaggtgcctaccttgatcttggggaattcggacagaaggtattttgcacagaaggtgggagtggagatgaaatttgggacttgaggagagaacctttcttggtcagtgatgacatgtttgctcttggtttatctttcagtctttcaacacaccctgcatgtgttcagcagtctacattattgtttacttttaaagatcgttgagagaatagtgatttcatttttcattacctccctgctgagttttccttcactggcatctctggctttatgtttgagttaacctattctggatccggctgtcttctggtcactggtataaagtagaagtgagtggcaggttgttacagcaatagaatttgatagcagttggagatacctgtgggaattggtcatgagctcgaatagttagcaagctctttcttaggaaatttttacagtcatttaaaggcctttcttgcagtttttattctgacaatgagtcttttcatgaacgttcagattgtctgaagatgtcgcaaaattacaataagacagttgtaagaatgttccgtgattcccagagaactataacattgaatttcctattaaagtcgtgaataagaaagattttgcagagaccagattgtgaatgcaatctcttacacaaaagcattgggtgattcccttttgtctgtgacctccttcctaggtcattcagagcttcaaactcttgctctcagccatccaccttcatgccttgtttctttccttcctactccttacattctggccctagtgggtgactttttgtaaccagcacaaggcattcaccgtcacagccctggggcttcgctctgctttcccctcttgacagcacactttgaacctgattgtttatctggtaaagttcttctcaggctgaactcctcctctgtgaagacttccctacttctctcttacaagcagaattcactccctttctgagacaataccactaatataataggtttgggcttctatcaaggttgtctggttagtcatcagggagcacagagtatttctgagttatacatgcttttccctgttgctttgcacaccctttgttcatttgcatgctacagggcactgctgtgtgtgctcatacttgcttattcttttaggcatatgccatagtattgccctaagtgaagctgggactttaatagtgattctacaagactccatttaatacccaattggtggtctggatgaggctaaaaggaacaacgtttctggactttaagagactttcaaaataggaggggagagggcagtgggtctcataactttccaccctgctccaccatcagactgacacattgttttggccagcatttctcaatctgggtttgccaggaacctagattttcacaatacaaatgtctaggcttcagagcttctaattttgtaggtctggggatgataattaaggtatttcccaagcttggctggtgacttatacagtggactgagaagagttgatctcactgtggctttagccctggctgcacatttgaatcaccgagggaggttttccaaatattgaagcctagtttctacccgtaccatttagatcagattctcaaaaaccagaccactggtcttaggcttctctctgcttttcaccaaaaagcaagatgtagaaaagagcagtaaacagagaggggtgattatattatgggaaaccacagagaagattcagtgtagtcctttttatggcggttatttttgtttctgttttctgattaggaaggagggatggaggataacaatatgaatgcctagaagctaaggacaaagccatttcaggtggaaggattcatacttacgaaggcatagaaatgagcgattacttttcctggtggaaagaccacatatgtggattcatgagggacacccttgcatgaaggacgacagggaggtggtgagtagggaaacccaacatctaggttgaagataatggatttcatgttggagagaataggtagttactttgtttctaagcaaggagtaattttagagataatattgagtttcagtaagatgtcttattgctatggttagggtgaactgaaataaatggtaacacagcagggttttgttcagggccaacttgtgtgataggtgtgacaaggtggctgctttctgttctgcatgtccaatttgataaaccaagatctaccatgggatttgggcaatccatagcttcctgccctctctctactcctgcttctcttgcccttctccacttccatatctctttctctgctaaatatgccattgtcctctatttagggtaaacatctaaaaataggtataaagaaatagaagaaaaataaaaaagtagcaatgatgggcactcacattataaaagatgtaaattgttttagggaagacagaattgtttaaagtatgtatttaaaagcagatatgtgttagatgtttttaaacattttttttaaccttgaaaggaaaagaaaataatgttaaaattttagatctataaaggatatgaatttatgcccaatattgttttaattcaattaggataattattttaaaactggaaaaaggaatcaatattgataatagcaaataatccaaaatcagaaagaatctattaaaaaaactactttctttgaagagtgaagttttctacattcaaataaattataccacagatagtaagagatcctataaatttggtcataggactatgggtcaataatgtctgagaaatagtagaaatgggagagtttctgaaaaattggtggtaagaaaatatccccattcaaaattgggcaagtggccaggcacagtggctcatgccttataatctcagtgctttgggaggctgaggtgggaggataagttgaggccaggagtttgagaccaacctgggcaacatagtgagatcccatatctacaaataaatagataagtcagagatggtgatgtatgcctgtagtcctagctacttgaggcaccgaggtgggagcattgcttgagcctaggaatttgaggctgcagtgagctatgattgcaccactgcactccagcttgagtgacaaaaagagaccctgtctctaaaataaaaattaaaaaaaattgggtaggttaacttacagcttaataagttaatggcaacctctacaaaattatcctaacagtaattaaacagatgttttatgtagaattagaaaagaaaatagtggtcataaagagctagcatgagttccttaaaaataaatgtgtattatgtgtctcatttcatttattggatggggttattatagtgatagctttggaaaattccatagacaacttgtgtctaaatttcagcaatgtatctgataatattttgtgatttccctgtggttaaggtagaaacatatagataggctaaaattaggccaaatcacaaatgttacatcccaccctactccaccctatgtgaatattataaattaattccaagctggagccaggtatctatttgagcaggggtcctgcagttggttctgtgctggttgctatgtttatcaatgacaggtgaatcatacatgaatgcttatcaacttatcaacttgctcttattctcctctgggaaagacagctgagacacatggtgatagaaatcagatttagatatccatagactggaacgatggtcccatatcaactaatataaagattataagtttagaaactgtggcaattagcctttcaccacttgtgctctagggtgttttgtctagatctttgttacttagaaattccaagctgaagctggctgaccatttttcaggattcttcgcagaacaagttgctaagtggcgaggaagcttgaatttgattatttgctaaccctgaaagtctattattctttggaattacttggagaaactgttttatgaaacatatcatcatctcaattgtctatcatacagctaactcacctatctcatccatcaaacttagtttcaaataacttgttgctgttggaataaaatgaaatctatcctcaaaatatgacgactattaacattcagaatcttccaaagagtgcctgcaggttcaggaggcatttccaaaagaggaatcttcaatgctttaaacaagatactggaatctcagttaaataccatttgctattgggagagatgtagtgtgtattttctagggtgacagctttggacagcagcaatttgactgtgtaaaggcttacatatctttctattcctaattttataatgcttaaaatatttttattattgcacattcttgagatcattactagaatttgttgttaatatggcacactttcaattttgattagaacacaaaacatgaaatgttctaaatgtataattagaataaatctgatgcttggttaaaatatttttattgagaagagaatatatagtaggatacaacaaaatatttggaaattataaagggtaataacccaacaaatatctgagtattccctacccattttaataacaaagggtaccatcgtaataacctctgaagtctgttgcttattttccttaatctattcctgagcatccccaataagcttaaatttttcacttattgttcccttgctttttattaacatttaaccaaatatttgtatctttactaatgatagcagcataaaactttcatatagtgatttctatgtgccaagcacttaaatgccatacattcatttaactcaaaagcaatcctcagaagcaggtatccccagccaggcatggtggctcacgcctgtaatccccagcactttgggaggcagaggtgggcggatcacgagatcaagagattgagaccatcctggccaacgtggtgaaaccccgtctctactaaaaatacaaaaactagctgggtgtgttggtgggcgcctgtaatcccagctactcgggaggctgaggcaggagaatcgcttaaacccaggaggcgtaggttgcagtgagccgagattgcaccactgcactccagccaggtgacagagcgagactccgtcttaaaaaaaaaaaaaaaaaaaaaaaaaaaagttggtatccccattttacggatgaggaaatcaagatatatagagattaacccgaattccagttcaggcagtctgactgcaaattctgtgctcttcccctctgttccatgccccctgtcaagaatacatagtatagctctatttgcatttaaaatgttatgtaaatgaaatactactgtgtgcaatctgcaattaacacttttagtcaccactgtgttcttgagtttcatatgttttgttctatgcaactgtagttcatttattttcatttgtaaagagtattatttcattgtatgactatattgcaatgtatttatctgttctgctttcatctgacatttgagttgcctttatatttttctgtaataaatagtgctgatatgatattttaactatcatcttgtgtgtatataccagagattatctagggtgcatatcctggagtataattcctgtgtttatgtgcaccttcaatattcctatagaacagcaagctgttttccatagtgatgaaccatgttgtcctccttgtgacagtatgtaagctctatatcttgccaagaggtaatattgtcacactttaaaatttttgtcagtctgtttagtttaaagtggtagaggaatgatgaggaggaaagaagaaaagggggaggaggaggacggggatgaatttccagttatctgatggatctgaacatgtttttctttttttactgttaatatttggtttctccttttgtaaactacctgttcaaatctttggttcactttttgggggaggatgtttatctttttcttattagtatctattagttgtagaaaacatcttttattttgtggctaatctttttaccttcttcatggtgtttttgatgaacagaattatttaattcaattgaatttataaatattttccttctaggatttctagatttttgtgtgtgtgtgttctatttattaaatacttctgttcactttgattttaaaaagatactttcctgtattatcttctaaaacttacatagttttgtatttcacatttccatttttaatctacctgggatcaaatgtatatatgcttcgaggtataaatacaattttatttaatttttctataaggataagcaattattgtgggaacatttgttgtaaagtgtatcttttctcattattctgtaatgccagttctgtcataaatcaagtttctatgtattttttggtctgtttctgactgtctttgtttcattggtcagtttgtttatttctgtcttaataccacactgtattaattgttaatggattataacaggtcttgatatctgctaatgccttccctacttccaaatctttttcctagggagtcttaactccttttgttctttgttcttccttataaattttagaattagcttgtcaagttccctcaaaagcctgtgggacttttgattgaaattgtatggatccataaatcattcagggagaattgacatcttcaaaatattgagtcttccatggtatgaacacagctttccttttgtttgggttttaatgactttctaatatgtctttaaatattgtctgtacccaattctctcttcaattctctctgttctttttttgaatctctaataaacatgttagatttaccttttttctcttctctatgtctcttaatgctttaataatttatttagatctacattttaatttactattttttctgtttctgtctgctattataacccatttattaattttaatcatgattgtccttattaaaatttatttttgttctttttaaagtatttattcatttgtttatggtctcttctttagtcttagttttaaccccatcttttattttttagcattaatcataattattttatattctatttatgataatttcagttttctggagtttttgctggcttatactcattgattctttttcattctcctgtgtttgtgatttttgatgaggatttcatgtgtcttggtacttttttggaattctttgagacttgggtcttcagagaggatttgatttgcttcttggacatgcagggaaatttatgaagccataagtactttatactaagtatttggattgcagtctgttggataacctagagaacgaaggcatgtaagggctagtgtgtggtcagatatgttggaaagatgtttttccttccatcacttagtgccagtattcaagacgaacatttttcttgtagtctttaagatgagtggaatctttcagatttagtctttcatttttgctgacatcactttagacaatatgccagaagtgtttacatataaatgtatgtatactgttgactgtatgctgactgtatcctctctcctctccctacacacgaaactctgtgactcccagtacccagtggcccataagagaaagaggccctgaaatttaagcttccttagtttcataataaatccatctctgcttaagagtagatgttcattattttatcatatcaagtacactgaagctttaaaaacaaatatttttattatataaagtagtttatagtctcatatttcctgtaaaatgtagtcttctcttttacagttgaggaaaagaagggttggagcagcgaagtgacctgcccagagtcataaagttaatgcgttgaatctggttttctgtccagtccactttccactttacaatgccagtagttctctatttagttataatagatgcctttttcaaaacctttactgtgttttaggaaaaaggtacctttaatatgcttactgaattgcatcttcatggcttctactcgaggtcacttcaaatcctgtttctgtcacctcctcttagtagcctttccctatcaacatcattcccattttctaccacttattcccatcattccattcatagcagatctatatctattagcaataattcatgcatttgcttacttatgtattgtctggtttttcccctgagatcataagctaagcaagaagagggaccatgtgtattttgtttacttccatacaaacagcaattactttgagcctagaacatagtagaagctgaataaaaatattgaatgtctaaaagtctgattctaaaacccatttctttttgctaaatatatttattgaatcggatgtttcctgttatcttagaattacaaccaagttccaaagctgaactaagtatcctacattctaagttttgagagctgccagtggttaaggccagacatctactgggaggactgagatcagaaaattattcctccaaagctgtcacttccactcctgtaaattaatataaagcgagaatgggagagaagatattgcttttttggagtacaatgttaataaagcaagtttaattgcttcctttactctaaatctgccactaagagtagggcgagaggctcaaagagaatattaatccaagttatggttgtctcaaagaagacactacaggtattttaatctccattagaacatatgcttagccaggcttggcgacctggctatctggcagaagagaagaatctgtaaagagacatcttagtggggtactgccaggcaggaataggccacaagttggggtttacttcaagttctggttcgcagaaagtttggaagactgatgccatatctgctgtcaggctcagataattgaaaccttagggataggggtctagtcttgttagtatcctcacaatttggggagatttggaggcaaaaaacaaaacaaaacaaaataattccctgtgtattagaagaatggatcatgacgctaccatcctggtattaactggaagatctaacaagatcttggtcaggatggttgtattagtctgttctcactttgctataaaaaaatacctgagactgggtaatttataaagaaaagaggctcaattgattcatggttctgcaggctgtacaggaagtaaagtggcttctgcttctgaggaggcctcaggaaacttataatcatagcagaaggtgaaggggaaacaggcacatcttatatgaccagagcaggaggaagaaaaagagggtggagaggtgctatgcacttttaaacaaccagttctcacaagaactcactgtcatgatgacagctccaagagggatagtattaacccatgagaaaccacccctgtgatccagtcacctcccaccaggccccacctccaacattgggaattacagttgaacatgagatttggatatgaacacagatccagacatatcaatggtcagtgctgggagagctgtgtgggtcaatggagcgcactaaagctaccatcagtccaagacaataagctcaatgtgccctgatggcttgccaaggccagcgatgctaccaacgttatccaatcagttgaggacactgccttttccttctccttccttcttccaaaatgctagaggaatccgcataggtgaatagaggtacttacgataagcagaccaccccactccctaattcaaagccatttgtaccacaggtctaagggaggagtggtggcatttagaattagaaatgaaaaatgaaatgaacaagatcaaaatgaacaagattgaccagcggaaatcaaatgagactgttaggggagactgttaggaaggatagatttaacatgtcacgactggggaaatagctgttggaaaataaagctctttctcattcataatcagtgaagttgagagtccacattaaactattgaaatagttccctctggaaggtcaataacctaggactggttcttaggagagaattatttaaaataagggtgtttcggcggggtgtggtggctcacgcctgtaatcccagcactatgggaggccgaggtgggtggatcacgaggtcaggagatcgagaccattctggctaacatggtgaaaccccgtctctactaaaaatacaaaaaagtagccaggtatggtggcatgcgcctgtagtcccagctcctcaggaggctgaggcagaagaatcgcttgaacccgggaggcggaggttgcagtgatccaaaattgcaccattgcactccagcctaggctacacagcgagactgtgtctcaaaaaaaaaaataaaaataaaaataaaaaataaaaaatagataaataaaatgaaataaaatgaaataaaataaaatgaaataaaataaaataaaataaaataaaataaaataaggatgttttggtacttcagtataccacccagtctttgatttcctcttcaaggtaaacactgtggtataagacctaacattttgttttaactggaactaaaggccaaacttcatattttcccttggtggtctgcatatttcatctgtgtagctattttaatgtacctagagaacaaggaaaaggaaatacatcaaaagttacagaaaagaggagaccccagtggtttgtatctttgggtaaaaaggccctgtaagggggcattgataaattgtggtataaacaaaccttgatcctggcaatatagtagccaggatctttaaaaaagataaatatttaaatatttatctttaaattatcctttaaattatctttaaaaaagataaatatttctgaatatttgctaatctgggtggtgattccactattaaaattagcatagacctgagttttaatagactagcatgcttggtgcctagtaggaatgcaataaaaattagcttaaaaagatgagtttccaaatgattgttttgtgggctcataaataaagatgcttttaagtgttttattgttttcctcctgaccctctctcagggttatatctttactgcatgttccatatttaatttcatgatcacattgaatatcagagaaataagaaacaagttatgttcatggatactgacctccattgtttaataataatagctatcatttcaataaatatttattatttgtctattaatttacatgcctttttcttttttgtaatttttattaaggtatatttaaatgcaagttatgagttttgcaaatgtgtacagttgtataatctatatatttattaagatatcaaacatttgcatcactccagagagttaacttgtgtgccttcccaatcagccatctcccctccactcagcaaccactgttctgatttctactgcaataggttagtttttcctgttctataactttatgtataatacatatacaatatgttctttctgtgtcccattttttttcactcagaataacgtttctgagattcattcatgttgttggaagtatctgtagttcattcttttttattcctgagtagtatttcactttataaatataccatagtttctttaatccattctcctattgctggacagttgaattgttttctttttctttactaatatgaataaagctgctatgaatatttatatataattttttatatctaggagtgaaatttctgggtcatattgcatatttatgtttaagtgcattaaaaactgtctaatagttgtcaaagtgatttactattttattcttccagcaacaatatatgagagttcttgttgttccacattcttgccaacatttagtgttctctgtctttttattttagtgaaatgaaatcacatttcattttggatttactttacattacccagatagctaaagtattgagcatttttttctgggcttattgggcatatttatctttcttttgtgaagcatccacatagaatttctttcttcatttttgattgatagtcatgctggatataaaattcttggttgacagttactgtttttatttcctttcagcacatataacatatcgtctcactgccttctttctggtctccatattttctgaagaaaccatccattagtatgaaggatgccttgcatgtgatgatttattttcctctagctgctttcaagatactctctttatcttttacttttgacattttgactatgatgtttctagatgtgaaggtctttgagtttatcttagagtttattgagcctgttgaatgtatagattaatatttttcttccccctcaagattgggaattttctgtcatttctttaaatattctttttgcccccttttctcttcctttttcttctggaatatctattatgaatatgctggtatgcttgacggtctgccacaggtctctgaagatctgtttttttcttcatccccttttttttcctgtctctctaattgaacaattacaattcacctatcttcaagctcactgattccttcaactatcagcttcaatctgctgtccagcacctgtagtgaatttttacttcagttttgatatttttaacttcagaatttctatttggctccttttcaatattgtctgtctctttattgatattctctatttgataagacattgctctcatagtatcctttagctccttagacatggtttattttaattatttaaatatttttaatataggtgctgttatttatttatttccccaggctggagtgcagtggcacaatcttggctcactgcaacctccgcctgctgggttcaagtgattctcctgcctcagcctcctgagtagctggaactgcaggtatgtgctgccacactcagctaatttttgtacttttagtagagacggggtttcaacatgttggccaggctggtcacaaactcctgacctcaaatgatctgcctgccttagcctcccaaagtgctggggttacaggtgtgagcgactgtgcctggcctgcaatttttaaaaaatgtctgatcttctccaaaaaaatttttattgacttgctcatttcctgtgtatgcgtgatactttcttgtttctttgcatatctcataaaattttatttaaaacaggaccttttaaataatacaatgtgacaactctggaaatcagatcttctctcacttctctccagtgtttgtttatgttgctgattgtagtattgtcattgctgcttgtttgttgactaattctgtaaagtctattttctatgttgtgtatgactactgaagtctctggttagcttagtggccatctaatgatctaattattggacagatactttcttaaatacctgagtacagtaagtgtccccaattttttcaagtggctctgtatgaattgtggggcatgtcttcaacactcaggaatgtgtaagatggtttacaactttgcattggccatcacttcctgtttgtgtaatgcctcccttttagccagaagtgggacattagggccttctcagatttttcctgagcatgtgtacagtcttatacatggtttggatttgtgtccccacccaaatctcatgtcacattggaggaggggcctggtggaaggtgattggatcacgtgggtggatttcctctttgctgttctcgtgatagtgagtgagttctcatgagatctgatggtttaaaagtgtatggcacttcccccttctccctctctctcctgctgctatgtgaagaaagtgcttgttttcccttccgccgtgatcgtaagtttccggagaccttccagtcatgcttcctgttaaacctgcagaactgtgagtcaattaaacctcttttttttcataaattacccactctcaggtagttctttatagcagtgtgagaacagtcttccacctgtgcatggtcttctaaatttttaggaatacgttgaagctttctgaaacaacatatgtgtacagcttaattccagtttttccttttaagatttttgcttagtttcttatttgccccagttgttatcatcatcttaggccactatggtgttaaaaattcataactgattgttttcaacaaatgccgctggtgaaagtgctgagtggagtctgagccaggttgaagaaaaacaagccatggaatgggggttttcagagaatgtcagacatggcacattacgacagttgtctgagcatagttttttgggaagctccaaatgtattttgccctttccagtggctgctaggctgctggtttttactgggatcaaggagctgttggttttcagtgctactatggagctgagagataaggatggggatagggcaacttaaaatgccacaaaaatcactgttcttattgaggtttagttatttttcgtgaccaaatgcttctcagattgttgcaggatttcttgaaaaataatctcaagagttctgaggaaaatgattttgcccattattgccgttgtttttactgcttttgtggaggagcagctttccaggggtatggctctgctattcctgctagaagcacagaaataggaaggaggtgctgagtaagtagaagtattgcttgacatgtcttttacttcttttgataagtagatgttaattttgatgtagttgaattcatgaatttcttcttttatggttagaagtttctgcatcctatcttgaaaaaaatcattgccaactccaaggtcattcagttttttaaaatgctttcttttagaagctttatagttttaacttttaggtttctatctgtgatccttcttgatgtattatctgtataatgtgagatagggtcaatattattttttcccatgtgaataacctttttttcctagcatcttgtcttgaaaagaccttctctccattggattgtttcaatacctctgttgaagctgtacatgtgggggttatatttgaatctctgttcttttcaattgatcaaatgtcaattctttctttaatagcacatgttctggatttctatagctttataatacgtctagaaattgggtagtgaaagtcttccctccaactttttcttttttatcgaggttatttggctattttatgttttttttattgctatatacattttttaaatcacctggatttggatagagattgtgttgattttaagtatcagtttgggaagttttgatatcttaatgttagtagtactgatctttcaatacacaaatatggtatgtttatttacatctttaatttttatcagtgatgttttatagttttcagtgtaaggtcttacaaatattttattgtatctgtcctttaataatgcatgttttttagtgctattgttaacagtatttttaaatttttattttttaatttgtggttgcatatatacagaaatacagttgacttttgtatatagtgtctgtacactatgactccaaacttactcattctgtagaatgagttgatttttgcagattagttggaatttcaagtaatcatgacatttgcaaatgaagataattttactttttccttcccaatatgtatgcctttattattattattaactttattttccctctctttttacactggctagaacttccattacaatgttgaataaaagtggtgagggcagactcccagatttgtttgaatgttagggagatgatactcagttctgtaccattatgtatgatgttacttatagatttttcatatgtattctttatcagactgaggactttttttttcctcatcaattttttttttctgcaagtaggcctgcaggatacatgtgaagtattagagtctagttaatgatgagttagttgctagtgaggtaggggaaattaaaagaacaagtatatctgcaggccgaactggataggatgaacaaaggccatatgataggaatatagacaagctgggctggatgaagaaacctgacttctctttgtggctctgccaccaacttcctattaaaccttaaagaaggcactttattttatttatttatttatttatttatttatttatttatttatttatttgagacggagcttcgctcttgtcgcccaggctggagtgcagtggcgccatctcagctcactccaacttctgcctcccaggttcaagcaattctcctgcctcagcctcccaagtagctgggattataggctcccgccaccatgcctggctagtttttgtatttttagtagagaagaggtttcaccatgttggccaggctggtctcaaactcctgaactcaggtgatccacctgccttggcctcccaaagtgctgggattacaggcataagccactgcgctctgccatggcactttattttttacctagcactaaaagatatagctgagagccaggttggtatcagaaagaatttggtagagttgcaaaagtgattttaaaatttgaaaaataagaaatgtgagaagagattgataaggctagacttcctttatctgctatgaaaaaggctgagatttaaattttttgatactactttcagttcactgcaccaagacaaccattcatctgtctctgggtaccttcacatcccttttctccaaaaccacacgcccttggtttctttagctatattgcaggtcttgagatcaggtaatgctgtgttccccagctctacttttaagtaattattttgctaaagtatcttcacctgaatcatctgggatgacttctgtttccttccaggaccttcacctcactgatacaactggcactgatacaccctggcagtgtgtctcctcaacacataggtgtgctctggggtctttgtaggcttaaccattgtgcctaggcctgacatcgaagtaggtagttaggtctttgcctgtcaccacagacatcccattatatctatggcactctgaattacagcttaggaaaataattttaactactttgaatgtcatttgactccattccttagggtcatgcaggattttttcatttttatgagtcccttctgagaacacagatagccttatgagggacagttgccttcagttgacagccttgtgtgggggttgtctagtcagcgataccatcagttttgcaagactgtggttgtgacagtataggcgtccaggtgaaattgaagggggaagggaccaagtgtgctagcatcgaaatggggagtgggatgctaatgatacacttttcttgttgtcagttttactgggaacagccctgtggaaatttaaatcctttcccctaaaatttctttgaagtcccaaaaggcttatgttcttaaggttatttctgttcccaggctaatgcttttcctaaatttgttcaattctggattatctttttatctcagtaggcaaaatctattctgtattcattgacctggatataaaattcagccccttctccaatttccatattcattagacctcactgcctttaaggcaaaaagtagacttccctgaaggtacaagtccaggtgggaaatatggaggagacaaaggaggcatttccatgacagtgtgcaacaacttccaattgagcattagactgtgttcttaacatgctctttatttaccccataccagggcatttgcctgtatgtttatgccccctctcaatcctaaaatcctaacccccaaggtgatggtatcaggaagtggggccttttgagaggtgaataggtcatgagggtggagtctgcatgagtgggattagtgtccctttaaaagagacctaagcaagcacatttgcctcttcctccatgtgaagatccagtgaaatgacaccttctatgaccaggaagtagaccctcaccggacattgaatctgctggcaccttgatcttgggttctccaacctccagaactgtgagaaataaatgtctgttgttcataagcctcccagtttatggtgctttgttagagcagcccaaacagactaagatagcatttcatggacagcatttagtccattgcatgccctggtattataccatcttgtggatccttcccttcctttctattgtgtggcccttctctctcccttcctttcagagcgaatacagagtgagagagcctttggagccagacatctgggctccagtcttggttttatcactgattcactgtatggcttacctaaattacttaaactttctaatatcaatcgtcccattcataaaatgggcatagcaaaacgatccatttcataaacttgctatgcatatttgaggtgtgctgtggtttgctgcccacagggcttctcagaaccaaggtactcatttcaccgctgctgggagtgttggctgctgctggtccacatctgagccccttccgaggtattgtctctgacacaagaagatctctgccatggttatactctccccaggggctgcctgtactcaaagactggttgatgtaaagtttgagagtcttgttcttttaccttaaattggggcaatccagctccagaacttcttgtgaggccaactgaggcttccgttacaactatctcatagtccagcttctcactctgctaatcctgcctcctttaatccctgacaagcattcttcagtaaacctcttgaaaacttctgtctgagagtctgtttccaatcagaaagaaagtgggtaaaagaatttccaatgcatactgggtacccaagaaattattattattgctttgaaggtaagataatttatttcaaggtattttccaggatatggatctatctatatatctatctatctggagatatatatatatatatatttggagttatatctatatctatatctatatatatctggagttatatatatctctctatatagatatctgtctggagatatatatagatatctatatatatctgtatctatctatctgtctgtttatctatctatagctatctatctggagatctggagagatatctatatatatatagctatctccagatagatagatagatagctatatatacatatagatatagatatataaagctacataaggaattctaattaatagtttgaaccatgagtagtgagaataaaattattctaaattttgacaagggaaattgttattgttttattttttaagatgttattttactggagcatattctaattagtctcctccaataaaagcagaatctttttatttagtaattgactctcatctgatactcttgggtactataattttgttgtttctgtatatttgagtattatcaataatccaaaactgatagaggtgctgatagtttatatttctggaaggctagaagataacctgtgaaaagctgatgttttatgattttatagaccgaaagagaagttaatgccacagaggttaagatcttattcactgatagagtgtaaactactcttatatctaatttagcagtctttttaggcatttctttcccgacttttatcaatctcaatttcttatttatactttgactttgcatttgtcttctctacttgttactttactagtgagttaaataaaacttggtcagatgctcactactatgtataagagaatgatgtttttcatgggaatgtgtttctgtttaagtattattagtttataaagggtagcattattatgggaaggcatccaaggtttcatgggggcaactggaaaagagaagtcagcattttgaagttagccaaaccctatcatgctaaattcaaactttgggtgtggttttgaagtatgtgtatttgctagggttgccataacaaagtaccacacattgagtggtttaaacaaccaaaatgtattgtctcacagttctggaggctgaaagtctatgatcaaaatgtcggcagggttggttctctctgagggctgtgagggagaatctctcccctagctgctggtggttgctggcaatcttcagtgttccttggctcatagaaccatcacccagatctctgccttcatcttcacatggctttctccctatgtgtgtgtctgggtccaaatctcccctttttataaagacacagtcatattaggttaggggcctgtcctaatgacctcagcttaacttgatgacctctgtaaagaccctatcttaaaatacggttaccttctgaggtactaggaattgggacttcaacatgggaactttggggtgacacagttcagcccataacagcatgattattttttctccattctcaaggattactttttccctcaagtgataccataaggagaagaatgtcattaactctggagagaatctcagtgaagtcatcttaccatgttttaaaatgaggtttgttgccacatcccacgccaagcccgtaccagtgttgccttatggatgtggttaggaaagttacacttgggaattaaatcctgtctgagaaatgagttcacaagttctcaggggcattcagctgccaggccatttttacacattaagcaaaaaaaaaaaaaaaaaaaaaaaaaaaaaaaagtcttttgggcattgcatttatttacatgaatataataaatacttccaatggcatttggattgcacatttgcatgtgtttaatatgatggtaaatctgtctgaggaaagtgtgcggtgctttctgattttgtattaggaagatgggttaggcagggaagaagaatgattcctttggcaaccgtggaattatttactgactagaagaggaaatcttctgtttgaataacccctttgaactgcctgacacgtggtggaagtttgtcaaatgtttgttgaatgaacagaagtgtccagggaacttagactgttttgagagcaatcaaaaagcacatatttattcagagatttaccatgtacctagctttggctggtgctgtgggggcccgctgatgtgtgtacgaacaataatagcagcaactatcgattgtgcttactctgtgccaagcatcctgcccaatttttttccactattctctgagttaggcgctatttttattttacgtataaggaaactgaggctaaaagacatcaagctatctgactacataaccattaattggtaaggtaaggtgtgtgcttaacttctgcactccagtgcctagtaaacatgtcctcttgctggtagaagtttgcattcttgttctagagacaggaaatttataattaaggcaattagagaagtagtatagaaaaggtgaattttatagtacgtctggtttgctatgtatatgtgtactgtcagcattttataaaagtgtcaggttgtgaaatggttaagtatataccttctggagttagatgcctccattcaaatcttactcggacctcttcttacctgtgtgttgttagacatggagcttacgtgttctccataagctccatggagaacatctattataaaaaaatgggaaatttattatgaaatagggatcataccttattattgtgagggatacgtaaaatatgtaaaaagattcagtgcctggcaaaatgtattttctgttcaaatgtaagcttctcaaaggcagcagtgattggggtctgttttatttgttcttgtaacctacacatttagaacagtgcttggcataaaatagacattcggtaaatacattgttgaatggatatatttcaatatgtaaaggcctgggcttagtcacattacagacaatgaagtagtcagatgtttgcacatctgtgtggaacagtggttcctagccaggatacacattagaaatacctggagggctttgaatggactcattcttaaaccccatggtaggcaaaggttgagtaccaatgttggagaatcactgtgaaggtaacaaacgtagaataatagttgtatattatgttgaagattcaataccaaaagtgattttttgagtgactcaatgggatgagtttcttaggaaacaaaacacaacctttggttcaatagtaattacatctttcaacatttcaatgtacattaaaataatcaaaaagtactttgagttcatatataatatgaagtaggatttaggctcaaataattacgcacagtttgttccctgacataaatcagaggtgaagtttgtgcggggcttgggacaatttttttattgcgtggactatcctttacattgtaggcagcttgtctaagtcagccaaaaagcactgtgagctgctttgaagacaagcaaagttagtgcccatatggtataagaaaaaagacaacaacacactaggtgattaagaactctcttggggaatcaaaccaagacactgagtaacttcttagacagctggttccttttctagaacaacaggatgagttcaccagtctctaatgtgtcaatctttaggaggtgttctgggtaagagacttcctgattctctggtgcttttctgctctgcaagaagaatcctgattctgttctcacgtgcagcatcacccagagagggagctggcaagatgaggatagatagaaaacgggagccacataaacctacaatcagactgaaactggaaccagaggaaattgagagaaatttgcaaagtgggtaattagaaaagggtatctctggcttatttgcatgttttccataaattttttttttttttttttgagacggagtctcgctgtcgcccaggctggagtgcagtggcacgatctccgctcactgcaggctccgccccctggggttcatgccattctctttcctcagcctcctaagtagctgggactacaggcgcccgccacctcgcccggctaattttttgtatttttagtagagatggggtttcaccgtgttagccaggatggtctcaatctcctgaccttgtgatctgcccgcctcggcctcccaaagtgctgggattacaggcgtgagccaccgtgcccggccttccataaatttttaaatttctatttatgaagagtatatgccacatgtttcattaaacacattgtaaaaatattaacactatcatatgccctttacgaatgtggcaaagggattccattttaatgttgaccacacaaagccgttttgatgtttcttaggcttcttaacactggattctaccttatttgcatttatttttaaagagctgctatgaaggatttctgactctctcaggcaagaatatcactgaaatgtaaggcatgggatataattcaaatcatcctaatcagatttctcaacccttgatctaatcagcaagctgtttttcttagcttcttggtcaagttcattcattaactcagaaagcatttcttgaatatagactgtgtctaccccagggctggaatgtaattaagattagtagatggattgagccctgtcctttaggagtttatagtcttattgaatgaagtgaagaaaataatatgatgctacttaaaatgtataatggcttttatattttaaatatattagaggtctttcaggtaattgatattaactgtgatgttgtattattgaaactgcattataggatattttcttttcatatctatttcacagttaatatcacagttcttttcaaagaagcatttgtgattatagccatctcctatgaagcgttgttgtgaaattaatagaaagaatcattggcatttcatggttttgctgaccgtgggcttgagaggattctgagcagaaggaaagaacaagttgaaaccccattgatttttttttaataggagcaaattgcagcataaaactactgccccctcatcccactcccaaccacacaccaagttctactagactcttaaattcgtcatctaccagcaagataaattcaaatagaaaaataactttcgctaacttatatttgaggtctgagatataataaaactattttcttattttggaagaaaatgtgtatgcatgtatgaattattggagaaaaggattttctcccatggttatttaaaagaatggaaagttctaatcagaagttatttcgtacaccctgttgtacctaaatatattttttctatttgtatgtccttttgtgagggcaattagagttacaaactggcagccactttcatgttttttacttatttttttctcctaattaatgtttatgtgtgtagacataaaaccaaccttaaatttgtatccacaaagagaaataagtgatcaacaaaaaggccttacttgtttctattcccaggctagaaaagagtgtgatttgactgtaatttctttcagggttaaatgtttgtatgtctctttatcatatagccacattatctttcatagacacacgtggcttgcatccttgaatcctaatttgattatttcagcaattggctcctcctggcagtcctaattaggaagagtaaccgggttttggcggtcagagtctacaagttctgatgagttaaactcatttgccctgtggtttctactggtgcctgacagtagcgttttgtttcctctcttaaaaaaatttttttgtatcaaaactgtctgggacagttaatgaaaaaatgaaagatctgtgtttttctcattaaaccaagatttagaaattcttcagccattctaagagtttgcacttgggtgtggtttggtattttttgtaaggacacttaatttaggttgtggtgactgttaaggaatcaaatgtagaacctgtgtattctgactcttcagagatctgattttcttatgaggaaaactgtagctcagagtccccatacagagcccttcaaagccagagaaaatcctaataaaaatgctaaagaagttccttcaacataggtggaggaaaactgttttgagatgaaagatcactgtataagattcttccactgttactttcttattgctcgatgatatggaatatgctttggggtgaggggccaaaattgatgttgctaattatttgccttggtgaaagtgaggaacgagaatattgtgtcatcattaaaggcctccatcttcataatgaccctttcggggattatataaagcaagtaaattgtctgttacccagtgggagcttttgaaagtaggctaccagcaagctcgatgtgatcgcttctaactactgaagacctaccccctatatctgggacttcctgtataggaatacaagaggcttaaaaaaaaaaaaaaaaaaaaaaacccaaaggtctagacacttgctgagctctctgacatacttggtaattgattaatggttgcacaatcctggattcttactggcttctactcagtgtttcctcaggcttgggggctactgttcatcttgctcaactttacaaattattttttggagggagtttgcagaggtcgctgagcaggatgaaaagattacctgcccttcagggttcaagaaagcttttaaattctgttcctattccttcccgtttatatggggcaagtttcttttcctttggggactcatttgtgatgggagtcaccacagatctggccatcactgctttccttttctccattccactgtctggagctttgttcctctgtgtagtccaaggggttgagaagtctgaggatctgggcctttctggggatccagggtatctgcaggcctcatctcagagatggcagattcttactgcagtgttcaggtcatatgagattagctgaagacagccaaatgaagataaagtaaataatgcaattgctgatgttttctttagagctccccttgatgggctttggaaagttgtggtcccagctgcttaaatgtacatgctcccacagagcaaagtctaagaactttagtgcacagaagagaaccttaggagtgtgtgtaaatgcagcttcctgtgcctcaccctccaactgattcaggactcagagttgcagcatcacaagaccctcctgattctatttcaggtacttctcagaccacacttagatattattataggggaaaagcccctctcccttctagggagtgacttagttcaatcacaaatcagcgctcatgtttaagctctagacccttgtgagacattttttgggaggccattcagaaattgaacttccacggttcctgatgatcccacagatctccctaggtgatctctgctttttttttcttcttcttgctgttcttattctcaccactatgctctaaccgttcttcccttccctttgctcagcaatgatcatatttgctttgctaaagtagcccctcttgtttcatttctttgcagaccaagatcagggctgactatctcaacctctcccaattcataccctcctttctgacgtgaattctgttatgttccactcaacaaatctaaaatctaattagtgtttttaggctttatcttactgtgggtcttggtaagttattgaatgtgcaatttcttggcagatgcaaagcagtcttttcccatttagaacctcaaactcatgtagtcctctgcaggggtaaggaggatagggaaaggatgatattctcgagaggaaagcaaaataacagtgaactttcagctgtaaccagcttggagaatgctttgctggaaaatggaggaatttcagtaggagacctcatgagcccatttttcttgcttttagtcgctggcaatcttaaagttgttcaagtatggtggctgcccaaaccctaggtctttttccataaatgaagagtcaagacctttgctctttccctctactctgaatagaggattatattttaatttttggttctgaagcactatttccccacagtggtccccttgacctccctgtcttttgggacctgccaccctctttggacaccatgcactttagagaggtatattccaatactttggtaaagattttcagatgtggaagaggctaactcaggcattgtttctaccccatgggaaattttgagctctgtatgagattctgatgttggtttttctttgtttttgtttttgtttttcttcttgctgcaggaaagcaatctcccgggcaggcctccagcatctggctcctgcacatcccctcagccttcctgtggcaaatggtccagccaaggagcccagagcgactttggactggagtgtaggtgttggccttttcatttaaacatcacttcagtgcatgttttgtgtctctcattctcaggattcctctagttacaaggaagacttgcttaataattttcaacattgcctgctgacctgtcctcagataccttagctgtagctccattttcaaactcctatgaacatcactcctttatatgaagtcagatgtgttcaagactaagataaaagcttcctgaatcatttgaagtattactgcagctgtaagattaaaaagtacctcgtgcgcagtctttattggtttctgccaagttgacgatgaattgagcttacccttagtgcaacatctcgcaatctaagttttgatttcctcagcttgagctgagtttttctgggtgctttttttcccagaggattacaggcacttcatgtcattctattgcttttccttcctcccttaaccaaaggcagatgggtctggcatcagtaggttgggtatatgagctgatgttaacattttaaccataacacactcacaaaaactattaacttgacttgaagattatagtctgaaactctttagttgattaaacacatttattgagagtcttcagtgagtcgagttcttggccgagtaactgtttctaactgtagacccaaaggctttgtcccttcctgaagcaatatgaggaaaaggtatcaagggagagaagggcttccctgaagttctgccagccttccctgatgatgaaccttgtttagcacttttagttgagtctgaatagaagggataatccatgttctttttctccatatgaaagagaaaggtggggtgggggaaaggtaacccatgccatgatttgatatcctctgtattatagcatttcttcctctcctctcagcacacacttattaatatccttattttacatcttggatgcataccaatgtaaatgctgcccacatttatgaagtgcctggcaaaagactggatgtgcttgaactacagcttctcccttggtggagatattgttaccctgagagtgttcagatgctgcctgagcctgttgaattggtgtatagaaagaatattcctttcctggagtttacttctttattccaggacagctatttaataaactcttaacccacaatagagtatatttgcaccagtgtttgcataattaaaaacaattaaatgcataaacataaataaaacctaagagaggtatgcatggagcaatgatgagagtgtattatgtatcaaggaaccgaaagagttggtttgatattcacgatgttccaaacaaccctgtagtctgcagcagcagggccttctttgaggtgagacattccaggggtagtttaatcatttagaggcgaacattcattaaatcccttctctgcccttttgtgtgacattaggtaagtcactgatttctttcagcttcaacgtcctcatctgtagatggggataatcatggccctatttcatggacattgttaggatcgaatgtgacaataagtgaaaaagttttttttgtaaactgtgcagccagcagatttatttgttaaagtaattgatgaattcattaattcatcaaacatttgttgagttcctgctttgtactagaatctatattggttacttgggattctgaggtgaagaagatacggtttctgccttcaagggtcttagaatcctgtgggcagaaaggaaatcaacacgaaaatacagggaaatgaggacgtcactggaatgcaacaaaaggacattccattcccatttgatgttggaaatagttatcagaaaatgctttttaaaagaagtgtcctgcctgagccagagcttggcacaaggtattattttctgattcctatagagaggtatgtactctaatatttcatcaaaatggtatttttggccagtggtgggaggctgcagtacagaatgagggaaaaacaaataggaatgaaggctgggtttgtgcctagtgatcttttatccctccctcttctccccttttctttgattttaggtaccccatcttggaggtctgttgaaagtatggcatgacacgaaacacttagctgacatctaacaatggtgggaaaaccgaaagcccttccttgagacagtccatctgagggcttagagatctgatgtgtaaggagttatgagatgttactctggaaaaaaaccaacatctttgtgggctgattttggtgtcagcaaacagaaagcaaaccgtgaccaacacactacactcatttattacaatcgtgtaaagcatttgtttcagaaaagaggaaaaagccgattgttaaaaatatttcagtgactttttctttggctaaaactagattacttgtattactttagtatgctcttctgttcaaggagccagccagggatttctttgttctgtttaaggtgcaaaaacagtcacctctctgtgccattccctctcctccactctcttgtttgattccctcatcttctaccattagtctactcttctggactcaatgtatggaaatgagcaatctttatttaattcagtattactatttattgagcaatgaaaagggttggagcctctttgattctttcaaataaaaaggaaggtggcaggagcttataaaaaaggtagggggaactccagtctcttgcctttgataaggtagagggccccaatagtgctaagttgtgcttctgaaggtcttgaccacagtggcagatggggtccagcagggacgacgagggtcctgttgttccctttccccacttgactcttgggtggaaattctctctgctctgtaacactttggctcaggggaatcaatgggggtcatctcaaaggcgtctactactatgattctctggcttctgttactctattcttcttccttcatctgtaaggaaaaagattaaaaaaaacgttcatggtgtgtctgaagttgcaaagtcagagtgaacctggagttaggatcttagtccccaagtttctacttattgtggaatcccaaaagggccgtgttctgacactagcctatgtgccaaagtcatctgaagggacacaagtatttcctaaatatactttggcaaaaggctttgaggagaagtctgtttgtggggtgcctgagatacaggtgagcactgatttagtgcgcatagactataggcacctgcacttcttggccaggagggtgctgttatagcagacagtttttatgctttgggtacattaacttaatacttctctttaagcattccatttttatgttctcatttccttgtttgtgatatatacagtctctctctcttagttttaggttgtttctcaaaatcccaaacattctctcctgctgtgttttactcaaatggcttattatgacttttaggattctctgtcccacatgggctcattctttgaagatttttcggcaatagatatttactgaggctgcctgtgcacagtcattttcctccgtgcatgtcagggatagaacctgcagtggtgtgtggagagtatctggatcagtcttcagtatgatgcctgagtcttctattgacagcagtggacactgggctctacccagtatgaaaattatttcctctagagattttctcttttgctgtctgccaagccatgctcatcttttcaatcaaactgattctatgtatctgatgtagtctttgctttgtatcctcacaacacctctctgttggtagtgcattgtcttacaaaccttagaaccaaattagtgctttttgtttgactttcttatttgtggctgtcagatttcaggctgcttaaaaggaggggcaatgttttctgcttgttttctcttcacagtggagagtgcagcatcatagacctagtagctgcttggttactgatgtcaggggatgaattgattacagtttttctgctcaatcagtgagaaggggatatttcgctgggagttgacaggcactcagataatctctagttcctgaaaggcttggtaggcatgactccaaagtctgcttgaaaaataaatggatttatgccgttttaatcccaagtaactgtctttaaatttccttcctaattcaatgcattgtgttagattttaaggcgcacacagtactttggccttcctactcttcacaaggacatcatcttttcacttccacagtgacagcctgcagcagctgccccctctgacactggatgatgcctgtcagccaagccagttggggtaaaacaagttaaattactagaaaggaaggaagtaatgcctaagaaggaaaaaatattctcatctcctgggatggattccaagttcccagtttagagtgaattagtccatttagaagcatgtctgttccacagataatgtgtatcttcttttaaatgtcacatgtctcccttccaatggagacttcatttggacttccagcactcttccctgtttgtagtactgcagcagagagcccaggaagtgtgtctcccatctgtccccaccatttcataatttgtttttgcccattacactgcctaaaacaaccccctgaacagtggtggaaaagccaccaagatctttcttaaagggcacattggttttaaacccagcacccttgattttattttgttttccttcctcattggcaaactttcttcggtcccaagagctgtggaaaacagagcctcaacacaaacaaagccagatcttcagtccgaaccacctttcctttcctttcctttagttgacgatgctaagaaacactttctctgaggcagatagaaacatcacacagttggtgcactgcctcacagtttggttcagggacaagattaaggaaccagagtcttcatgtgggattggtttaaactgggttatgaaactaggtcatcttatctttagaaaccttgaatgaaaagccagaaggaggcagggctgtgtgtgtgcatgcgtgtttgtgcgtgcgtgctcgtccgtgtgcatgttctcatttcagtcctgtttcctgtgagtcctaggagacctggaccttaattttgggcgtcaggcccccctcttcatcaggtctgagtgtcatcacccacagccccacatctttccccactcccagccccatttcgaaaaactgaagtcagattaatcgataaatgagactgtttgttgagcagcgcataaggaactactcactataaatcagtgaagatcccagtcctggtcagccacgtaaatgaagggacaaatcgaccttaatttcagggactctcaccattcctttattttctgagaacgggggagtttttaaatcaaatcaccctggctgccgagggaaatcatggaattctgtaacttcacagacctgtgagaagtgtctcggtctaatcttctgccccgaggcaagtgattatctaaacaaacgctgtccagtagaaatagatatgagctgtaatgatacattttctagtagccacactttaaaaagtgagaagaaataggtaagattatttttaattccatattttgtttaagcaaatatattcaaaatattatttcaacatgtaatcaacataaaaattattagggagatgttttacattcttttctcacactaaatcttcaaaatctgctgtgaattgttcaaagagaagcacatctcagttagtgctaaccacattttaagtcctcagtagccatctgcgtattgtacagcacaaatctaaaacatccaacatggtgtgttatcaattcttgtcctgaagattttcaaggggaggcaatccactctttttcctttttgattttgtaaggacatttacataggatacatatttataattctcattgtttcaaaacatttttataagcaagcgtcttcattttgtgtggagtatttgcttcttgtgtgagcatactctttatctgtgttattcagtctcaaacactcacctcacctttgtctttttgcctgtaaccattactagaatttcggtagcacttgagcaagaaaacatgcctatatctagaaatctgtatttatgtctatttaggtgaatctccactcttagatgaatagatctatcgatgtaaatctatcaatgtaaatatatatatagctatacagacttgtgagtctcagcactcacaagtacagaagaagtgctatctttgtttagaaataggagagttatttttctgtctggcacagatggagactctttgagttgtatactatttgagatggtatttcgagatgcatgtgtagagaagagagaaagatgtttccaggtagggacagtagaatgaacaaaaacgtggcaccaaaaagggaaatgcgaggtatgtttcaagaagagtgacagggagcccagtgtgttggcatatgcctgtaatgcagctactcaggaggctgaggtgggaggattgcttgaatccagcagtttgaggctgcagtgagctgtggtgatgccattgcagtccagcctgggcaacagagcaaggccctgtctcaaaaacaaacaaacaaacaaacaaacacaaacaaaaagagtgacaaggataaaagagtgacaaggataaaagagtgattgatgctgttattggagtctagtatgccaggttgaatttggattttattttataaatagggaaacatctaagcattctgaacaagggagaggcacaatcatggctctcttttggcggaaactaaatttatactaacgttaaataaatcggagagggtgtcagagttcagagcagaagaaaacaagactccgaaattagatgcactgtccagcgtatagtaagtaattgggggtatattcagataatgaaaagaaacctagacaaaaataaaagcaaagggaagaggcctgcatttgctggggtaaatgaggctctgcagcaaatgaaagactcaaatgtataatggcttaatacaagagagtgtctcacctatgtcatagaccaagactattccaggtggttggctgggtagtcaggccctttctcacatagctattcagtgacccatgctgaggatcactctgacatctcaccaagaggattccaaaagcctgacttcccaattgaccagtaagacaaaaaatcatggaggaatgtatgtgggaggatttaatggaacaagtctggaatttctgctctgtttcactgttcagaatttggccacacctaattgcaagagagactggggaaataaagtctaactatgtgtccaggaaaaggagaaataattattttgaggactggctagcagtcttggccacaaagaccaaggagagaaacgtagttaatgctaacatctgtggattgggaggaagaagggaaactagagagtaatagcaacaataataaatataatgaacatctattaacttcttgttttatgcggaacattgggctttatgcatttttatgtttaaacatcattgtagtcctgtaagggaggtacagtgatttttatgtgactgatgagtaaaatagggtctaggaaagtgagaagggccctgagtcatacaactattgggcaataagtctgactccaaagctcacattgattaatatggagctggagacgggttcctgagaattgtaggaagaaaacaaaaatagttcatttgtctactgcattcttgtgctaatgccacccaggctagacaactttatgcaggattcaagagtccccaagactaccctgtcttctgacatcagttgcaagttcgggacccccaagaccacactcagcttcagtaactcactagaaacactcatagaactccctgaaagctgttaatactcacatttgtggtttattacagtcctttccacgtagaatcatggttcactagctaacttctcccagcaaccatgtgctataatatacatggcatagagccaagcagggaagctcattcgaaccttgatgtccagagttttaagtgggggttggtcctgtagacagcgttgactgcccatttggttgacaatagcctctagcccctctgggggtcaagctgataccttatggcccaaggccgccagacaaacaaaaacacttttatcaggcaggactttccatgggcttagagattactttcttggagctgaaagctcattgctttatcagtaggttttgacattttacccactgctacattttggacttcactttctaaagtagttagtgggattttgctgtggtttccctcatattggctgctgttattatgcatctagttccatcttctctggtagatttttctccattgattaacacagaatctcagtgcctggcaccagtgttatcgaataaagaattgttgaataaattaaagaataacaaaatgaaaaggcattattctgtataaatggttataacttagagttggagaaaagttcccagtagtagaatattttaggttgtgtggattgatgtcttcaggataccttgcgaagaagtgcctttctactttttttaaagtgttgtcatcatccatcactatctgaaaacttttagggtctgaacccatagctatgcttctcttgcatctgctgttgtcccacaaggttgactgtgaggtgaagcctattttcccattgacttccttgaaaaaattgaacttgcaacagggaaaaattaccagtagagaagaaaaagttttggtgaacaggtgtccaccctttgatgtagagggcaatgatcctggtcagtgttgctctccctttaggaatggttttgaggcactgggagatgtggatggtgcactcctaccaccagggtctccctgtgcgttgtcctgaagcccttgacatctatatccctagtgactttcacattctcttgtcccttcctgcctcacttctgtggtccaggacttggacccacctttcttggatcctgaagcacctacatcacatgtcacaatacaaattttggttgttcttaccccagaattatttgagtcactaggccctgaaaggaaaatgtgttctatctgaatctgaagaaatacgtttattttaaaagatgggtgacacttggtattttttcccagcaaatgtcatttagtgtatattccttttttttttctcttttcttttgagtcagaatattgatccattgcccagactggagtgcaatggcacaatctcagctcactgcaacctctgcctcctgggtttcaagcaattctcttgcctcaggctcctgagtagctgggattacaggtgcctgccaccatgcctggcaaatttttgtatgtttagtagagatggggtttcaccatgttgtccaggctggtctcaagctcctggcctcaagtgatttgcctgcctcagcctcctgaagcgctgggattacaggcatgagccactgctcctggccatttggtatatatttctgctttgctgtactaagctttgagattcaaagggctatcgtgtggacactgctggagtaggttataataaaagtggctcatgtataagatgggttttcattacatgattattctatagaatttcttattgaagtcatctgctcaggctgctataacaaaatggcagacttgttagcttaaacaacagacttcatttcccacagttctggtggctgggaagtccaaggtcaaggtgctggcagattccagtcctgggtagaatcctcttcctcacttgcagacagctgctttcttgccgtgtgctcacatggctttttccttggtgtgtgcatgaggggaatctcccatgtgtctcttctataaggacactaatcccattatgagggctccacccccatgaactcattacttcccaaagtctcatctccacattctgtcacattgagggtgagggattcaacattggaatttttttttttttttttttttttgagatggagtctcactctgtcgcccaggctggagtgcagtggcatgatcttggctcactgcagcctccacctcccaggttcaagtgattctcctgcctcagcctcctgaatagctgggattaacaggcgcccaccaccacacccagctaatttttgtatttttttagttgagatgaggtttcaccatgttggccaggctggtctcaaactcctgacttcaagtgttctgcccacctcggcctcccaaagtgctgggattacaggtgtgagccaccgtgtctggccaacatatgatttttgaggagacacagtttagtccatagtatcccccataaaaaataattacatgcccatgtacatctgatgaataaaataaaaacaagagtaattttcctgtaagccatggagacttagtcttgtttctttatggttaatctaatacaatactttccctaacagctcagagctccttttaagcaaatgagcaaaatatacaattaatatataaatctataatttccaagatagagtcccataagaaggaatatggaattctattcatcgtacgattaaaaaaaaaaaaaaacagtttgcttccccctttccccaataccgcactacacatttctggaaaatagggttgttgctcatcaggtcatacattctagcagctctgttccccatccaaagtatatgaatatttttagaagcaataacatttagtttgaaaaattgagaagtaattgggtgaagaccttactgaattagtaagatgtgaattagcagaaacgtattatgctttgagtacacagggacttagttttaagaagcctctgcccttagaaatataatttacctattactggtataactgtgttttcaaactgtctttacttaaaatactttaatgctaccatcctcctttttagctaatttgttaagcttattcactaagcaaagtcaaattttaatataattttagtctcagttgtcatgacatttgcagtggtgggcctggtgaataaggtttgacatcgaactatttagaggtgttttttcctcatttgttgaatatgtttcaaaaatgtccacctccatggataaagcagctataaacctaatgtttattttagttatagctcaaagtttttccaaacacctttctccctttttagaatttcgggagaatcaactctagcagtacttttagtggtcaaatgagaaatgtttagactccttggtttcactaactttcttgtatcccaaatctaaatttgaaatagttttccttatccctggaaaaaaaaaattgatgtcaggtgggtcttttccttgcaggagaatgccgtgaatggagaacacctgtggctggagaccaacgtctcgggagacctctgctaccttggagaggagaactgccaagtcagatttgcagtgagtgtgcgctccgtcttgctgggggaaggcctgtggatctgaatgaatagaggggtcaccttgcctaaatttccaaggggaggtttgaacgagcctgtccttgtgagatggaaaactttccggatgttttcaaggtttgcagagagtttctcaagttaacatggctttcaggttgtcgctcgtaatggttttagggttcacttatgcaggccaggccttggtgtcatgtgttactttataatgatgcccagggtaggttgttgtgtgttggtggggggcagagggtaaatgtgtacgaggtagtgtctccttatggaggagttgttggtgtggggccaaggcctgtgtgtggaggaaggggctctgtctgtagggaagtggccacagtgggggctttactggtgggtgaaggtggaaagagagggaaacacctgtgctgggaatgggtgtaggctaacaaataatccagactaagttctggaggatacgattctagaaataatataaacaatcaacagtcaggtcaattggagttaacttttgttgtttaaaatttgctttgtgtccctatttagaacaatctatttagagggttaaaattctctttatgttgtgaggtaagtgtggttgccaagtagtgcattgtggagatatcaaaaccacagtgttgagaaattgaacttaaagtttgtgtgtagttttaaatgattggtccaaacagacagtaatgggaagcttaggatagtaaagaagagataaaagatgtattccttcttatttggggaaattagcaccagaatttatagaatgcttttttcttttttaaaaaaatatttgtttattatgtgaaagaaatatttgcagcaagatgtagggccttgaaattgcagatgaatatgtgtttgttaataaccaatatggaataaatcgagtttccatcaaagcttatagaaggatatgtatagcccccaacgattttaaccaggctgcctaaaagcacaaagtcccagaaccaagaccttttttgttgctttagctgttttaactccttgtttataaatttcatttggagagttttgagagttctggggagaacagggcctgtttaagtgaagttgggaatcaatgtcagggaaagacccagatgaacaggctctggattggaagtcgggaaacctggagctgaatctcagtgttactgctcagtgtgtgacattgagaactcgtgacctttgggccttggctaccttctaaaacagagagtaggattaaattcttttttattaatttatttttgtttctagacctgtaattaatcatttgcttctcttctaattttgttgtaaatttaattgacttaaatatcaggatttcaactttatgcatatgtatttttaattaaagtataattgcatggaattggattgaattaacgaaatccatgagaagctcagctgtttggactaaaatgctgtaaataatgaattaacattagtgtcttggttaattgcgtaaacactggtcctgggatgtaagataataaaaaatggaaaaaatgaaagccagtattacttacatatatacttttgaacaatttctactgatggactatgattttatacagagtcatcccttatttccaaattgctccctttaatccctttctgttactttttaggggatggctacctctcttgacaaatatatgaacagatacgtatatcctctttaaaccttgtatcagtaaatagcattgctatccactgaatgattattacttgttcactaatacctttaggccaggaaaagcaacaaggagaataaaggaaattttaggtagaagtaggaagaaacagagttgagaacgttcccagtttccttctgaagcttcctcataatttcataccaggtacttggccctattaactcatattacaaaacgtctgaaagatgaagaactctcctccaaaaaaatgttggttaaatgaaggaataaatcagtgaggaagctgaagacctaactgctgtaagtttcttgaagctcagtttctttacctataaagtgggggaaacactgttttgagggtttggtgagatgatacatagaaagggcttacttggctcagcaactgacctaatgaattaaaggcaaaaaaagaaaaaaaagaaaaaacccaggaaggacaaggacaggaaatttacaaaagaactaccaattgccaatagatatctgaagaatacaaaggcatcccaattaaaacaactcaggagtcaacttcatgtgcctattaaattagcaaagatttataaaatggtaatagttgctgctggttggtttaggctgaaatgggcaggctcatcatcagctgccaggagtgtaagtagatacactgtccttcacaaaattggcagtgtgtactgaaagcactgaaaatcctctcagtctctctccccacctcgcactgtgaggcgcatgtcatctctgggcatcccattttgagagagacattggcaagcagcagaggacccagagtggggtgcccaagttggtttaggggatggaagcttgttgtaaagaaatgttaggttacatgggctacagctgagtattaggagcgaaggcagagagatgtcttccagtatttgaagagttaatttgaagaaaagagaagtgacttgctatctgttgttagaaatggaaaagtcatagaggtagaatccactgactctaactttataacaataaacaaacattacctgggaaacctaacaatgcacactcctgtttccctctttgctccaaatgctgattcagtatgcttggagttggacttgagagtctccgattttttttttttttttttttttttggatgtagtcttgctcggctgcccaggctggagtgcagtggtgtgatctcggctcactgcaacctccgcctcccgggttcaagaaattctcctgcctcagcctcctgagtagctggggttacaggtgcaagtcaccacacccagctgatttttgtatttttagtagagacggggtttcaccaggttgaccaggctggtctcaaactcctgacctcaggggatccacccgcctcggcctcccaaattgctgggattacaggcatgagctaccacacctggctgggagtctgtgattttaacgagcacctcaaataattctgatgcagatgggtcgcaaacctaactttgagaaataccgtatgataagaaagaactttgtcagcctgagcttcccagcaagcgaacaaggtgcctggagagattgactggtgggatgtgtgtttgtggataacgtgggtggccatgtttcaaggatgctgtagttggggactctcagctgctttgggcaagaggtcacagagatctccaggcgagtctttagtttaaatgctctgtttgcagttttcttagaacaacagtcttttttgggaaaaaagtatgcataagcagatcatgtatttatattctaatttcttttaatgaaccacctttgaagaaagcctacctgttggggctgggactaaattaccataaccaggtactacctgcaggctcctaaacaaagtacaggcagagtgctcaggggaggagtgaatccatcatctacgatgtgcctttcactccttccctattttagcaaagcaaatgtcacaagtagaagttaagagaaggaagaagtcagtgtgggttgaagcagacagaggcagcttcatggaaatggggttcgagctcagttttgaaagatgggtaagatttacataagtgattttgaagaaggagaacatttcgggcagggaagaggaacatgagcagactcagaggtggggcaagctctgtacaaacgaggtggcaatcatgagccgtgcatgagcatgtgtcagagaaaaatggaagtaagaatggagttaggttttttgaaacaaaacttggagtgcatattgtaaatactggtgggcttaggaagcatgactatagaatacattgtctaaaccaagacacttttgagggtgaaagtggctgctgttaataatgatgccgtaacattagggataaaccagaactgcatcaccctagcttatgggacattagggcatctatgtaaaactaaaactgtcctgcaaagccgggacctcctgctgccatgtggattgatatttggggactgatattggagggtactgaaagccaggcaatgacttccaaaaccctagaacagctgtaggagagtttgttcccaagcttcagggctaaaactaaaccacgtgaccttttcctgttctacagctctctggtggcaacatttaatactgtagaatacctgtgagcagatacgtaatggaattaaatttgttcccaaattggcaacagttcccaaattagcaactgtttctttttctggtctagataaaatataaaaggatgcaaaagtaatgaaattgaagtagaaagatcactgtttcccaacctgattatgggcactggaaacctgaaataaaattccagccagaatcactgtcgtttggtgacatttatttttatgtacatttattcatttattcattcatttattctgtcagtgtttgtgagctgggttgagtacccagtgcctcaccgtttagcgggcacagccagatagaaactgttctcatgctctggggctaggctatacaaacatgtttagccaaatatttgtacctaaaggagctcacccctccagtagtaatccctggagtccataccatcgtgcacctactcagacttgaaagaaacttgcctacattgatatgcaaattatacacccaccgtggtcacacagacctgaataggcacagatgggtagcatgggtggtcagaaggaaatagactttgtgtggactgacctgggtttgaaaacctgctgttccatttatgtactgagtaaagttgggacatatcactttgcctttttttgcctcagtttcctgatttaaagtattgctactgagatagaccacagcgattcttatttctggatgagcattatagtcaattatgccattttaccttttaatcttacctttgaagtgttggttcccattctggatgtaccacatcaggatctctagggagtgggactcagcctgatgtcaaaaacaaacaaccagatctacagatgattctcttcactgtcagggtagagagacagtgatccacttcagaaacagagtgtcaggaccaaaaaccgtggcctggttctcacacctggtgtgtagtggctgtgatgggctaaatagtgtactccaaaagatatgtcgaagtcctgacgcctcaggacttcagtacctcagaatgtaacttgatttggacatagggttgttgcagatgtaattaattaggatgagttcatctggagtagagtgggccctaatccagcatgacatgtgccgttataagagaagacacacgctgggcgcggtggctcatgcctgtaatcccagcactttgggaggccgaggcaggtggatcacctgaggtcgggagttcaagaccagcctgactaacatggagaaaccccatctctactaaaaatagaaaattagccggggtagtgatgcatgcctgcaatcccggcggcattacaggaggctgaggcaggagaatcgcttgaacccaggaggcggaggttgcggtaagccgagatcgtgccattgcactccagcctgggcaaaaagagcgaaactccctctcaaaaaaaaaaaaaaaaaaaaaaaaaaaaaaagacacacagagacacacacacagagaagaaggccatgtggtgatgggggcaggaattagagtgaggcagctgcaagccaaggccctccgaggatcgtggctctcctcagaagctaagagacaggcatgaaattcattctccctccaagccttcaaaagggtgttcaaccttgttgaaaccttgatttcagacttctagcctctaggagtgtgagagaatacatttctgttgttttaagctacccagtttgggttccccacagaacacccattgccattgagtgggatcttagtattcagtggaaaagtgtttgagaaatgctcacacaatgtttgcagttttcctaggactcatactcatcatctctgatccataacaacaaccttttggggtggtcatatcgggctgttcacttctacctaaagataaagaagagtcagagaggcttactcactatccagagctttatggcttctttgctttcttagggcagtgctaggaacctaatatagtagccattctataagtcgagttaccttatctagccatgcagataccgcagttacataggctcactgacacgtatgcacacaggtgcgtctacagcaggcttgagtgtttaggttgagtggtatgtggttgaggtgtaagtgagcagacaggcaggttggtgtcagaagctgggagctgcagggaacagagtaggtagatggtgaggtgagtgagcgtgtatgttgtgtaagaggaaaaatggaactgtcagacttcaggatgctgttaccagatatatcttctctatttttaaatgtgagcatgccaccctctttttgtggaccagctaataggtactgctttgcttttgttattgttttgttcttgtattttgctttagtcttttcctcgtagataatgtttggtgaaaatggcttaaccctacctgtgacaccctgccttaattctaagttttcttctaatgttgcttgcaatttgccaaatacagttttactgagaaagtgaatgaattgagttagagaggccatgtgatatgagagttggaggattggagggcaagagcttcacagatccagagacaaaaagatctagataaaaatgcaagttctgctctgcctttctgagcctcagtttcctctgtaaaatagtggtgattaaatctacctctcagaatcagtagagggataaaatcagttaacaaatgtttgtattcattttcctcctcttctgtacctactatggttcaatgtcatggagctgaacaagctaattagcagatttggttggactttggcttaacaaggccttatatttgggatgattccaacactaagactcttatggcttcacctgtcattttgctgctgtgtgtagcatccatattcttaccaagtcatgactgcggacaactgagtgggacaaatcaaagtaacccattctgtgatctcatctcacaagctgtgtcttcttattggtgaatcagaagcctcatcattgtctgtaacggggtatcacaatatttgctcacaggaatgctggtcatgtccttagattcttggaagaaactttcaagaagagtacaagggtcatagctttctgccctatttgaaggaaactttcagctttctgctgtttaaaaatgaaaatgattttgagcccagttacaccttgtctgtttcatctcaggaagaatgagcaccaggcagcagcttgtgaaaatgctggttcccatgcatctgtgtgtgtgggtgagaagatgaggcaatcagagcccgacatgcattactggggactttctggccatctgcgtattcaggtctagctggtgtgtaacatggagcaccagcattggacttagaatgcaccaagatctgcctgcatgttgctcctgctctgtcagcctcaaatgccagttgtctggcacagcagactcatgatctgcaccccagatggcagtttggctgagctgggtgcaggctgtcagagggaaccacgtgtgtggcaataaagcccaggaggcaaagcccgctctctgagttgtttgggtgccagccattctctgccaggggcctttttcaccattaggatattgaggatctaatgaatcaagatgactcatggaaagtgtggccatcaacaaaaataagaaaagaattttcacagacacactgtctgctactgagttcctagtcagtggatatgagagagggagagagtggggtgctctcagtggcagaagtaatgtcaccctttaggtgtctggcctgatagctcagcatttccatgagatcgttcacgtgcacacttagtgtctggcacatggtagaccctcaggacatgttagccattgttactatgacaactgtcatggggatcgttataatttggtaccaagtgctgtctgtatattaaaggagaatctagtgctgatactgctcacttcatgtaatggggatagtgatagtatatgtaggctatgaagccaagggatctttaggattctgtcacttctaggtgaccctggatcaatagtaccattgtctatttgcacagcccattttcttttgacccaaaattgtgttctggagaacactaaactcaaaagaaaacaatatacggcattatacattaaaaggagctcatgaccataaattttgaaaacactgaatgactttaatatgcaaataggtcctgtgaagctcaacgaagcatataaggtatgcaggatttcctactttttttttgagtggatgggaggattgtggaacccataatttccccacagaacacccattgccattttgtaggatcttaggagtcagtggaaaagtatttgagaaatgctcacacaatgctttgcagttttcctaggactcatactcgtctctgatccataacaacaacattttgaagtagtcacattgggttgggttgttcacttctacctaaagataaaggaaaaaaagagtcacagaggcttactcactctctagagctttatgacttttttctatctttgtgcagttcttttgcctttatactaaactttcattaagccaaaatgcatgtgtcttattttattcttagagtttgaacctctgagaataattgtcatcttttctgtcatgacaattttagattgaggctgcatttgcgtgtttgtgtaagggtgtgtgtttctgtgaagcagttctgttgttattggatattgtatggtcctgttacctagtaataaaaataatttgcatctgatttagcataaggcttacatgttacctaggcaatgcccaggtgtacagaaatggtttctcttcttgcaatgttttccaggggcagggacccacagtactggggtttaaccagtattcctgttgcttagaggcactcaatcttgatggaagcattatttgcattatcggttactccaaaaccactactggcccccaaagttggtattgtctctgtttgttaggagcttgttgttgttgttccctgccacattgatgaggtggatacatattcagaaggtgatgctttaaaaacacgaggaaatggaaaatcctgcattgatgccttcatttaagggggtgcaggtaatgtgttgatgaagcgtgtgagctttggaatcagatgacctggttttgaatcctgatttccaggctttgagttgtgtgacactggtccttgttttaacctcgttaagcctaagttttacatctggaaaatgggattatactgcttcttgtggttgttgtgaaaattaaaagagttaatgcatatataacagcaggctggcaaatcacaggcactcaataaatattgaccactataatcattcctccttgaatgaaagtggttccaagaaacagagccaaaagagacaactcagagtactaggtttggagagtcttagcatcacctactacctctgtttcctcgaggaaagttaaggactgagcttgtgaggtgaaacaactagcctagctgacagtcaggctctccctcccctcttgctccttcaccattctgtcaaccttttacagcacacaccacttactagctatcatacttttaaaaattgctcgcttatttatctgtctccaacactacagcataagctccatttagctcaggaactctgcccttgttgtcctctcctgtattccccacactgaggataagtgattgaactgaatagttaccctgtgttacttaacattgaatgaatgaatgagttcaatgaggtgcttgttgagagagagacacatacacacacagacacctgtcaccagatcaaccctgccatttaagtattgttatatttataatccaggacgtctgaattcctgcctcctttttaagactctttagagggagatttaacacatgcaggtagctgacttgtgtaaggttttatgccctgtttagccagtgccatgccttttgcagtgcattttatttcattctcgtggagaacagagactgctttttgccatcttggcacagggggtcatgtgtggttgtcattagtcagttcccctagggatctcatgagaacagatcatatgaagcaatcacgttaaatatcatatttcttatctatcctcatcagtcttggtcccccaggttaccactagcaaagaaaagaggaaaacagtaagctgtaacacatagagatggctttgggttagaaagacttccactcttagctagtctttcttgggcaagttgcacagtctcatagggtctcagttcccttagctgggtaagtcgtacctacttggcatggcagaagtgagctctgtttacagtgtgggtaatgtgtatattacacagctagcctcctggcaaatctctgtgggtatgatgtcctcattaaaaaatgaaatgggcgggtgtgtatgtgtcagtgaaaacattaccaactggaggtacagtgttgagtaaacaatgactgagatgtctgtgggtcttcctggactagattggctggaagactgccttaattatgtcaccaaatagcttggaatgtgaaaaatggcagtgaaaggataactaacttaccacagcttgatatcgcttcttaactagaaatacagtattccatatcaaagcaaatatctctaaatttttggttagaaatattaagctgtgaactttaagaaaataattctatttccacaaagtaaactgataatggaaacatgtcaggattcataatacaagtaagatggtgtttatggtactgtcacaccagcaaggactgaaaaaggcaaagtgtttgggatttcctagtttatactaaggctcaaatctctgctgtacccgtgatatgctacctcagaactagagaaagccaccaagacatagaaacaccattttctattaacttgttttgttatgacttctgtaatatgtctagcccatcttcactcaagtctgtctgcttgaaatttgtgaatgcacatgggtgtgtatgtgtgtagggctctaatggtatgaatttctacttattagtgtctgtgtacctgtaattatatttatatccatatttgcgtgcatatcaatccttcaattactctactataagacacctggcaactttgacctgctggcacaaataataaccttgaagagcgtgtaaaaatatgacaaggaacagccacaaaaccacctgtaaagagccaaaatcaggaagattgcatctgatgagttgaaactagtgaccggctgtggttgtatactgacttctaagctgagaagcatagaaaaacaaatggggaaaaagaaataagagaaaagagaagcaggcaaattttaaagaagcagaaacaagaaacaagggcaacaaagtacagagaacttcaataataagaatgatgaaatatgaagtgtccttgggtaaaatgagagccagggtgggaaacagaattatggatttttaaggatttcttcaagttcattaggctggaaccctttttaatgtatcatgagcatgagggaagaggcagaaggaatacctgagctgcccagtaatctagatggaggggcacagtgagtatcattccccatgactctccgcctggcaactctgagggcatcagtttgttagtatcatttgattagacttgtgcaaacccattcaaacttatcaggcccttcgccatgcttgttataaagactggctgcaatatttgttttatatctcaataactgtgcctgaattgtaagaagatttccaaaagatggtggcagtacgcgatagtcacccaaatgaattccaaggtgtagacttctcctaagattcacgtcgtagctttctgtttttttgtttgtttgtgtgtttgttttagagacagaattctgccatgtcacccaggttggaatgtggcgatgtgatcctggctcactgcagcctcaaactcctgggcttaagtgatcctactgcctcagcctcctgagtatcagggaccacaggcttgctgtagatttctgttgaagcctatcagagaaactttgtgcctatcactttcttctcattaaaaagaagtattaaatccactaacataagtcacatttaaccatttaagagtgtgatttggtacaaattttagtttaagggtaaactgttgagatacagacatgtacctttttcctcccttaaaaagaatcctgtactgttctgactgtagtttttaccaaacttaatccagtgctcaaaacacgatggatgtatcattctttgtaaccagtcatgaacgttagctttgaattaacgcaatcctagcaatttggttcttaccaaattgtttctcctatgagccccgattggctgcttctcaggaagaggaaaggttttttgtgtgtctttctagttcttatattcagctcacagtcttttttttcccttggctttctgctgtaagattttggttttctttcccttcagatgaaaaatataaaatacactggctatctgggaaatagacaactttttctttctggttcaaacaacaacacacaggcactgctcttctttctccctgtaggtctctcgggaggtcatggaattgagcctgcctaggtggggttcagcctagtatctagaatctacctgcacatctgaggttactcaggggaggtgctaggaacatcaacataaacacttcatatgcagaatgcttctgataatgtgtttctcagaacagaacaaaacacgctgttcgaagagcatcaagtgagttttcctgcggtactcgagaggcaattccaaccataatagagcatgagactgtcaggtatgctgtcagcccagcatacacatgaacagcaaagctgcccaaggggtaggattgaagccctcctgagctgctgatgattctactgaaatacttaaggacaaaatataaggaattcacactgaccttagtggaggctggtgtggggctgggaagagggctgtgtgctctcagtcactcttgtgcctctgcctttcctttttgttccattcttgtcactccagttcaggcccccatcacctcatacgggaaattatcactgtgacccttgaatttcttattctctttcaggaaaaaaagccagtgtcttaaccacgacctgcaacacagcatgatctggcctgctgttatcatctgacctcatctctactccccaacactggcccccagccactccttagcatcctgacatcctcatgcctctgagctttgcatggctgtgccctttgcctagaatgtttttccgccagatatccacgtggtgaactctctcacttcctttgggtgtttgtcaaaatattcagtgaaaccttccctggtccacctgtctacaacttcaattttctgctactcttgatgtttcttatctccctttctctctttaattttctttttagtacttatttctgtcaatatattatatactaatctctcttgtttgttgtctgtctctcacaggagagtataatttctatgagatcaaaacaatttttcagggctgggcacggtgtctgatgcctgtaatccctggttctgtctgttttctctccactcctgcaactgttcccaaataaatattccaaggtttaactaacctgtagacacaggtggcatcacatgagccgcagtaatacagatgcaactgtttttaactctacgcagtctatgtaagacctcagtcttctgcaaaatagcccttctatcagatagtcctgtgggtccccagaagatatctgatttgtgctcacaaaaatattatagttgttcagctataattgtcatgcagcctctatgctttctttttctttttcctttccttttttttctttctttctttctttttttttttttttttttttgagatggagtcttgctctgtcacccagcctggagtgcagtggcacagtctcagttcactgcaacctccacctcccaggttcaagtgattctcatgcctcagcctcccgggtagctgggattacaggcgcccgccaccatgcccagctaattttttgtatttttagtagagacaggcttttgacacgttggccaggctggtcttgaactcccagcctcatgtaatcttcctgcctcggtctcccaaagttctgggattacaggcgtgaatcactgcacccagccgcactattttttccctattgtgggcagagggcttccattcctcaaacagtctgagggcacctcattactgttgcttttgggattgcttattacgagaatgtctatgtcccggtgggggttttgtctcctaatgtttcctaagccaccaattctccagaccggggctgattgagggttaagtggggagggagccctatgtcagaagccctttctcctttcttccctccccctttcctttcagaataactgtgtcaggcagtgttcttggttctcagtgctggaatatagcggcatggaaacacacagagaaatctccacctctctgtaactctgtaattttgaaccccatggcttctggggcgtagttctgtttccccttctcatgaagctcctcatagacagctcctctggcttcttaacacagccagtgtacctacttcccaggtttgagggctgccagcaacccccagacacaccgttcaaacctccacactcaaccaccagccctgagcccagtgactcctgtacatagacacccaggagcccaggaattgtcccgcagtggacatgccaaagcaggtctccatgccttttcagaggcgtcggtgcctactacgtaaagagacttcagatctttttcctgctggaatgcctttgatttttttgaatatacatattttaagcccaaattaaagaatttgctttctctgctagaccctttttactggttcagcctcagattttgccctcctctaggtgacagcttttcttgtctgggctgttgttgagcatgtcgccatgtgtggctctctcctgtgaatggccttttctaccaagttcctcttgtctcctcaagtagcttgccagctcttgcaaggacagaagcttcctcctgtttatatcctgtacagcactcacatagtcttatacacatagtgatggttaaaataattggtggactgaatttccataaatatattctggaaaagtcagcagtaacagattgtttcagccatatggaatcttctcttatgtaggataactcaaaccatcatgattccagatacccagcatctacagattcaggagtattggtgtatatctgagcattgcatgagtattttggtgtatcctttgtaagagtctccaacccaacttctagttgttcctactgcttttcttccagatattctgagatacttttggcaccatcccttatcaagggtgttggttgttgggggctatctcagaaggtttcagcctttaccaagtccttgtctgtccacagatcacattgcacaaacacatggagtctttacaaatgaaggcctgccctccaacatgggccaacactactcagggtctgggctgggaccttttaacatggagtgaggtctctctgcaattgaacctctaaggagaggtctgagtttccactcgggtcacagactcctccggacatgtggcatctttgctccttggtctggaatcatgagatcctgttgtcatagacagaatgagtgatatactgaggataaaagaagtgtgctggggccgggcgcggtggctcacgcctgtaatcccagcactttgggaggccaaggcaggtggatcacgagatcaggagatcgagaccatcccggctaacacagtgaaaccccgtctctactaaaaatacaaaaaattagccgggcgtggtggcgggcacctgtagtcccagctacttgggaggctgaggcaggagaatggcgtgaacccgggaggcagagcttgcagtgagccgagatcccgccactgcactccaaccccgggcaacaaagtgagactctgtctcgaaaaaaaaaaaaaaaaaaaggagtgtgctggaacttcagccggccaccctcctggcttgtccaaaatgttctatattcctttgaagaaaaagggaagcctgcatgagtgatggtggaggtcgggctttggccctgaaatcatattaatggaactttcagataatgtcattcttcatttttcctaatgccaatttatagattgcatcccagactccccagagaagtagaatttgccaaatatgcttgtcatttcttctaattaggtttttaaataaatcaaagaactcttgttttcatttaccttggattatacagcaacaatcttgttgtgtatgttgccagagagacaatgcctactgagaggacaccagattcctgacattctaagagcttaggaaggttcctcccctccactttcctaagcattccattagccccgccattgaagaggaggagaggacagtcctgcctgggctgcatggcgcctccttcctacccatctccaagatgctgctgtggaccgggctttgtggtctaaaagggaaggagaagggggaggaggagagcactctcctggcctctcttgcagtttcccctttgcttgattttcagccttccctcggtttctagtcctcggggtgaatcttcccatctaggaggctaaggggtagagaaaccatgggggagaaagctgggaggcagctgggggtaggcctggcccagcaacctcctctgtccttctccttggcttctcaccatgtggcccccctctggccctttccccagcatgccccatctgcccccttatgcactcacagtattgttggtttctgcctgaagcccctttcctggctgtcatccctttgctcactgtggcctcatagctggtgattccttgcattacgtctgggaattctggagtgaggtgccatgagctcagactttgccctggtgtttttggtcctgcagcagcctctggcctctgagctcctctgagatggggagactaagaaccggttgccatgctggctcttttcctactgccttccccatgtcccatctctggtgattccacctgtcgaggtgggcaagctcagtgggagctcttaggaccgcagtagaagctatgtagtcagcaggcagtgcagttggccccactgcaagaagaaataaagcttgccgtgtgcctcattcagaaggggacagccagccttgttgtacctgcttcctgggtgtcaaacttctgacaattgggaatgacagatatttaattttacttaccttgggcagcaaaaaggccccaatccttttatagatcatgggcctgtgaaagtagctaaccccaggccctgaaggacccacccctcttctcctttcctcccctctcctctcccttctctcctaccctttcccgtcttttccccttccctctttttcatctttatttttcatcatctttcccatccttcctttcctgtttttctccatcaaactctctcaactcccaccagatattcattgttacttagcagaaatcacatatcttgctcaaaggaagaaaaaaaatagctttcttggtacatatagatcagggacttaggcaagggaggtagttgggtgggataggattcaatattaatctctttattagggacaattgtatactctctaccactgcctgccactgatgcctctgtcctcctcaatccccattccctgctccagtggtctaaagctgtgacagtttttctcccttgcctgctatgagctgaagattggtggagagctgtcactactttcaatgccagcagggcctgcagcatgggaaatatgtaggatgtgttttctcttataaccactgtatggctgctggtgagatcatgcccaccatcctaaaacctagcatatatattattgtgttgttatttaagtaaatgttggtcatgtttttattagaacagtgtaatataatggactgtgatctatactgtattccatattgtcttagtttaaacggatatgttcccccctctgcccaccccgtaccacacacctacaaataagtttcttttgaataccaacaccagcaaaatcaggaaacccttagtaagggtgcttaggtgctgtttgatatttaaggcagtaagctcaactggcctttaaattcattgatgagagcaaattattgttttttaaataattttaatttttaaacatgtttcatgttctaggcaatatttgtttaaattatgtttttgtgctaggttctataacaactgtgtcccaatgtaaggaataagaggtaacctactgaatgcttcttttttgagatggagtctcgctctgtcgcccaggctggagtgcagtggcgcgatctcggctcactgcaagctctgcctcccgggttcacgccgttctcctgcctcagcctcctgagtagctgggactacaggtgcccaccaccatgcctggctaatttttttgtatttttagtagagacgagctttcactgtgttagccaggatggtctcgatctcctgaccttgtgatccgcccgcctcagcctcccagagtgctgggattacaggcatgagccactgctcccggcccctactgaatgcttttaagtgacttttcttggtttaatttatcacctttcgtagagaagtaagcactggctcatataagttatttgggaaaaagtgaatatttgtagtatttagaatgtccagattcctgcatcttacctttgtgtatagctgggaacttaaaaatgaaaaattgcaacctaactaagcacaaaattctaggtgttttgggcaatttctgtccggaagcttattatccaactacttcaaataactttaaccagttgaaatgtagtcatacaccgtgaagtcagtgattaaaatttccgatttgctaaaacagtttccctcaattaaggaactaaaaatctatttacttttctactatggcaaaagacctgggacctttattcagaatttatttacttaattttacatatgattgtaaactgtaattatctgatttctcagattaaaagctgttgagaagctgccatttaggaaattgagagcaacaaaagacagcaacactgactcaaaaggagctctacccaaacagaaggacaggaaagagaaaaatgactgttctttgtacagtgcatcatgttgtagtctttatgaagaaaaatttagaatatggtttatatattctgcctcaaaaggcacataagttcataatatattttaagaggatcttttaaaaatcaatatagttcagttaaaatcagttttagaacttacagcactcgactccatatattatcatctgcggaacgttgcacttcagtttttccatatgaatgatgttagtgcatttacatgacgttccagaaggctgagagatagcatatcttaatgcaccagttctcaaattcttctagcccagatcccttgtgcaaaagatgttttgactcagaatcctgatttgtaaaacaaaggaggaggcattgcatttcattgaatgcatgaggcttcctgagttttctccgcatcttccttccatcttcagtgactttcgtaacagactaagaaatccctggaactccatagaacttaatgcagagcgtagtgtcaagcacgaagctagactaggacaggagttattggcaaggagggaggcttttcaggcatccttaaatcacagcctgtaagtggttgcctacctgtggtaatattgcattgcttatccacaatgtaatttactaggagtttcatgggaaatgaatagactaaaatcaactccagtttcctttgtgtcgctataactctgattagcaatgtgactcaaatgccccatgcattttccacaggtggtgccaaagcagtgattcgcaccaggatatccataggaaacagaagggaaaccatgatttgcttatgggtgctctaccctgtagagcaaaatagaattttttgattgtccttttgattgctactgctgtgttactacgattactactgtatgttttcttgttcctccccctccttctttttctcttcttcttttcttttttagtagtagaacaagacactgttcagtagtgtagctagatgctttggtttcttttatcattgttatgtgcaaaagcaattgtcaaatgtatttcatgtgctacaccatgttcttccctcaggaagaggaaatccgagagtgataaaagcatctgcaagcagaataaaggaatctcagtcagtggatttcttctacaagtttcatggcagcggtactgcagtgttttaggttctttgttggtggctgataatgtgtaaataccccatgttgaatgaatgcagctgtccaagacctatgaggctgcattttctttcctaatcctacccctccaaagtggtggtttgcagctcttcaaatctctggccgcagcaatgctttatttcttctcacctacctgacacagttgactcaaaaattatacctcagcaggggaaaccactcctcggaaggggaaggttgccagcaatctctaagaggacaggaactcaggacctttcacacttggatgctttgatagcccatctgacagacaggcttagttatagtacatttctttcaggctcaaacacagaaattattcatacaaatcctccttccagtctgtcctttatagagagggctgaactttcctatcttagatcctgcatgacactggcagtcatgaaatgtagattctgctcattcatctctctccatgcagtccattttttatcattagagaaaaagataaactttaaaaagttttatttcattataattttaaactaatactgactgtcagagaggccgaattgtgtaatgcttataagcatgagctctgaagccagaccacttggccctgctgtgccttaattcactgaccttgggcagttttctcatcagtgaaatggaattaagaatagggcctgtttcatagggttgtgagggttaagtgaactaccatttgtgaagtgcttataagaacagatagcaaatactatattcctattagcagcgtttcctgcttttgttgctattcttattattgtttcctgggcgtaaaagctgaacttgccttcctttacttctggaagatttgggcagaaaccgaagtaacttagtctagactcatgcctgggatagaagcctaaaatgactggcccctggaaatctagactctttggcaatagggaaagaatgcctgttttcaacttagatctgagtttggatgttggtcttgccccttagctacttgagtgataatgtagaaaatattttaaaatggaagagaataatgcctatattgtaaggttctgaaacttagaaatgacagaacaaagagccagttcttgttatatgctcaaaatattggagctattattattattatttgaagagacaatctagcccaccctaaatcatgcagatgtggagctacttggtgagtgcagagactgttgataaagtttgtcagtttattcaatatttaagatgaagttttaaatttgctttgtaatagaaataattacaatgtttgctgtatttatgtatttattatatatgcccactttaatactagggaactcttcagaacagactgttaacatttcttttttgtcttttgaattgaatattgtagaaatcagctctcaggaggaagtgtgcagtctgtaaaatcgtcgtccacaccgcctgcattgagcagctagaaaaggtaagagcgcgccccctgctgcagttttgttacattgcaagtatttggtcttcagaggcccggtgtaaatttccagttccaactttttgaaaacaatgcccttaaaaaaaagctggaagtccaacattattaccagattactaatggaaagacaatgtttaagggtcgttcactctcttgtttgctgaagtgtaatttgatatcattttacgttgactcttgggaaaaggaagaacacagttagatggaaaagcctggtgtgcactgattctcttattatatcatctcagttcaagcattactatccacccataggctgttccacaagctgtttaagaaggaagaagttctataagctgtttataattgttgttcacatatatctgacttgtgtggtttacgtcttcctaaagtgcctgcaagggagcgagccacgctggaagccggctctcactctgctggggcagtgctcctcctgttgctgctcaaatgtgtgggtggggctggaagtgacatcccggtggtggtgtgcctccagaatcagtggattcggcaaagtccatttatttgtcatttaggggatgggaaaggctccaatagtgagttgcctgccatcctctttcctttcacacttcccactacattttaatgtgtgtgtttctctgtgtattatctatgttcttgagctgtcatgggtaaatgcattgaaatattttagtcccccatgacattcatgtagtttcactgacatgaccagttgatcctagctgatatcttgtggcaatgactaccaacatgttatcttaatattttcttttctgccccaacttcacttactcatctctgccttcattcttttgctcctttcactttatcgagtagctaaccgaaatgtcaatgtgcctactaggagacctccacatctaaaagaaaagcagtgctgaatccttttataaagaataactctgggctgggtgtggtggctcatgcctgtaatcccagcactttgggaggccaagatgggtggatcacgaggtcaggagatggagaccatcctggctaacacggtgaaaccccgtctctactaaaaatacaaaaaattagccagatgtggtggcacgcacctgtagtcccagctactcgggaggctgaggcaggagaattgcttgaatccaggaggcggaggttgcagtgagctgagatcacaccactgcactccagactgggtgacagaatgagactccatctcaaaaaaaaaaaaaaagaataactctgttgtctttgaataattgtcataatactaaaaaaactcaagtttatattttctacttttacaatcagaaacccagctgggtagtttaagctgccagtatctttcctctggctctttcttatctcagtttctcaaatttatggtgtaagagcattatcgtttaaagatacttagatttgatttgtgagaatgaaggaaaggggttggagatatagaatcacctgggatctctgttgattatctaatgtgatgatttcaaaagactaagaagagtattattccttgttctttggaggttttgcttttcagtctcaatatctgtcactgtttttttttttttcaggtaattcagtctagtctgatgcttatctctaatataatatacttttctttttgaatgacagattaatttcagatgtaaaccaacatttcgagaaggaggctcaaggtcaccaagagaagtgagtatttcagagcttgatttcaagtatcacctttgatttctcattgattcagtggattcatagatattcaccagggaataaaaaataaattctatctctttctgttgcatgccaattttttgttaacacatcaataagcacaatcaataaaatcttcaagtcttttcaacatgtgcacactggactttattctcataaaatgtactggggagtttaaggtcttaccaaatgaaccagagactagaggaaggtggtagtgatagaattgaaggggtaagaaagaaatagacttttattacttatttatttggagacagagtgtcgctctgttgccatgtgttctggttgattttaagtgcatttttcaattttgagtgggtataagccattcatggggcagcacagtaactggttattcctatgagccctggagtcagacggtctgctttcaaaaccagccttgatgtgtgtgatcttgggcgtctcacctaagctctctaaatctcagtgttttcatttgttaagtaaaaaataaatacatcataagctagaactatattcagttctcagtccctgaccctccagtctggtcgtgaagataaacaggtaaagaggaagttagaatgaagagttgttactgatgtgttagtgggaagcagaggtatgacaagaggagacagcacttatttgttcacattttatttagcagagacagcaagcacagttcaggcaagaaccctcctgtgttattctggacagttaagctccaggcccaaaattgcactccctaatcagtgaaacaaaagcctgcaatgaacagaacctgtcctcctagaatgtagttcagcctgcccagcagtcactcactgcctcccaaacattagcatcttatacggtatcctccttaagacaaagtctggtaaaaatgatttctgataagcatactttctcagggagacgaggttcagttccacttacagatttaccccttggaaacctccccagctggtctactcctcagatcagctctgtgtagtaacaaataggaaagagaggagaggggtcagagaaggggcttcctggaagaggcggcaattaagctgagaccttaaggagctaactaagttaagtgagaggagggtggttaggaggtgagtggcaagagccttccggatagaaagaagagcacacaagtccaagtgagagagggtgtactgagtaagacatgagatctgagatagcaagagctggaccctgaaggtccttgtaagccatgctgcaagttgagtgttttatcatcaggatagttgggaggtgagcattaaactactttaagccaaatattgttcaggctgcagcgtggaggaaataccatgcagttcaagagttggaggcatagagacaactttcagaagccatgctagtaatctaggcaagaaataatggtgacgtgaactaagaataacgttggtagatatgagtttgaaggaaacaaaattgacaggatgtagtaattgattggattttggacacaagaggagcccagactaaaccaagctactgctaagtgcgcgcacgcgcgcgcacacacacacacacaaacacacatacacacacacacacacctgaaaaactgattagatgttggaaaatgagttgatttgaggatgggctggggaggtaatgagtttagttgtagaactgtgaagtgtgaggtatccctgttgtcctcaactggagatgcccaatagaaggttgagtgggtatatgagtttggagcttatgaggaagactgggctggaggtcaggcattgtgagtcatcagcctatttacacagtaatgaaagctgtgggaatagatgaacgtggagagtggaaataggagatatctgagaatcacaaacatttaaagagagttgatgaaaaaagacaacatgaatatgaatgctataattgctagtgacaatgcaaaaggattgggagaacatgtggaaagagagtaggttgggatggaggttgtagaaagagaaaacatagttgtccccatcagttgtcttctcccattgtgtttgtgcagcatggcagcaataggaaggttgtgggccatgcgcagggtgaggaaagcaggagaagaatgatagggctgtggtgcctcagtgccacccagagtgcagacagtgtgggccagaaggtaattcagtggtgactcaattgaaggaggtgctttatttaggaaactagaaggggttgtttcaagttaagatggagtttatgactttccaaccaggggattcatatacccacctttagcttcctgccctccaatatgtatctctctcaattgataggtcaatgtggaggcaggggaagagagaaagagagacaattttaatcgtgcaatttttctaatacaagatgcttttggttttcattagtctgtaccacttctctgaagctagaccttccataagggttttggatattctcccttgtcttcttatcaaggacttgaaattcctttcttttatatattttcatcccctcatttctagataatttctatcagcataaacacactctaataatttctatctttaaaaaaacccaaaaacattccttagccacaaactgtgtcttacctactgctctaattctcagttttgtggtcactgccaagcttccagaaagtgttaactatataaattattttcggtatgtcactttctagtcattgtaacctgttctgatctgatatctactctacccatttactgaaattgcttcttttttcagtgttgcctatgatctcctatatgctaaatgtattaggtattatttatttttctgttctttccttatccagtctctcaaaaatattcaagatactacatattccatcctttttggaatgctctcctctcttggcttctcacatcaccctttcctaattttcttcttgtttcatcagatggcccttcctattctttttcattgcttcctcccccaacctctgcaaatccctccgagcttagttcttttctatgttctcttccgtctgcccactcctgttagaggagcttatccagtctcatggcttcaaataccatgtgggctgacaactcctaactttacatttccagtctgcccttcttggagttccacttggcatgtcttttgaatgtatcacagtcatctcaaatataatacatcaaacactagactatttccatcaccataaaaatgattttaagaaaatcgtatgcacctcaggaaatgagatggctgttaatctggcttctcaactgagaaaactggggagtcatgtttattccttctctcatagactccccacatctaattcatttgcctgtcctgtcaattttatttataaaatatatttcaaatccatccaactgtctccaattctgttatcagcaccttaaactaagacactgtgacctctcccctttgaccaatgtaatagcttcatgattcttcagttgtcactttcaatccacccatgacttaaaggagtgatctttcaaaatgaaaatcagattattaggttggtgcaaaagtaattgaaagtaatgacaaaaaccacagttacttttgagccagcctaatataattttccctggcttaaaactctccagtggtttccataactcttagagcaaaagcaaaccctctgtcttggcatgaaaaggtccacattgtctggcccctgcctgcccttccagccacctccagctcccacatgaactttctttccatttatgaggcatataccaagatattccccacctttggatatttgtgtatttcactgctgtactgaaaatctctttgcgtgactgtttcttacagttaggcctcagttcaaatatcatccccctcagccattgtcttagtctgtttaggctgttgtaatgaaataccatggactgggtggcttataagcaacaaaaattatttctcacagttctgcaagctggaagtccaagatcaatgtaccagcgtggtccaattctagtgagggccatctttggggttgcagactgccaccttctcattgtattctcatgtggaggaaagagggtgagagagctttctgtggtctcttttataaggagcctgattgcatccatgaagagtctactctcattacttgatcacctttcaaacaccttacctcctattaccattgcgttggggtttaggatttcaacataaaaattttgaggggacacaaaccccagtcctttgcagaggtcttcctttacaaccacctttaaatacatagcatattgttctttatcaaagtgtcttgttctttcttttcagggcactttgtataccataataatttatgcatattactgtttgcttgtctaaagaatatctcccttctttagtgtaaattttgggagatcactcctagattttgtcctaaattaattgcaccaaaacacagagtatgtcactgatggatatctgctgactgaatgcatttacaaaggtattcatttctctcaaaatgtttatgaactcttagtctaaaaggacattttgaagatgaaacttatgactcactgactatgacccatttgatattcttaattaaaaattaagaattcttactactactaattcagatgtttatttagtaaatgaaagaacatttgctttagaattagtttgaccctagttcacattatacctctgcttcgtttccactaagtggtaagagtctctggagcacagattgttggtcactatgccctggcatttgcatagtgcctgacatgtgacaagttttaaataaatatttgttggagtcatctaagttgaatctttctggatctcctttttcttagtcataagccataacggactgggttatgatttctaaggtcctttcaaactctatgaaatatatatatatatatatacatatatatataaaattttttatttctataggtttttgaggaacaggtggtatttgcttacgtgactaaattctttagtggtgatttgtgagattttggtgcacgcatcacctgagcagtatttaccgaacccaatttgtagtcttttatcccagttcaactggctgtttgaaaatagccaagcaattgtattgtgtatttttgctaacaatactgaatataagccctgaaataatgcattaccaatattttaacacctgtaagtaatagccctttccttgcccagtacttgaagttgtttatgaataattcagaagttattgacgagcaataaaaaggttttatggtgttagaagccttgctttgctatcttaacaacaatatatcaacagtcacatttgcagtgttaaggatcctgaatccaatgtcagttcagcaacttaggagctcttaataatggtcaaaagaaaagagtgtgagaaattaaagcacttgggatatgaggattagaataaatgattctatagtaactttttttccttatcgatgaaggcaattgatgatcctcccctcctccatggtaactatgtgatttaatcgtcaaagaaattaggtggataattccattcaattcaacacacatatattggatgtttgctttgttcaaactataattaagcagcagtagaataaatttatattgggcctaaaaagaactctgaacagaaggatgctggacatctcaaatcgcagagctgtagtttggagacaattactcattttcttctacgatagtgattttgtataagttagtttatcaatccatgccttagttttcggcttattttctaggaaggatgatattaaaaatatttaataaatggtagagccatagagagtaatatttaaataataatttttaaatgttcttttttattccctgactaaactatatgatattctacatctgcttaccaaattatatacagtagtcccctcttatccatgattttgctttccaaggtttcaattacccaaggtcaaccacagtccaaaaatattaaatggaaaatcccagaaataaacaattcgtaagttttaaattgcatgctgttctgagtagcacgacgaaatcttgtgccatcctgctctgtcctgggatatgaatcacccctctgtccagcatatccactacctgcccattcatcacttagtagttttctcagttatgagactgaagaatcgttgtatatgtaaagtttggtactatccctagtttcagtcacccactgggaatcttagaacatacctcctgggaagaagggataactgtgtgttgcagtgcaaatgatgaagtcagtgttaagatttctaaataattgttgatttatggacagtgttggctgactcttttgagtagagctgttacttgctaaatgatcccatgagtcagccatgatttcacacaggtaattgcatcaaatgtttccaacatgtttcttcttaaattgatagtcattaggtgatttataatctcaataattacagatttttttctgaccatcaatgatattgttccttttccctcggcttctgctacactaacagcaattatattacatttttctattctgtatgatactgtctgacatttttatatattcaatatttctactactgactgtcattgaaatcatttgttggtgtgtcatgttgaatagcgtgagccctgttttgcagaacagaggaaaggcacagtgacacaatggtaagggcacagattctgctgccaccctgtctgggtttggaccctcactttgacctttacattttgagtaaccacttctatgcattagtttccttatctgtaaaatgagaatgatgttgaccattcaagtcaagccctctgataatgtgccctactgtaatgcgaattgggatatgctgcagttggcagctggctctggttctccctaacccttattcctaagcaggcagtggactaaggttctcatcttatcggttgagtaggcagatgctaaaggtgtcagcagtagcctcagctgcaaagtaaagaggtagagggtccagtgccttcatcctcagtagaatttttgcactgaactgatgggatagatactgataactgggcaggttattctagaattgccgtcactttcttgaaagccacagccagccacaggacccagaattgtccatccaggtggatatttacgattgtacatacaaccaccaccagctgggcccagcccagcattctgagattctttgggggaaccagtaatattgctcagacagcatgatttgttttcagaagagagagatcattggaataggatcctggagacctattatgtcagaaattaacattataattgcttaataatgaggaggtagaagtggtctctaatgttgaggtgatgcaagggaggagtcagagagatggtaggggcactaaactgcaatttcccaatcaacatatatttcaatatttcaacaactcataggattttactgatatattccaactaagtggcatctctactcatgaaaattctcatgaagattagaagaattattacttataaaatattttttaaagcgcatggctcacagtactcaacaagtgttagctattataattagcttctttcttaggacaatctaagcttgtgtctttgttttattaaactgtggtagtaggaaaagtgagacaaacattagactaaattgtgggaccattgtgcttatttatatctgattatagttaaaagaccattgttcctccagggtctttgtttagttttagtttaagtggatttgacattattaagagaaatagaggtggcatttcagtattgataatgctaatgcttctcagtggtttcttgtcactctgaatttcatgccttgatatataaccttttttccctctacactgatctattttctgtccatctgtacgtactaatagaacagtgccttgcatgtaggaaaattttgaataattgaatatatattcaagtggtttttaaagagaaaataagggttatggctagaccctacaatagacatgttagaattagataaagtgtgttttcccagaaaagggcaaaagaaaacaatgagtactttaggggtattggtgtcagagggatgaattgtttgtaagttattagggcttgcctgcattcctagtcctgaggatgactttcttgtaatgtatcctgagaaccagtggtgaatggcgctgcttgactctgccccaggagtgcttgtctacttgggaggaagaggactttctgtgtttcctacagtctgagacaaagatagaccttgaaagctaatctgtaatagttcaaggtgcccaaggatggtttaaacacaataccattgcaaaaacatcattgatatgcttgtatctcttgtccttgacatctcttgccttcagcttttctctttcttcactctatctagtgaataattctcacgtctatgtcttgtattaggagatctctttctgagagtttgatctacattatctctagctagaatgtttggtatagtgtctgcctgccacagataaagcactacatacctatttgttaaattgaacctggatattgttgtttcagcttctccccttcacctttccacttttgtttgggtatttcttttacctgcctcagttacctcccagctcaaggtcctctactgtgttcacaaatctgcagagtgtttgactattaagacagtagagtaactgcaatctcgtgtggccacttgccactaggaagacgtggagggagggcatgagaagtggaatctacagatatgaaagatctttggggatggagaagtaacttaatttgtccacgtagattcatgtttattgttaaacaagtcatacccataaatatttgtttctgggctcatctgggcttagatgatggtttatataaatcaatagtattaccacattaaaaaatgaatcttgagatttgcaaattaaaacatactcaatcaagtgcagtagctcatgcctgtagttcccactattcaggaggctgagatgggtgaattgcttgagcagaggagttcgaggctgcagtgaactatgattataccactgcactccagtgtgggtgacagagcaagaccctgtctatagaaataaatttttaaaaatattcatttaattttgttttcccacagaattttgtacgtcatcactgggtgcacaggcgtcggcaggaggggaaatgtaagcagtgtggtaaggtaagagcccagccacctcatggcctcgcaggaggctccccaggcctctgcaagcaactgaggtagatgagtcctgtccccaaatccagtgttcactgcatcagttcctttctgaaagaccttacttgtccaggtctccttaagaggcattgtagttgttctagaactcactgcatgaggcaatggtgttaataaaaagaattagcacatttttaagatacctggatgcattcttacagtgaatttcattgatgatttttgaaaacatgactgttttgtgaaaatgccttcatgaagacaactggctcatcgtactttggccaatcgcagcaaatcaatgggtttgagcaacactacgtttgctaatataaaattgtgtttgggcggaactgtttaggacaacatggtcagaagctagaaatgtgttgctcccttgggacattatccagttcatggaagagatgccctttttatttgtggttatttatatctacctcctctgtcatcatggctggttataggtccctcaggatgcagtgccacttggaaaagtgagctggagcaaggggtgggggtgttgtgattgtatactattaaatgccatagattccatgtgtcattgaccccaacagatttgggttacagctttttccaatgtacaaagatctactttaaggatgacagggtcctctgggagggttaaactggtggcgaatatcactataagtatgtatagtgtggttcaccaccaatttaaatgacattaatagtaagctgatggtcatcagtaaagggaagttttgatttggcagacagcaagataatttggggggaatatcttcctaaataattaattattcctctgtttgtttattcatgtgactcctttgggtcaagcattggtgtgagctgcccagtgcagcatttttgacagtagagcaatgcaaggaaatattggctgcctgagatatggttgtggagggtgagggagggagacttggaaaaaattgcattaattttgctgttttgcccaatgcctgggaagaaaatatgctgtaaccattggttatgaaggtcttctctggaaggctacacaccttagcctccagggcataggcctccattgtaaccagtattttgttctccagttcaaccctgtggctctcagttggttctcttttatcctgtaaagaggatgaacaaaacagggtgaaagcagggtgaaataaaacaaagtaaacaaggccgaagggggaagtggaaagatttgtactgattcttattggccatcctacatgtcctggggaaaaggaggtcacacctctactctcacatgacctttctctcttgggtccatcaacctcttccaaggtgttgccttggggcttatggattttcttttacttcaagaatcatcgactgtaactttcccataagtgtgcatgtgtgtgtgtgtgcatgcatgtgagggtaacagtatgctgcagccgggcaggcatagccattttttgggtcagagatgtaaagagtagtaagaatctggatgaataggtccttcactttggaaaaatatcttcactggagcccagtagctggcaccacctcaataatgtaagccataatggagtgggagggattttattaaaagaaaatcaataaacattttatactttgagacaagtgttccctagtgccatattgcactctcttctggcctcttgttggcatggtcaactgaacaggaagaactgggcttcctccaccctgagttgctgtgtgtcctttcctgccagtgttctcagccagccatcatgccatgagcacagctcgctgcacgtccgtcgtcagtggggaagtcagtgatccagcttgtcacatcatgtttcaaaaatattgcactattatagtcatctcttgtgtttataatgcagcttctccatgaattcttcaagactcaaacaattatgggatgggtgggattgtctccttgccacataataaattacccttccttggattccagcttccaccctggacaggaaagctatggctctatttccatttacagattaagtaatgaaaattcactccaaacattggtgctatacataattttcatcagtagtgttgtaccttcttattcatattcatagacttttttttttttttttttttttttttgagacggagtctcgctgtgtctcccaggttggagtgcagtggcgcgatctccactcactgcaagctccgcctcccaggttcatgccattctcctgcctcagcctcccaagtagctgggactacaggcgcccgccaacacgcccggctaattttttgtatttttagtagaaacagggtttcaccgtgttagccaagatggtctcgatctcctgacctcgtgatccgcccgtctcggcctcccaaagtgctaggattataggcatgagccaccgcgcccggcccatattcatagacttttaaacctcactccatcccccatacacacacacacacacacacacacacacacacacacacacactattccataatttactcattgggatggagtgaagaataattgcttcacttagcaaaacttttttttttttttccaactgatggcttgcaaactttacagattttttaggaagtgtttatggttaaagagtgtttgtggtttccatttctgcttttaaaataaacaataaaatgatgtttggactgattttctcttgccttaaatatgtgtttggctgagtgtgtgtggcatttaacagagatcagatgagataactcatgatttaattgctcagttcctttaacgttagccgaatgcctcaggctactaggtttataacccttctgtggtttttcattgtcattcatagtccttgattacataagagtcagggtcaaggcagaaaagagccaaaatgctcaagttcaaattatgtaatttgatgagagtttaatgaggagaatatttaaaatgtgtgaaaagcatgggggatggtgggtggaaccacaagaaaaaatggagaacactgtgactaatgtcagagagctgtggtcaagctaagcctgaagaggtgaggagatggagaggaccccttcccaggagctgcaactttcagtcacaagactcagccagcctgtggtgacctagagcctggagaaatagatacccagtagatacccagctccacatatcttcatgttctagtggccaaacccaacagaaaccatagcacaagggattgtttgatgcaatccataaaagccaactctttacaatgagtcattgagtagagaaggatggagagtaaaacttgagaggcagatggaattgatctagcacatattgtttaatgcaaacctgtagtcaatcaatggttggaggcagaatgcatacttttgctgtaaacatgtctctgatcttcactagatctacacattgccttcattcagtcaaaatttatgaaacactgagttgtctatagtgcttcaaaaaatctatattcaaaaaatatagtaatgattatggctattttgactcttcattttttgagggaagcaaacatccaaacctagcattatggtaattgtgaaaatatgtttgtaaatcacaacttaaaagcttatcttttatttcttcatatgtaaaagttataaaaataaacaagctaactttttgaaaatcaaaatttaaaaatttccaacatcaattcttgaagccagttttaaatgcagtatacacattgaatatcccttatctgaaatgccgggaaccagaagttttttggatttagatttttttcagattttggaacatttgcgtatacataagatatcttggggatgggacccaagtctaaatatgaaattcatttatgtttcatgctacacttaaacacaaagcctgaaggtaattttatacaatattttaaataatcttgtgcatgaaacaacgtttttactacgagctatcacatgaggtcaggtgtgaaattttccacttgtggcatcatgttggcactcaaaaggttttgggttttgaagcattttggatttttgattttcagattagggatgttcaacctgtaatacatagttaaactttgtctacattttttatactgttcagttcctgtattaggctgttttcgtgctgtttataaacacatacccgagactgggcaatttacaaaagaaaggggtttattggatttacagttccacgtggctggggaggcttcacaatcatggtggaaggcaaggaggagcaagtcacatcttatgtggatggtgacaggcaaagagagagcttgtgcagggaaactcccatttttaaaaccatcatagctcatgagactcattcactatcacaagaacagtgcaggaaagacccgcccccataattcaatcacctgccaccgggttcctcccatgacatgtaggaattgtgggagttacaattcaagatgagatttgggtggggacacagccaaaccatatcagttccctaaccaaacatgctacattaatatgaattatttgtccataaatagtatgtattttcatatattgtttaaatagcatgctgtgtttattaaatgggaaaacatcaaaactactctttatttttagtaaatattgttaaaaactaacttgagagtgaacttagggtacaatatgtaaattatacacaaaaatgccaaagtgtttaaaactagttcatgggagtgcagttgggatattacatgggtagtgaaagggattacagagtataaaaataatggaaaatactgacttgggcctttcaggaatgtccccttatcaacttaaagcaatgtactctactaatctgaaaatgtgtaccctgggagttaaggttaaggacaaggaagggacgtttaagggtgaggatccatgcactcattgggcaggtttggttatttgcctgtctgtgtgtttgtgcagctatagcaaaggaatcctctcccagtagcctcaggaggattacgagtaggtagagagagggcagtacaagggcaaggaatccaggatgctccataaagcccctgcccacatgactgctggaagcctggcccttctctccttggctgagtatcaagaagggggacaaggacaaccactgttctactctctgctcctatgagttttgactattttagatttctcatactagtggcatcatgtagtgtttgtccttctgtgtcttatttcacttcagtgtaatatcctatagattcgtcctgggagggggaaatggggaattattaggcaaagggcacaaagtttcagttatgcaagccgagtaaggcctagagatctactgtacaccatagtgcctgtaattaacaatactgtgttgaatacttcaaaatttcctgagagggttgtgctgttaagtcttcttaccaccaccaaaaaaaaaaaaacctaataataaataaacagggcaggaaaacatttttggagtaatggatatgcttttgtcatggattgtggtgattcatgggtgaatacttatctccaaactcatcaagttgtgtacatgaagtatgtacagttttttaatgtaaattatacccccaaagaattttttttaaaagaaaagaggatgggggctaaagggtccttgctgcagtccccagttttcatctgtagaaccattttactgctgtcactgctccctgggtctttggtgtggtcactatcctggtcatcgcagcaaatacagtgccctggtcaccctggggccctttgttctttcttcagtagttcccgcccacttgtctaccttcttctggctgctgctgttgggcctgctggtacttgtgaacccagatgacctgcacggggagcagaggcccaaacctcaggccagggtggcaatgaggacacttcctgtcatggtgttcaggtcccaggtacacaagcaaatgacccctttgctccctgatcatgatgggggacatggtcccaaaaagttccaggtacacaaggtcccaatcccaaaaggttccaggtacgcaagcaaatggcctctttgttccctgatcagatggtcctcagagacaaatggcttctgtccttcttcctcacttcctcagcagggctgattctgcttctacatatttaccctcctttttggagaatctggcccaagtcatgtgtctcatgataaatctccggttttgattccagtctttttaagggactgatctcattgcatatttcatatgtttttgctctctctgttgctgaatttgattgaagtataaactagatattagcaagtaaaaacattttatcaaaatgactatttcaaatatagtaatttaggtgtagatgaacaatcagaaaagcaaatctaaacatttttgaaatctttgtgttcttctcctatttagaattactgtcagatagatgagatcatatatgtaaagcagtgtatggtaaatgtgcacctcatatttggatgccaggtgaggagagctagtttcctcatgaaaagcaaatcaattatagactatgtacaaataataaaaaatttagtattttttaagagagaaattagaaatatacagcttctctgccttttaaattaataaggcatataaaactgagaaattataaaaatatatacatacaacataataaatatctctgtataaaatatataattaacatgttatagttatttacatatgtaatgtgtatatatgtatatctatgtgcgtacatatgtatctgtgtgtacatacgtgtgtatatatacatatgtgtgtatatacatacacatatatacacacatatatatgtgtgtgtgtatatatatacatatatgtatatatgtgtatatatacatatatgtgtgtatatatatacacacatatatatacatatatgtgtgtgtatatatatacacacatatatatacatatatatgtgtgtatatatatacacacatatatacacacatatatatgtgtgtgtgtatatatatatatatagttgttcttgccagataagagactgaaaattcataaaagggcaaaaatagaaaaaaaaagaagcattggggaaatgaagaaaataatgacatttaagataaaaattggaggaggaacatgaacaaaatgtatatggagaggaaagaagagacgaagaggtgaaaggtgagaagcaaagggacagaaaggtccagagagccaccagcaaatgagtaagagtatctggagaatgaaaaggaggagttgtgaagccaccaagctgatatttacaagctgagctgtgctcattcctgggacacactgggattccctagggcaggcaggcttggaaaggggtaagggaagcagttcccaaatcctcatttaccgtttgtctctttattaaaacctgaatctgacctgcctgagaacacttttgtgattctttgcgctgacctccctttccaaattgcctttcttcaatccgcttatgacggaaatcattcttttcagtctttgccccaggtgtaaaaccctagggatgtcaaacagacatgaaatattgatgtcagaaaaaaatctcctttaattaaaaaaacaatgaaatgaaatatgatttcaaggaagaaaaagaaatgatataaaattctctcttgttaaagaaaaagcatgttatgtattctttaaattgaccaccacagtgatgagcaaagccagtgcttagtttatttataatccaggcagagaaatatgagctgaatagttagctgagaagcaaaaatcaaggttctgctgattaataattggagctttcactccctatagggcaggattaatccaaaagtacatccacagttgattaaacaagtcaggtaagtctaaaagtaccttcaagttggtttagcagttggttaggaaagttttttattttgatgaaagtctagtaaacaggtgtaattcttctttattagtttcagctggttaaaagcaattttggtttaaacacagcattccattttgatatctactaggcaagtggtattgttgagaggacagttttccttttacatggaaaatgtttcctttttcatggtcttctccaataaaaagataggcatattattaccttttcagatccaaaccattattttagctcagggttcccaagaaacggactcggagttgagatttatgtgtatgaagtttattgagtgatctcagaagtgacaccggtaaggaagtaaaagcaccaggactgggtagagggaggtgttgaactgtggggcagtcacaacagaggccttagccaactccatggggaactggaagagcccttcagagttacccggacttgaccttggccttgacccacaactgggcgagggctgtccttggccgatgtcttcgttcattgcattgctataaagcaatacctgaggctgggtagtttataaagaagagaggattatttggctcacagttctgcaggctgtacaagaagcatggcaccagcatctggtgagggcttcaggaaacttctgctcgtggtgcagggggaaggaggagccctgagtgtagagatcacatggcaagagagaaagaaaaggggtgccagtgtcacccaacaatcagatgtcactggaactaatagagaattcactcattgctgtgaatgcagcaccaagccactcataggggatctgcctccatcacccaaacacctcctaacggttcccacttccaacactggggatcaaatttcagcaggagattctagaggggacagatatccaagctgcatcagctcaagtgactcttttaggctcagggcaattcctgaagatgggagggtgactcatttgaagaccttcagcttccaagactcttctcaactgagggaatgagatgagtggctcaggcctgaagcagagttatctgggtggaaagccacagtattcaatactgtccattcctggtgctactcagagtaccttgttttgtatcgtacatttttagagcagctctttcagggttctgattggtcacatttcctgggaaacatagaagaggaaggatatgggataaactatagcccccatggttgcagctggtcttacatctgctactgatattcatcatctctctcctcaaccacttatcctggattcacctcactctcaactagtgcctctggtctaggtgacctacctggtaggcggaccaagaccgttatctctctgcagtctgattccctggtcttggctgctgcagttgtctatttattattaaaattgttcatagcattacaaagcctgtcccagcggatttcctggttaccagatgtattcttccagcttctgttgtcaggtaacagctagatctgtgcctaatgatcaggatcaattactcctgtcaggatgctggctcctttctgtgcctgctagtctcttaacacaaaaattccaaagtaactgggtgcagcagtagcttaaagtttaagagcttcctgttaagtcccatgacgaagaaattcaccgtcatgggatttagaccctcaaagcccggagctctggggaccagaagcacaaactcccaaagtgggccacagtaggcatagccactgttactttctctcactggtttctgtatttctgtattttgtcatggagacacagcaccatgaaatgatcatagatttagtgagtaaacatactgagtctggtggatggtgctcataggatattttctcaaagctgaagccagtgttatattttcaaaagattattccatctctctgtcaggccttcatcttctggatggtgtaggccgtgatagtccagtggatctcatggtcacatggccgcttctgcacctctatgccataaaataatttccctggtctgacacaatgttgtgcaggatcctatgttcgtgggtcacacatttcgtaagcccttgcatagtggtgctgactgaggccctgaagaagggagaggtaagcccatatcctgaatatgcattgattccagtcaagatgagttgctgccccttctaaagcggaggggcttcagtgtaatcagtttgcctcaaagtagctggttgttctctctgagggatgatgcaatattggattctcagctttggtgtcttttgctggcaggttagaaattcagcagtggcaggagccagctcagttttggtgactggccacccatgctattggacccacatatagcatccatcactccaccaagggtactgcacttacaagcccattgcaccatccatcaatgggatggctcatgacacagtatggtacctgcgttgtgtctaagattttagttcttacaaagggaaagctctctggtaggaattaatgtgcaataatcttcactctttgtacttactttcatatgtccttccttatacctcttccctagacctcctgtttccctccagggccctggccaaccagccttgccatttatcactgcctgtgcatcattatatattctatgtcaagccacctatcttttcacataaatgggatgacaatttgcttcacctgaagttatgcccatgaggaggatttcttattattcctgtctctaggacccactcctgagtaggcttcagtgcagcagtagtttacttttggcctggacgtatataccaagttgatccatgcatgaaccaatctcagcattttcctcctctttgagctcgtcattcagtactcccatttttccagaggtgagttgaatgagagacctggtactgtaataatagtggataatgtgggtgatctgagccacctactcatgcatccctggtactgcttgttccagatctcagatggtcccacttactataacaatggattaaggctgggctcactcaaccttatgatgtagtgatctgacagaactcagctcatgacacctgatgattcatggacaggtatttctccaccagagtacagtaacctgccagaaaatatttttgaaaggtgtatagttccctcttgcagatagcacaaccttgtttcagaatcctagagtctgtgttgattttcctattggtgcttgttataagcatcacagggcatcttttctccttctctaaatttctaatcacatggagtgacagggattctttcattgcaggctggacctgctgcagcactgtttcatgctctgggccccattctaagctggcagcatttaatgtcatccaataaatggatcacattcctaaatgtagaatgtgctgcctccagaacccagaaaggccaaataaagtgctgtgtttcattcttagtggtttaaattatgaaatgcaataattttttctttagattggagaggatattctagcataccttggactactgacccctagaagcttcattgacatgggggacccctgactcttcatagggcttatgtcccacctttcttctcaccaggacctctgatgtaccttccacttcttgctcatctgctttaatgtgatgctgctgatatggtggaccaaatgatgttctacagaatgttcacacagttcgggttcctttgcattagatctggataacattcagaagagttgaaagccctggtacatgcctgtaaaaatgtactgttaaccctgaaagcacttgcaaatagttttgaattctcctttcagagagggatggaaaaaattcatttgccaaatgtcatgtacttaaggctgaaatattctaaatttggcacagtggctgcaaatagagtgtactgggttaaatttgtgatattcaggcaccattctccagtctttggttttatgggatctcagctggtgaattaaatggggatatgttggagtacaccacctctgcctcctgcttcctttagtctttaagggtggcacttagataattttggaaatgtaaacacaataccatcgtcagagctttcaaaattaagataaatttaatgcctattacttcttaagaatgtgacattgattttgatttagttatggctagaaggatggtttgaagctttcacttgggcttcctcttacacaacagaccaagaaaccagtcttggggttgtgccagtttccaagtctgttcactccacttacacaattgaggacaaaggaaattaatactgatggatttgtggaaccagtagactctctgaaaaccagccctggtctaggactcctgctttttttttttttttttttttgagaacgagtttcgctcttgttgcccaggctggagtgcaatggcgcaatctcagctcaccacaacctccgcctcctgggttcaagcaattctcctgcctcagtggcccaagtagctgggattatgggcatgcgtcaccacgcccgagtaattttgtatttttagtagcgacagggtttctccatgttggtcagtctggtcttgaacacccggcctcaggtgatctgcccacctcggcctcccaaagtgctgggattacaggcatgagccactgcccctggttagactcctgctttttttttgtttaactgggcctcacgtttgtttgtttgtttgtttgtttgtttatttatttgagacagagtcttgttttgtcacccaggctggagttcagtggcatgatctcggctcactacagcctctgctccctgggttcaagcaattctcctgcctcagcctcctgagtagctgggactacaggcgtgtgccaccacgcccagctaatttttttgtatttttagtggagacggggtttcaccatgttggccaggatggtctcgatctcctgacctcgtgatctgcccgccttggcctcccaaaatgctgggattacaggtgtgagccaccatgcccggcctgtatctttattttaataggggaccattagatacctggtgctgcttcatacccagggtatacatgtcaacttgtacagttgtccattagtctttagaatatttggacatttctctctctcctcagcatacaactacccaagttaatggatgtaggtccttttagttaaagaccagaaaagtgttaccatagactcttgctgtgttattgtaagattcttctcctggggacttaccctctccttcaatcaatggattctgtctttgaaaactagcttaggtcgagaaacagagcaaaagattatgactttttattgcaacatctgccctcatctctcttgatcatccattcttgatgtcttctgattctattaattgaggaatgtctcttttatccgataatccatctttcttgtagggatgtcatgctatgttaaccatttccatagctctctaggtcaagtccccttgcaacttcaatcttacagtaagtgcacccactttgttttgatggtttagtgctattattttagaattctatattccagttactgtcagagtgcccaatctgtaaggtgtttcctagcatcaggtctaacctacgagggagagccacctctgaacttcccaacaatgttggtgctcttctcaccagcacatttcttattgctttggtaaatggagtgtcctttgggcctctggcagatcatagtcagctgatgggcttttcagctgtacctaatatagcagctttagcctgcctagttctgagatttggtttgcttcttcctctgtcacagcaattcaggcatttttactttacttaacatggttcattttttttttgttcaaattttcaagaggcaccctggtgttatcatcttctagggttcttgataatgtgttaaatcctctagtatagattagtgctcccacaatgggaaattctcctttatccaactctaagttctgccctttttcatccttcaccctcaggatccagtcccccactctctcccattcctgctagtacatagtgattaggtcctgcagctagttcttttgagatgtagtttttttcactcttagcagcctcttcaccttccctgatcaggcacattgctctgcaaagattattagatcatttgagatactactgggaagagtagatgtagtaaaaccccaaagtgaagtcaaaactatttctagagagcagactcttttctccctctaaggcatatattacatgctaatgtcaccttgacataaattcatgaagcaaggaggggcacaatctgagtaattctgggaaattttaaagtctccttctcagttgtctgggaactagtatagcaaaatagtctatgtttacacaaaaaggaagtgtagataattctaccagcagaagagcattttctgcaatcaacgagctaaggctaaagagtaaagacaattatttcctgtaatgtcacaccatcggcaagattatatgttaggtggcttaactgatttgtcattggtaactctgttaacatcaatcctatctttcaaaaatatttaaactattttaactagtctttttttcaaaaaaaaccctgctttgtgaatattattagcattaaaatgataatttttattggtaagtttattatgagttaatcagaggtggaaattaattttcatggatcagcattgtcataatgatagctagttgccttactaaggtaatactttcataaaagaaaccttcctggtgttctaggacaaagatataaacccaacaggtaaaggttcatatatgattttggccttattgaatatagcactaactatctgaaaaaaatatttttgtcctaatatcaggatagtcatagcaatatgaaatataaatattatagctaaaaatagttaatgtaaattaaaatgtacatcagttgccattgttataggtgtctatctcaattccaaggtcttgggttaagttgtctgtttccacgaaggcatctgcttctgaaatgaagatatcgtggaagctatgccttagttgtttcatacagcatgacacatttgtggtaagagttgttaagttgtactgagaatcttgtgccttaaatttttgatgtttttccccagaagactgaatgatctatagcttgcagcaggagccttcagataaatgaatggaaaaagcaaaacctttctcaggatgatgggggtgattggctttgattaataatatattgtgattaccaacaatattagaatggaggaatttagaatacagaggggtaaaaaaatgtcaatctatggacataaatccttgattcctctggaacgggaaaatattatagacagtaagggcactgaaaaactttcagagtcttttattaatgccataaaagatattgtaattaaatccaagagacatgcatttagatttttcaaagatgattctaataaagtaactatctagattcagctaatttgcaacactgtcagaaattataaagatcttgtttactataatccaatatagatgaatatatatgtttacattttgaagatcttgaatatttataacaattttaagactagtaaaatttgtatagaaaatttaggaaatttagaaaacttaggttttctatgggtaaataaaccctagttttgcaaagtctagaatattatgctaccatttttacactgtgagaaaactatggaaaaggcatattatcaaaccagcctaattttcaaggtttcacattagtcacattaccaggcaagggtacacatatcagcagaaaactaggctgaataatttgttgaaggaaaaagccaataatttgtgtatgtattagggagttgggttatggtgggttttgctggttaaaaactgaaggctacactctggataagacagatatagtccgtaagtcagtagatagttggttaaaacaaatgccactttttatcactgaaaaaagttttcagttaggttggtgtgggtctgtacctgggtcacgtgaaggtctcagttgcttatctgcttccactggtggaatgcccaaacatcacagttgtttgtcaacttcggagggttggaagcaattatgttgaaacaccacaaccagtttgaggtcttcaagcaaagtgaaaatggaaaaattgtcttgacactagtgtgtaccaaatcactatgttattgctatcccatagaatacctttatatgtggtccaacagtttgattttaaaattttcatcttattttgctagaaacttaactttgccattaattaaatgtatgataaacattttagagatgaaatataaaatacataaaagtactttttttttttcaaaaatcataggaagtatttgtgtagaaatgtttggagttctgtgttttaagataaatattaacgaaagcaaattgagtcagtcttattttataattccatgggtttgtcctttgtaatactttgtgagccttggacacgctagtggatatggagaggtttattttgttgtttaaagttttggaggtaggaggaatatcaactcttgtgttggatcaaatcagatcaaatagggaatcagcctatggtcagaatattctctcaccccaaacaaagttaaatacagaaataatgaaataaattcagcttatcttaagtcaagccctttttttttctggtttcagccaaggctgtaaaactgagtgccctctggtacctgccctagatgacagaagaagtcagaaggcaacaaaactttagtactcagaataaatctggtttaaactttattccaaaggctcaatttgattgaaaaatcccaaagaacaaaaaaagaccttattcctcaatgttcttggtatttttaatcctgaagtcagttggatccaaagcatctggcctcccatccctattttcctctttgacggtactgaactaaacagctcttaaaaatcacagagtcggttgaacttcagtcagggcatctgtcagtaccatattagcagatttgggccaacatttaaaaatgagtaattgggaatctggttcattttggcatgctgagagcctggccagagtcttcctatagcaggtggtttaatgggaacttggtccatgaaggctctgatgtgctctatttatgtctctgtgttagatgataagcccgaagctatggttgctgtgagtctgccagacaagaatctaaaacaaagcacagagttgattaccaccaggctcattgccaagggccctgccacaatactgcataagtgtagtgcccagtgccccaattgtgattggccttattgtttgtttctagtatcggtctggctgttagtaccacagtgtattgtatctattctctcccaaaaaccagagggctaatacttagtagcgaggtggggctagatacactcaccctatatcattgagtagagcatcacttagtcacatattagacaccagaaagctttctcggcgagatggtggaagagattcttgttcatagatcttggcaataaaagcactccttagctttatataaacacacattaaatacataagtaggtaaagtgttataaagagttttaaatgcatggcctcatttgatgcttataaccacttagtgttataggagaggtttgtattattattcccattttctcatgaaagaggaagttagaagagttaagtgatttgcctaagatcactcagccaacaagaagatccaagaatggttctgagctttgccgtctctcctcagcttttgtttcatgcacagccatctgatatctaagtggagagaatggtggcctggtgattgcatttaagacttaataatgatacatttaaaactgtaacatttagcagacctctagttgtggctactactgctgtcttgccacaaattctactgtattgatttttatccatgccgcattttaatattgtggacttaaaaatgaacatcggaatcctaccatctttgcagtggctgtaggggttagtttttttgcctggaaggatgctgtgaggaaacattttcaggtggcttgggtaaggcttataatgtctggatagcgtgaagtttgtaattagatcatgacagaatagcagcaactttttgttcaattaatcagaaaatatcatggcatgcctatgatgttcaaagaactatgccagtttgctaagaactagacaaggactgactgccttcaaagaacttacagttccattgagagataatacatgtgcacacaaaataaccagccacatagggcagctatttataatggcaagggtaggtacgaggcaaggcaagcctgtacaaggagaggtcacagtgagttgaggttattttggaagactcttgtagattttttagtggaagcaaaatttagatactgtatatgaaatgggggtaggtttctagatggtatgttgggagtgaagaaacagccaaaaataaataaataaatagaactataaaagaataaaacatattgtggatatgagtagacctgtctcactgcggacaggaatttataatgcaaaggagtggaagatagatgtcagaaaattggtgggaagattatggatggccctgaatacctgcatgaagagcttgttctgttaatctgtaaggaaagaagtgtcattcaagtattttgaatgggaggcagaaacttagaaagcatcatttcaccgggtggcagtgcccaggatagagtgaggaataaagggagaaacagactatcagtggagggacaagttagaaaatggagcaaaaatccggatgggaggtgaccctcagcagagcgtgataccggactggacagaggcactcgggtctcaccccggcttctgctgctcttttccttcccacacagtagccacaaggtgtcgctgtagcctttttttgctccctgaaaaatggcttgggggatgatgaggagcttttcaaatggctgcaatgtgaagtcatttctgcagttttggtgccatcttatttcatattgaacagtttagcatcatcttggaaaatacctgcatacctcaccctttggcccactagactctgtgtcctcttgtaagctgttctgtttaggcggttgcaactctcaggtgttggggactgtgggggttgttgctggccctgtagtagtaaacacatggacatcaaaattcagcacttaagtccgtgtgtgtgtgtgtgtgtgtgtgtgtgtgtgtgtgtgtgtgtcagaagcactttttttcttcttgggaaaagatactgtcattgacagaggaagaaatagcaggagtccttatctgggaggagaggaacatatcaggggtcctcaagaccaccccaggttcagtgattcactaggaggacacacaggactcagtgtatagtgctaatatctatagtttattacaacacaaggatgcaaagtaaaatcaacaaagggaagggctcatggcacaaagtctggaggaggccaggcacaagcttccaagagtcctctcccaggagagtcacacaggatgtgcctaattcctccagcaaagtactgtgaaacacatgtggaaggaatactggactcagtgtccagggtttttattgaggccttttcacataagcacttttcacataatcacataagagttgcaactgcctaaacagaacagcttacaagaggacacagagtctagtgggccgaagggttaggtatgcaggtctctgcattgcacataataaaattccagacttccagaaggacaaaatgtacattggtgcaaaaagtttcttttctgtctttttttttttttttttaattttaatatagagataaggtcttactgtgttgcctaggctggtcacaaactccagggctcaagcaatctgcctacctcagcatcccaaagtcctggaattacaggcatgagccaccatgcccagtctgtgcaaacagtttaggcccaatgagactctcttaactgtgctgtcaattggagaaaccctcctgcaatccgagttcccagatgccaaccaagggccaaccttgcaagcagcctttctttatttttttttaaattttttattttattattttttttgagatggagtcttgctctatccctcaggctagggggcagtagcacgattttggctcactgccacttccgactcttggattcaagaaattctcctgactcagcctcccgagtagctgggattacaggcgcctgccaccaagcccagctgacttctctatttttagtacagacggggtttccccatgttggtcaggctgctcttgaactcctgacctcaggcaatctgcctgcctcagcctcccaaagtgctgggattacaggcgtgagccaccacacccagctgcaagcagcctttttaaggagtctgatttgctatgttaactcttttctgcacagggagtgaaaataccgcttaggtttttgagaaggaggtattgatggatacatttttcaaaacccaggagagtctgacgttaaggtcatgtctctggaagtggtagttcaggttggagcaaaagtagtgaaaccagtcctggttgtctgtccacatacagaagactggagaggtagaagagaactgggatggtgtgttaggaaatcaagagaggagagaaggccgggcgagatggctcacgcctataatcctagcactttgggaggccgaggtgagcagatcatgaggtcaggagattgagaccatcctggctaacacggtgaaaccctgtctctactaaaaaaatacaaaaaattagccaggcgtggtggcaggcgcctgtagtcccagctactcgggaggctcaggcaggagaatggtgtgaacccgggaggcggagcttgcagtgagacgagattgggtcactgcactccagcctgggctacagaccaagatcccgtctcaaaaaaaaaacaaaaacaaaaacgagagaggttcaaaaggaggaaatgctcggtagtatataaagtactgcagatgggcagggattatgggcgctgaaaaatgccattgggacataatttaataatgtggtaattgattttcaacttaaaattatctgtacacattaagccagacttacttagccagtgccttgaatagctttcctgcctatcacatctttctgttttcttttgatcaccttacaaaagctctgttttaacattttttattgtggctttgaattttttgtttgggtttagatttcacaggcagagggaaatggatgagctttgggaaggctaaaaaaattctttgtgcaatactacatacttctctctggccattatttagggacagcagcagccgaaaatcacctcttctgttctggatggaaaagtaattcagtttgttcctttaagaggattaggtttaccatttcattgatttcatcgttgcttcctggtaaagaataaaaattaaaagctgcttgttttgagtggagacatctcaaggggcttatgaaagtgtctgaatttactactacaccgttggacttctcccagacccggagttccagttattgtctctctgatatttcatttctttttttttttctgggttctcggatgctaaagttgtatagaccctctgagatgaatgattattgttagacaagaccatgtgaaccaataatggcttttcctttggttataataaaaacatatcagaacaacatttattttttcaaaaagctctttttgtgtggctgactttgagtagtaggtggtctaggaaataccagcacctcctctctctctcacttgaaatgcttcaggattagaaaatcattgcaggcagaaagtggagagtgtggtgctcaatgtggcctttgcaattctacttacctccagtggtgggtgacagtcctggccttctggccttattcacgtcattgcacttcaggagggcaaatgtgcgctgtaactgaggtggttttaaattatctgtctcttgttctaatatcccagggcttccagcaaaagttctccttccacagtaaagagattgtggctatcagctgttcctggtgcaagcaggcggtaagattgggatgaaataaagcaatgtgggctcatgttttgtcgaaatacacttgtgtcattatttgagtttctccctggaagtagaaggcattcctaatttaatgtattgcttttctcatataggatccttggaggaagaaagacagactgaaactatagaacaatagcatagatgagctgggatacactagagagataaattaacttctatattttatgtacattaaagcttggggtcaaagactagaaaatcctcccctaattctaacactgggtctagagttgaggacttctcacacctagaccacattttccctccagtacctctgtattgttgagaactcctctggtatgaaggtacaacattagaagcaaagcaacgtatgacctaagaggtccctccaacacaggtggacaggaatcctggctcttctggttttaatgtttaatgtgcatgactttttattttggggctaagtgtgaggataagaagagtggttcttgtatgcttttttaggtttggatgttgtctgtacactcattgaaatgtagctctttcttacatttgaacatatatatactcattaggatctgatggtaatgtccctatttatttttctttaatctaccttttttcccactttatttagagcgtaattcctcggtctgtaccagatgctacattttcttatttgtttgtacatgtgtacctgtgtacctgttctttcttttaccacataacatatagtctaacccaggtgttggcagactacagctcgtaggccaagtctggctgccatctatttttgtaaataaaatttcactggaatgcagccatgcccagttatttatatattgtctgtggctgttttttttcatttatgtattgtctatagacactttcatgctacaatggcaaggatgagtaattgcaacagaggtggatgatcccataagcctaaaatatttattccctgtgcctttatagaaaaagtttgctgatgcctgctgtaatttctcaatgtccctattcttttgaataagttggaatatataaccccttcattgcacaggggacctgcaaagaaaaggctgtggtgtcttggtgaggttaaaggtttgcagaaaactcctgccactacacacatcacgctaaactagccacacaggccatggggctggaacagatgcatttagttgaaacatatgaaatggacattttgtgggtcaaaaccatttatattttggcagttccatatagttcaacttaataatatctctagcctcctacatgtcagaagaacctgctgtcactagatagagactcggtggtctggaaagctcagtgtcgctgcatcacaatcctgtgacattttttattcctggcattttcatttactttcagttagttgttacacaaataatcatttcacttctgttcaagaatgtgtgcacaaatataaggccatcctagttattgaatgaaactctgtaccagcaaggcaatatctccatttgtggtcctggggtccccagtgctgctatctttgctcctggttcttctaatctggtgagaccccactggtggggcagccttctgggcagcggtgtgctcagatcggctgcatctgctcctgccctgtgcagctaccaggctgtggtgcgatggtctatccagattcaattaatttggaaactcaatcccactttacaatgaacatgtgtgctctctttctattaatctgtagtccaactgaatcactacaaaggacaactttcacctgaccattgtggtagagctttggtcagttccacttatctttgaatttcccagtttcccaccttgtagaaggtgatttttgtaaggataataggtacaaaagatttgaacacaaattacagcggttgatatgttttcacagtccaggtgaaccccttctaggatatttgatgtcagacaagcaaataaatatgtgaccctttatggtacaggagaaagaatatggggtttgggacctggatttccagggttggggttttgattccatcatttaaaaactgtgcaatcttggatgtacctctgagtctctagagtggagattacttaagtattcattgagagacttgacataggcagtctctgcgatccctaatgttttagaaatgcagtggtcatacatttgagggtttatttgaattgccaagaaaaaaaagcaatttttaaagaaggtattcaaatgttaataatatttatctggtatatttgtttgcagatcaccaataactggtggcaggcagaattattaattattttaccagtattttatatacaattgcttgattaatgattagccactggatcacagcagatcttgaagacatgtagaaatgaaaacaaaaacctctctaatgttatgtaatgtaattagggtggacatatttgccagtttttttggagacggtcctaatttgtgtttgtgttttcaacataattattatcagtgatactttttacttttaacattgttccagttaaaatgataaataatatagttacgtgaagtataatctaagaagaaactgaggttgaatttttaaaatcactgtgattaaaatttaaggcctataattattgcataatgttgattttagttttctttttcagaaaaataaatgttattacacatcactatcactttatagtcacacaaaagatggttgaaaacttgactggcctaaggtcaccagtctgagtgtcactgttggggtatacagttaagaccctaatactgtggtattgttatgatcgttagcctacatttacttcctttcaaaagcaaaaatcactttagacttgccaagagtaatagggtcattgaattttttttttagcagtccagacaaacccaacagaagcaatctctttgtactttgttacttctgggattttcaactctgtagaagagacatcatgcttcttttctgccttctctaaaccggaaagacaacctgggaggatttatatctatgataggaaaaggaaaggcaggtggtaggcattgcctttctgcctgttcatttccttcttaacgttatcttagatcaaccaagtccatggccagcacaggtcaagggaagtgtatgtgaacattttgtgcaaaatcaggattaatagaaccctccaagactctaaaacttttaagtaaatattccatgcaacgattagaaagttttagcaggcttcatcctgctagactgatttcttgttatcaatgttataagtttgtaaaccggaataaatctgaagtctggtctctaagctcctggggctggctgggtggtgatgaggaaagcatgtcctcagtcctcagtgtgtgcccatgtgtgcatgtgtgcatgcatatgtatttttgtgcatgtaatgagtgtgtgtgtgtgtgtgtgtgtgtgtgtgtgtgtgcgtgtgtacatatttatcccttcttgctgcagcattactctttgaccagaattgtttactggcttatttttctcttcagtttcacaataaggtgacctgcttcatgctgcatcacattgaagaaccctgctccctgggggctcatgctgctgttattgtcccgcccacttggatcattaaggtgaagaaacctcaggtaactgccaggactctggtgctgctgggccagtgcagagaaaaatgaactgctgcttcgtgcttttctccccagactagtctttgggttcctatgacctcagttcactcatccccaaggccctgtgcttagcttcctcagttcatcccattggcccatctctttcccactttgggctctctcatggaaccagcctccccatcctaatgaattcaaagttctagagcaggaatgttgcctcctcattcatgtgctaatgatattctctttgataggtgctcttccaagtttcattgagtactagtggtgggtatagctgatgcttatacaactctgttctcttccagcctgggcattcccagagggtcagtgtgagggcaaactgttcaggcttcatggtttggttaagattcctgccacttccaacctggaaggcagaccatgaatcatgaccttcctgaatacacaggcctgcttagagagtgacatttgtttttttcttaaggcaaagtagaatttattctcttaatatctaatctcattctgtgttctccccagtgcacttcctgtccttgtgagtatccacctcagtattcagggaaaccttagtggtttcttgacaaggtcgtaatctttgaaataaaatgtttctgcctttgtactatacatccttgacagttagcttcaagttatgggatggcagatttttaatgctatgggaagagagactatacctcccttagggtgcaggtactgtaggaagacttatcaaatgcaatacctttaaatgatatggtggtcctacttcctgtggtctccagactcatcatgtgattcattctcattgactcaggtttatttaaaaactggtggatcagggatactgttttgctttctgtgttttatataaagtttagactctgttgatgagtaatgtttacgaataaaattatagtctatggaagcccttgggatatttttttccagaggcaagtatagtgtctacatattaaaaaatgaggagcctagtgcttcattttatattttagaaccaaatgccaagatatgttaaatgagttacccaaggtgataaaacaaattatatatagtattactatttgaaattcaagtgtactgaattccagtttttatttttaaatctctttaacatttctactttaaaattttttttttctaaaatttggtaatctctccaaggctttacattaaacattcattcagttaaatccacatctttccattgaaaacctcgattgtatcaggaaggctaataggcattgcgataaaatacgtgatccttactcttaagagtcttgttatgaagtgggggggagggcttcatgaagaagatgggatttgttctgctttgtaaaaatgggtgagatttaggtctgtggagtagagagagagtagcaggcaggagaatggcacacaggcatgagtactgtgtccaaaattatatccgtggaactgtgagtctagtttgaccaaagtgcagggtttatgcagagggtgtgtgggagatgaacatacaattgctcaggcctgactgtggaggaattttttttttttttaataaccgtgaactttatcctgaagtagcagcagagttccttttaagcaaaggaatgatagagtaaaaaaaaaaaaatatatatatatatatatatatatagtattttagaaagaaacaagtagcaagagtgtgtaaaatagcctagtggtatgggaatttggaagtccgcagacacactagttaggaaaatcaggggataataccagtttgtagggaaattgcaaagtttactcttctaaaccttaagaaaccctttttgttatggaaattttcaagcaaatgaagaaaaaggttataatgaatcctctagccatcaacttttctgccattctttttcatgtgtctcctgctacttcatattttcattttatgaattacctttttcttttgagattcacatgcagctgtgagaagcaatacagagaaatcacttgcacccttccaaaatttcttctcatggtaacatcttgcggtattacagtacaaaatcacaaccaggatattgaccttgattcagtcaagatacagaacattccatccccaggagcatccctggtggtcccttgtcaggagtcatatccatttcctcctggcctcaccccatctaccccatcttcctggaagtggaatccccctactttttctttaactagagtattttaaaacaaacattagacagcataccacttagtctgtaaacacttcattatgcttctgtaaaagatagcattaaaaaaatccaaatgccattatctcagtcatgttaataatcccttaaaattttttcctgttgtctaaaatatatctttttttactgtttttcaagtcaggatccaaagttcacaactgccttttgttgacgtagtttttaagcttcccttagtatagaacaataccccctgttatttgtcaggccacttacccgttgatgaaattgggtccctttacccataggatttcccatattttgattttggctgattcttaccatgtttccaaattatttctcttattgcccatatttcttgtaaactaatatttagacccagagactcaattatatttaggtttaatttttttttttttttttttttttttttttggtaaaagggatacactggcagtacattgccatcacaggaagaggatatcagccatttcactctcagtgatgctaagatcaatcagtgggttcaggaactgtcatcctaatctgtctatcataaagttcaccatcagcttgtcatctattgttatctatcaaagagttttgccaaagtctattattgcattaggggttgccaaggagtcgttttccaattttcactctttttagctatgatttttagaaaagagacctttccttcatcccaacaaatacatgacaaacgtttgagtatttgcctttatttgtaagttttcagaataataagctgatgccttagcaacccttataggatgtagtagtggttgtttttttggagagtatcattacgaaattacttaattatgtttttatgtattatgtgtttttccaatacgttgtcatcattcttcttcctatgtttatattgtttcatctccaaccattggaacctcttccacatggtgtctgtcttcacatttgttatgagccatgaggttttgagagcttccttggttttaggaacaataccatgtcccaggatcatttaatgcatttcctgtccatacctggaatcagagtcttggttctttctctagagtcttggttacttttaatgggatatgggatttatagctcatagtctggatgcacagtccaaattcattattcaacatgtgcctttttattaccgtctatgattcaggacaatgtagtaataataatagtaagaagagctaacatttatatgtgttaggaaagttttcagtattttacattcagtatcttattttatcatcatagtatcctatgagcaggtatcctgttattcttactctatatctgaggattgtgaggcacagagaagtcaaataaattacccagggtcatatagttattaaatagtttgagatgggacttggacccaggaattttgattccaaaaaacaagctcttattggtatgccacactgcctcactatctttctgtagccagccttgctgaatcagatgttttaaaaattttagtagtcttttctttagtgggcttcaaagccatcaagtaagttaaccaatgaaccatagtctatttaaaagctgaggtatggtgagcttgtggggacaatgcagcagtggttaagagctttctgacttttgagccaataccacctgggcccgtaataaccttgctgtagccacgtaactaatttgtgtaataccgaacaattaaactcttctattgaaactcttcgacaccaatgttaaattctatagacataaaaaaaccacgaggaagaaaacaaggagaaaagtcattgtgtctctgatctgttcatagatgacagtaaaaactatagtttgtagtgtgtggatcatgggtggcaagttttagccatgatttggaggtcaatatattagagaattcatttaagacattgggaagtgactaacggaaaatttggaacataggtggagaatagcagagtaaaatgtttttccaaatttgaggatacacacacacacacacacacacacacacacacacacacatacatacatatacacatatatgtatatgtatctatattctatcatactgcttcaaaataaataatagagaagatgttcttaattgaattcagttcatgttaatttaactacattcagagatgctattgtatacagtaggaggtccaaagatgaatccaccgtgatccatttccacaaagagtatactcaatagtggggaatatagctagaactatctaagtcactgggcagagtgtttgtggattttgaaaaattcagctgtgtgtaaatccttaataaaagagtgcctcctactatctcggaaggtttgctttttggtcagtatgcatctttgggagaaacacacaaaggatggtgagaggaaggggccagacaggttggttgaatcagccatggtcagcatccaaggtggcctatctatccaaggtggagagtggtcagtgctacctaagatgtataaacacagtgtgaatatgaagcagtacggagcattttcggtcatggggatcagggtaagctaaatagaaaatatgccatttgtggtaggccttaaaggatgtaggcagtgtcagtgaaacacgggttgagaaggacagtaaaagttgatagaactaactgagaacagttaagatggatctttaaataaagtcagctttatttgggatatttgtgtctaaacaagtgactctagagaggaggagtaaaggaaatctatttgagggtatcatggtcaggagacatggtttataaagagttggaattaaaccgcatatttcatttttactccacgagcaactgtggaattggcagctctgtgaaaccttgatgctaaagggagtgagggctgcttgggtaatttgctaggtttcatcacctcattatttagagagatgaagaagttattttgtagaaataaaaaggtaatggaagatagatgattttaaataactcaaatgaaaaccccaaatttaagaatcaagcctggatctgttgatatatttgaagtccaagttatatttaaagttacaaatgtcagtgtttctctttcggactgaaaatattactagacaatattttgattggacaggcaagttaaagatggtcaaataccagtgcatatacttggagctgagggattgagacttacgtgaattttctgtggggtcaagttgtagaagaccacagttgggaaagcttttacaaaacttatgtatcatgagatgacatcatttgaaaaaatattttgtacttggtcccctaaattttccaaactgtcacttttttgtaactttctcatgaatctcactgggctgctcctatcttctaaaaagaatataaaatggatcctccattctctttccttaatacagcctgttgtgacttcatagtactgagtgggaacaagctggtttctttgaaagaatgatagtgctcaatcttttattgtttcgtttgtagtaacatgagtaatatataaatatgctccctgtaaaaattaaacatctcagataagagagtctcctttcaccagcatttaaaatgataagcatctccgctgtctcttcctatgatatatgcagagtttttactgtgcgtttacatgcatggaaatgcacccacagaagaaatacagaaccacttcgagtgtaagggtgtgtgtttttaataaataattcttcacataatgctttaaaacttgcctttcttagtaaaaaaagattcttggggaaaagtctgttattatatgtagacttaactcattttttaaattgctgtatgtatcccatgctgtggatatatcctagtttattgatccatctgcctactggtggatatttatattgtttctaatgttctacttataaacaatgctgcattcatttcttcatagccctgtatgagctttcttcataatagtccccctttttttggtttatctcttctggttagataatcttcttaaaatactgggaacccatgaaatgtaatagctaattttgtgcaacgaccaataatatcctgtaaattagcctcaaaattgcctgaaccatttcctttggtgaattctaaagcttcattagtacttgtgatttagtcaaataggcctggttggagctgttgggaccctgtctgtaacttttggaataagttttctttatccttctgccttcccatcctcagagcagcctttgttccctggcacaatgggagcccagcagagtaagaatgcgctttaatagactaagtccattactctctctcctactgtctaccagagttttgtccagtatatgatgggggggagactttatttgggatgacaaagaagagcgaacagatctcttctcttgggatctgttattataaccagtcatttgtgatcttataacctggaaaaatccctgaagattaataagaggtagttaagtttcagtcacagttgagtgatttacccgtaactatttcttaatagcccagcaaggagtcataagcatgatcaggattttattgataggattatttctgtggcaaggtacaattatcctggtatgaagtacaggaaaacaaaaagcctttttatttaggtctttaacaaaagagcaggcacagaatgtctagggggcgactgctgttggaatcagaagaatgcaaaaatccaagtgagggtacatacagcatttcactgtgtttttagtgttgatcttgcaaagcgaatgcttttatcaccgagttagctgcccttgatataatagagatgatttgttttggaacatagcacaagtgttacaggtttcttgcatatatcaccaacaaattctacacagtaacttcttgacataattttaacattctcgaaaagcgtgctcttttgtttaactctctcaacaacactgacccaggcaggataagcgatcctgtagattatcaagagtaggtgatttatttcatcatggtcaaaacatatacaaaatctgccttcaaacccatctgttcctagaggtagagatagatacatatttatacaaaatagagatatgtatttatacaaaaatagaagggagccatgggattttgaggtatgctgtgaaattcctactatttatcttttgtgtttgactatccgtagggctgtaagcttactcagagctcacatagatgcgtccaggtactgtaagtcaacgactgtgcttggtctctgccctgttcttgttctgtgaagtgaagaaggcctcagatgcatttggtttggtgaggctagaagcacttgtatttgctacctctgtgttacaaaaaaaaaaaaaaaaaaaaagcccgttttgtgtgtctgttccctataagaattgagttctttgcctgctctgttttcagacatcaagccttactttaatgtgtttttctaactctgtgctccccatacgtgcttgatcatcaaaatcacctgaaatactgtgagttctacgatcagacaagtttaggaaacaatcttagcctgatgcgttagatctgtctcatggagtttaattgctgacatcctgtcaaggacctaggtccatagcatgttcctgcaagcacttggtgtctggcattgctcttggcagtaaatgaattaaaactacaaaaaagttaggaggcaagcattcacttcccaaggatcctttcccaaatcaggagaggctcagtaaatgctgtgaattataggaatatttgttcattatttcaacaatgattcgagtgtacactatgtgccaggaatttgtgctcggtgttggggacacacagctgagaatgaggcattatttagaatgagctaacatttactgaagtgctcatggtgggatgaatacccagctaactgcttcatgtacctttgctggttataacttcataactgtcccatgaggtgggtagtgtcaccatcattttaaaattaagaaactgttatttcagaagtttgactgacttggccaaggtcactgatctcacaacagggagattcagagtccataccagacgtatattcctgtctctgttcatcttctgcttaacacaatctatgtgtctcctcactttcctctttctactgccatcactctgtgatagagttgcctggtaaacttttaaaaagtatccttgcctgggctttaccccaaacagatgaaagaatagttgatggggcccgggcacgagcatttttcaaaactctctgggtgatgccaatgtgtagagatggttgagaagcatttagagcattgttaattgacaccaaatacatactgttcctgccagcctcgtggtttctagcattcttcttagatcatttggctgattaaatgattaatgattccaaatcacttttcttcccttttaaacaaacagaaatctatcaaaatataacaaatactttcataatgcgaaatattcctcagtgagggacatgataaaagacccatttaactgagaatttagaaactcgaagatctattttcagggggaagtagagtcaacagtgagtgatgaggaatgacctggggtctagagcacccatgagctcctcgatctctcttttcctggtgtgactctgagatcctgagatcttttaatctgatgggaaagaaaaccttgggacagatggtagttcttgaaaatttccctcatccccggtgaacacaggtcatgtatcaacttattttttttcccaaatccaagtcaaagtaaaataaaagctaaataggagcttactaatttggatgacttagtatatgtactttatactaaagattattttgaatgctcaaagaaaaaagaatacattaaaaagtagaatagacatttgcatttcttgaggctgtttgacaactttactcaaacaatgcatgcatatatacttatataaacttttaatttaagaattctgtgtttcttgctgccaacactttgttaaacatctattatatggtcagtaatatcttgccttttaaagatagcagtctaattaatcattgactctccactaattaaatctgtttttatcttgtcttcaatcagtgggttgtgactgatccctatgacaggttcttctcaaaacatctgtatcaaatattaagagaaaatggttagttgaagtaatcacaatattgtggtctataaagtttctagaaagagaaagacaaggaaagtaaatttgggggtcactgtatttcaacaagtttgaggcacttttataagaagaaaaaaatcaaggctaccaggggagggaaaactttttaaaccattaggtctttagacagagaaagaaagaacaatgacttccatcccactctcatagtgatttaaggtgagtattatctttgcattttacatgtcagacaactgataggacagttggatcataaatttcgagtagggtcaagagtcactttatgactattactagaaaagatcattaccaaaagagtaaactaagaaaaaaaaaacaaaaaagaaaaataaaaacatgaaaaatggcctccttttttacatttccacataggtgatctccatacgaggagatgaacttgaacttggttgggcgggagacgaacctggttgggcgggagactggagcccctcagagaatttgggattcttccatttttactgggagggttggcaggtataacatgtgttgttatgtgagtccatgagagcctctggggttcttactccctgcctctccgtgtggtggagagtcagtcgcttactctgaagcactcgactgatttctgtctgtggcttatccatgaacagtggcttggaagtgtgaaagcatgagaagcatgcagtggaacagcatgcgctgccgtcatcttctacttggttctgcatgggaaagctcctgggctggctgcctctgagctcaggcatttctctctctccctacagaactccctgaaggcttcaaatcggaagaagaagagaacaagctttaaaagaaaagccagtaaaagagggatggaagtaagtgtttcagagttttattctgaggaatttccactttctttccatagtctactctgtcctatgagatctggtccaagttgatttttctgatctatcttctactactgctttctcctcactacactctaaccacaataggattctttctgttcttttaaaaaaacaaacactcaaaactaacctctgcgcttgcctggaaatgttatccccaagatgatgatgatgaagatccaagctaatatttctggaatatttggagtttacagagtaaaataaaaagcctggcttaattctctggagcaaatgataacttgagatactttcttccaagccttacatggaagtcgtgttaagagtcagccctgggaaacaaaatgtattattgggtggttttccacctcccttgccttggggttgcctttcaagccatggatgtgtatcctaacagtgctgattgcttctttcagcaggaaaacaaaggtcgtccttttgtgataaaacccatctcttctcctctcatgaaacccttgcttgtatttgtgaatcccaagagtggaggcaaccaggtgagtaatttttcatgattttcaacttagaagttttgataatttcttgacgacacaactctcactgccaattaaaatagtaccactaggatcccaagctttggaagacaccggtttctcaggaacaaggttattgtttctctgatagctttacacattacagggctgggcaaaacctagatgttctataatttatctgtctgcttccatataagactataacaaaggcacttaagaaacctaactactgactttttccttacagattttcaagaaaggatattctagaatttctcttagttcgtatgtttcaggattcctcaattcttatagttaggaggcccttcatcaacttctttttatttctttctattgcaatttagatacaaccactttcatccctatcctcagagaagaaaaaaggatgattcatgagccatgataatccctaccaaataccaccaacattatagaaaatatcaacttcttaaggtttcacttggtcctagcccaaatccaatagtacagatacttatctcatttgagaataaagaaattgacttagaaaagttaagtctaaaggcatgcctaaagtgacactggtctataaaggacagaatttgttcttgaatcctggtctttgtctcttcatccgattatcttcccactctctgaggcttcttatcaatactcttctatgggctttaattttctgttattttcttctgagtttggatgagaaaatattttctttatccacgaagtatatattttacattttgagacaagattccttcaagttttacaataaacaactggagatttgaaaccctttagtcatcccatataaggaaggtaagttgtataaataggattgacccactggtccaagatgatgttcttattactaaagacaatgggcattgtccagaatgtattaattacaataaaacttctcttatgggagcttatgatttaaatgaaatattattcttcctttcatctctgccttcaaaattctcaaaaacttgatatggtaaaaatgtgtattaacattttggagaacaaggaaaagaaatttgtgtaagcaaagaaaccatttgttttcaagtcctgcatttttgagttgctgagagatctttatggagtaatgatggcaattctaagacatcattagaggaggacctagacatgggtttccttgaaatgaggtttaattttccctgaacaatacccactctcttgggctagtatccctatgttctatcaaaggttagagatgcagttgggaaccctgaaacatggaaatgtaattagttccatgattttggccacctgagcaccacatatcaattagtttcaaatatattttgtcatgacagtccacatataagatgcatttattaaatcattataagctctctttcctagggcgcacagaggctagtaagttatctatttctttaaggagctgatgatccagttaagacatagcctgttcctattccagtctatgtgtaaattattaatgacggggacttcagagattatctaatattgcttcctatttcactaaatagaaaagggaggtcaaggaagcttaaaatgaattttctaaagacatcttgtaaatgacacaaaaggaacaaatggaaaataatttaagcaacattaactgcatgtgacttctaaattgagtggctcagactgcagtgctatgatatttcagaggtaagcagtgacttgggagtgataaggaaatggtgtcatggacatggctgaaatcaaagatgggtactacttagttatgcagaggagagaagactggaaggtctgtccttttcctgctctttactgtggcagattcctgttcagcaaattcttgttcatccttcgaggctcagtggtgcctttctgaaccatttctcgagatcaatcatcctgtccactatgccccgatagcccttggtacacacttgcatgatatgaacagtaacataactgctctatgtgcgtcttcactgttggggtacaggtccaccattgaatctgtgatttctagaacacggcacatagttaaataattgtataataggattagaagaacagatgtcatgatgccgattattcattttgaggacaatatgatgagtggtgcatgcatattaagttattggaaatgtgattaaagattagaatgatcctatggaatcacgtcttcaagaaacaggatacttcaggttgaagactttggatttatgcaatggaaactagtttttttgctgtttaaaatattttagtttaaaaaatcttttggcttttgaacagaggaataatatggtggaatttaatgtgcgtatgattcagatgggaattgtgctaaaatgcagattctgcttcagtaagtcggggtgggccctaagatgctgcattcgtaataagctcgcaggtgctgagactgctgctcagagaaccatactatggttagcaggggcttactgtgataaatagaaaaatagatactttttgttaaatcttgagttttgccttttaataatttacttattccactcacctgcttttagatataaaggattcctatctccttctgtctttgaaacttaggctttagactttttttttctttttttttaaaaaatttttaacttgcttagtcttctaagtaaattactggacaatattgccacctactggcaagaaaaatagctttttctctttatataatattttacttgtgtaagaaaaacattttgaaggaatgtattgggatgaaccgtgtaaggactgcttctatgtctctcttttaagaaatcccatattttaaaactctttaattttttttctaaattgatacattctttttgtacatacttatggagtacatatgctattttgatacatttatggcatgtataatgagcaagttagtgtatttagcacatctatcacctcaaacatttatcatttctttgtgtttgaaatatgtcaaatcttctagctattttgaaatgtgcaatatactgttgttaagtatagtcaccccactgtgcaaacactagaacctatttcttctatgtaattgtatgtttttactcactgtccaacgtctggtcatcccccacacccaccacacccttcccagtctttggtaactatcattctactctctacctctgtcagatccactttcttagctctactacatatgagtgagaacatgtcaatttttgtctttctgtgccaggtttatttcacttaacataatgacctccagttctatctttgttgctgcaaatgacaggatttcattcttttttatggtcaaatagtattttattatgtatatataccacagtttctttatccattcttccactgatgaacacctaggttgttaaatctcttcttttaaacttagcagtaattgtctctttgtttttccaacactcttaaggtagcgatgacactgggtgttttgcaaagctgtagagcttggtagcactgctgctattattttattgggatttgacttatttgaggaatcagggaccaaaatttcaactttttttattttattttattttattttattttattttattttattttattttattttattttattttatatttttgagacggagtcttgctctgtcacccaggctggagtgcagtgacacgatctcagctcactgcaacctccacctcccaggttcaagcaattctcttggctcagcctcccaagtagctgggattacaggcatgtgtcaccacaccaggctaatttctgtatttttagtagagacggggtttcactatgttggccaggctggtctggaatgcctgacctcaggtgatctgcccgccttggcctcccaaagtgctgggattatagcactgtgcccagccaaaaatttcaactttgaatacctccttcggtggaaagagatagtaagtgtaacataaagtttactccagtgcaatcccctcctatgtgtggaaactttcgagtactagagaaatacgtcccctcccttacacttctgtttgccttaatgtcaaaacttagatttttctttgaggtcctggactcattagcatctttctgagttttatagaatcctgtgatatctctcagtgtttcctgctttcacactgtctctccctcacgttctctcatgactttctcttccagtgacctagactttaacttcagggtaaagcaatgttctgacctctaggatgattctatctgatcatccctgagagccaagggatccagaccctggctttgcacactgttcgatgtggaatcctggggtagaagtatggcaggagttggatccttggattacaggtcccagggtctttatcagtagggtgatcgaggaagaggtgtccagtctgtggacagacacatggcagctgagtttacaccaccatctgggaatcggctttctcagactagggccacccctcctaagtcaggggccagtcacatcaaggtggggagaaggggaagacagaaagagtaaataacttcagatgagaaatttgagtcccaaaactgtttctaaataattggacaagcaactttaatgaagtagttacttttttgcagtactggaaacttctcaacctagtgataattcaaggatcattatgtttagataaaagtgcaggctccctaaggtttagagtaggcagggaagagggcagagggaagtcagtagacgaggacacttgtcaaaatgcagcctcaacatcttcttgtccagctagcctcaacagatggaattaaaacaaccaaatgatgaacctatggaaagtcctatttctgaaatcatagtattggtgggaggattgggcagctaagacccaaactagctcctgtgataggtctggttccttagtctgtagccagagcgatgcataaaaaatgtcagtctgggagaaaaaaaagctggtctgaatctcttaatgaagacttttcagtgactccttgttttctataaattaaagcctaagcctctcagcatacattatttaaaccacagctcacttcagctgtctcctctctcgcaactccctgtctcatggttcagaaaagtgaacagaatgtagctttttcatgggatgtcttgctgtttcacaccttttgtgcctttaccctgaaggttcttcatctattcgaggtggaaagaaatagttaagtctactcatttttcaagacacatttcagatattttacttacaacgccttctaatctctcaacttgggcttaagagtgtttcctctgggcactcatcctccttagcagacgtctgtatcagagaagttcccatctttggtgaattaatttattttgtattgctctccttccagtaagttctgagatcccgacggtacacatggacagagtaggggcctaatacgtatttatcaaataaatgaggcattctatttggattgtttgaagcagtttgaaataataatttcttaagcccttcctctcattaatgtatttttctcaggcctttcttattgtctgggcagttgttctttctataatctagataatgcctgcatgatataaaccaagacttagtaacatagcagagtttcaacctacactagagttatggtgctttgatgaagattgatgagctatttgaaccgacccgttcttgattgcttctccacacccccaacaattgtcattatgttttcctttatgaataatgcatggaacttccttctgagaacaagatcatctctgtcttgttcatctctgtattctcctacctaaaactgtgcctgtcacatagtaggtgaatgaatgaatcttgttcaatccagtcactttttgggaatttgtattctcctgttgcactccctccctagtacttgctgcttggaagaataatgttcttttactccttaggaatacccattcttataatatctaaaaaagttctgtggccagtgaggtatatctacagtagcatgcatggattgggattggcatataagctgtttttttttttcatttagagaaaattagactcttgcacaaaagttgcagtttttatgtttggcattatagcatgtgataactatgagagtgctggagagttgttagtaagtgacagatgtctaaatgagcagatttaatcctactattgaggaagaaatgaattacccttctcctggtgaattaatatttgtcaaaccattcagttacatttaataaattatctctattaaagctttaaagttacttaacccagaggtaacagcagagttaatagaattcatttaagtgtgtgagttagatctttgtttctccacacactaggtggagcattttttcaacgctttcttttagatacttacatttttggtaataaataccatattttgaaaagaagattactttttaaaagatgtaatcatatcatgcctgaatgtcaatttcaacagggtagccatgcctggctatgcaagttatctttacacaattgcaggcatgttattccaatagactgcaatagaaatgtcacctctgtggccactcggaccttttagagaaattcaagtttaaggaaaacaacctctcaatgctttttatttttattttttggaagatgttagttacctattaatatttgcataatggagaggctgaagctgagctgtgcactctactatagcacaggtggaaaggagtaattaacatcaacaattcaaactactctaggaatctaaaactgaacaaagaactttctagcaagtcagttggaaatgttttataaattagttggtcattaaaataactcctgtgttacctattaaacataaaagattattcgagataatcccaaacacacttcatagcaaggctcagcgtgagaagagggaaaatgatctagtatttagtgtgtatacagatctaagtctatgtttgaatttgataggaagcacaatatgtcatttggtgaaactcaaggattcgttgtaattattagatagaacgtgattcctaaaattatagcaagcacatgataaggcagaacttttaaattataggtttggctggtacatgcaacaaaagacctgcattggcctatgtaacaacaggagtaacaatgtgataattataagctatactttagagctcacattctcaagtgtaatttaatgagtagattaactggctgcaaaaaagaaaaggattaacggtaacaaaggtctgttttgtgccgcatactgtgctagatacgtgactgttagtgattcacttaattctcatactcaccctggaaggtggacatcctttctattttatatactgcatttctgcaaggttataaatgctcatgattactcagaacactgaagttagtttgacctcaaatctcatactatgtccagtatactgggatgactcttaaatgcagcttattagatatacaaacctaggcatattttaagaaagagcaattacgatatctactaaaacaacaatattatgagcaacaaactcggctcaactggtcaaatattatttgctatgggtgataaaatggggcatcctactgatttttaaagctcttttggtattgcttgataaaaagatccttcttgcatttctttttcttttttttttttgagacagagtctcgctctttcacccaggccgaagtgtagtggcgctatttcggctcactgcaagctccgcctcctgggttcatgcccttctcctgcctcagcctcccgagtagctgggactacaggtgcccgccaccgtgcccggctaattttttgtgtttttagtagagacggggtttcactgtgttcgccaggatggtctcaatctcctgaccttgtgatctgcccgcctcggcctcccaaggtgctgggattacaggcatgagccaccgtgcccggccccttcttgcatttcttgtttgctcaatccaatttaaaaatgatctctaaagtgaccttatgtctgctgtaatgatgatctctataaatgtcacagttacttaaaatgccccaaaaatgttcacgtgacagagaagtgtttggcttaaacaaaccagtataggcatggagattgaaaatgtcaaagtaagctgtgatcttactaaggaagttttatatatgtataaaataactgggagcctgggatacttttgcttcagttagaaaaaactatttctataaaattatattaatacttagctaatactgcccatattttatattatacagacaataatctgtacaataaagtgaaaattaatgtcaaattacataggctgactaataacttttctatatggattttcatacattaatgatagtaaaataaatattattcattaagggcttactgcattttaaacactgtgatgtacttctcaaaaattatggcttttaatccttgcaacaagtctgcaaactgggtattcttgtctctgtgttaaagaaaaggagggctgagctaaatgaaatgaagaaacttgcccagagttacacaggttagataaacatctaaactgacattcaacctatggctatccatgaccaaagcccgtgattttaactactcttctatactgcttataattagatattattttatttatttattcatcattcattcactcacttattattttttgagacagggtttcactcctgtcactcaggctggagtgcaatggtgtgatctcggctcactgcacactccgcctcctcagctgggactaaagacatgtgtcaccacacctggctgatgtttgtattttttgtagagacgggattttgtcatgttgcctaggctggtctcaaactcctgggctcaagtgatccacctgcgtcagccttccaaggtgctgggattacaggcgtgtgccaccgtgccctgtgtattattttaaataaaagtatttattttttaaatgagcagttattcttgggaaatttcttcctattattgcctttttgtgtatttattttttacagggaaccaaagtcctgcagatgttcatgtggtacctgaatccacggcaagtctttgatctttctcaggaagggccaaaagatgcgtaagtctggaaatattctccatggtccatatgtattttaggcaagtgagaattttctgcttcattatctgattaccttgtgaggtatatcctgaccatctgtcatctaccttctcacctgtactctccttcctttaaaacttcatccaaagttctctcctactctttattggcttagttcccttcgaaacatatcttctcagctattaactcaggatacgtctagtgtgtttgttacttacgtatgtgtaactgtaggttattctctgcaaatctgtgaattgagaaaggactcattgtttttctatttcttcatgtacaactttggagatgcacattaatggaatgtaaatgtatgtctgtggagggtggagccatgtttgtttatgaatatttgaactgaaaagagagagtgtgtgtgtgtgtgtgcgcgcgcttgtgtgtgagagagagagaatcaattgattatacctgaggactctgcacaaatgtggggaagacatattaattcctgctcaatcccgtttctgagcttctcagaaatctcattctctgcttttgttagaagtgtttaaaataaagtctagattgtaggtgacccatatcctgcttctctcctttggtggagaggcacacagtggaaaagaccaaggacacttctgctgttctctggttctccgttttaaattcatgtactaggatagttcagatgttatctgataaatgttagaacacaagggtaccacttattttttaataagtaacaatatcagaggaaaaggtgatttctagagaaatagtattcttgtataaaatggataaattacttattttaagcatgcagattaggaaatatgaaaattaatttgttattttcttaacgtatgaatttcttcaccagttgagtttgctgcaagattcttcctctctctgtcccataatacatatatatatatttatttatttttattttctgtacttgattatgctaaggcaaatctgctatcctgggatgtgccattttaggagcttatttttcttaagattttatcactttagttagaccctagagagacacttcagaggtcaccgtaaagaacatggtaggacaggaaatattttcagaaaaaaaccatattttgtgatttaaataggtgatattttctagattacagcctctagcaacttcacctaagcaaaagatttagcaggggcagtgtcaatgcattttcctgagatccaagaggaaagacaaaattatcttatttcaagcagagaagtttgaaataaataaaaatcagtcaatcttcccactttgggttggaggtgtaagtggtgtgtaactgagctgagagaaagactagatggaattgtagatgtgatacctgtgttcacatctgagagtgcggaagcctccccgtctcgctgaaaaagatttcttaggattaagagtagaaagtataagttagaagaagtaaatacatccagggaaaactaataaatataaagaggggatatataaggactactgattatcaattaatgatgattttcttggggaaaggggaagaggaaatgatgggaaaagaaaaagaaggaagtcaaaactaacgaggaaaataatgttgacatataatagaagttatgggaaataaaactaggacatcctaaaatcccttaaattccaacgttgaattattcattcaaaaataatgtctgatgcctacacctgttccactggtgggagtcattcttcctgtggttacttgggacctatgatagcattgtcatcctcatgattacacattttctccagcggacaccacccctacctacccatgttgtcctctgctttctctctgctctagccagtgaaatgttcttttgtttactttttcttctatttcctctacaggcttgaattgtataggaaagtaccaaatctgcgaattctggcctgtggtggggatggaacggtaggtccctgagagagaatccagttctctgccaattctatctttcttattgttttcttgtggcacttctttttattcgttgctcagtctttctaatcccctaacacatgtatatctctcatgtgaatcatagcccctaagagtaacaagggactttgttattgtccttatgaatacatacttgatccttctaatgtgtgcttcactccttcaactatgctgtattcttttgtgtgccatgaagtagggatgtggtcaaatccttaaaatgaagattatagatagataaattccttttaaaatataagctgaactgtttccatttattcttaataatttggccacagtagggagaaatacgtggacacaattgaattattatgtttttttttttactagtgggaataaaactcagaatattgagtgttgttttgccttaaagattattaattggtcctatttatgttcttttttgttgacatactttacctgtatatggggtatgtgtgatattttgttatatgcatagaatgtataatgatcaagtcaaggtttggaggtatccattacctaggctatcatttctatgtgttgggaacatttcaagttctcttttctagctactttgaaatatataatacattgttgctaactgtactcaccctactctgccattgaacattagaacttattccttctgactgtatgtttgtattcatttatgaaaaaaaggtggaattgggctgaaggttaatatcatggatatattttctcctgtttattatgcctcatcggttttctccatttggcctctacttatggtgatatatttaacaaagtaaagaattgagaatcatgacatttagattgtgttgtctggttctttttcttccggatttggaatctgatctcataggatctacgaatgtattatgaactatctttagcttttctctaatttccctaattagaatgttttattctcaaaggtagcaacaaaatcttcgaatactatctctcttagcacataagcacttaatgtagggttggatacacattatataccaataaatgcaatgagaatgaaatagaactgtgatttttattggtctctcagatactgtgtggagagtaaaaacaatgttcagttgggaaaaatagtctttatctttcttcaaggttcatattacacattattagtttataaaattcattataatgtcttacagcaaagaagccaaacctatttaacttttttaaacccaacgtttttcaaaattatttggccatggaatttttttcccccacacaataccaatttcaattgattttagtgttctagggagatcaatttaagggatatggtagggcaaaatttcccaactttctttagtaagaattacatccaaatgaaccctctgaggatggatatactgtgttcttcctaactcaagcatcccccagcttagttatctttaatgaaagggtaaactcactgtgactctttaccatacccatagttatcttccttattttagcatctacttgccttctcatatgacttcagcatctcactcacatcttttctccttttctaaacctcagtgacaaaaacagataagttgaggatgtcgtccttcctctttcttaactcaaatccacataagctatgcataacatccccagatcttggacttctttgttgccttgggtgctccacctcccaggcctccctttctccatggaaactcccattccacctctccctccctcattctctctcctttcttcttccttttcttttctttctttcttttttttttttttttttttttttttttttttgagacggagtctcactctgttgcccaggctggagtgcagtggcacaatctcagctcactgcaacctctgcctcccaggttcaagtgattctcttgcctcagcctcccgagtagttgggactacaggcacgtgccaccacagcgggctaatttttgtatttttagtagagacgatgtttcaccgtgttagccaggatggtctcgatctcctgacctcgtgatccacctgcctcggcctcccaaagtgctgggattacaggtgtgaaccaccctgcctgcccgttttccttctttactcagcagatatgtggaggaagcactgtgctaggtcatgtagtattgagatattctctgcaattagatgaatatttgaaagtatgggattccaatgaataaaagataaagaggaaagagagccaagtccacacacttgtgaaatgtataattatgggtccggagccaaagtccaaaaggaaaataaatgaaaaaatagaagaataggacagccaccagtctgttctgtcaagtaaacaaaccaaaaaaggagtttcaagaaagaggcagtagttacatttttaaggagagactgaaaagttaccattgaatatggaatttcaagaaagcagtttcaatagagtatgtggggcaaaacccagaatgatgagtaagtgaaagttggtacaatcttaataaattcctaatggccagatccgattacagtttcgaatgtctgtgatctctctgatgccattgtcagcctcctgacatgtagactacctacttctcctatttttcatatccagtcttttcaagcaactcttcattaatgatagcataactatgagtattccataagggtaactaatttttttaatgtggtaggtaccttttcctcttagggacattatctatattttaacatctgtttttacctcctctgatgtaattcacaaatgtactagtcatttacacttgggtgccccatggccacttgcattcagcatgcctaaaataaaagtagtacgtttaccctagagttggcacatttaaactaattatttttgtcagtggtaacatctgtagttaaaatacttagaatcaaaactttgcttatcttgtaccttatgtaaacccaagttttatttaatttaccttgttaggataagatgttttgtgaaaaacatggggtatatgaaatgtttgtcatggtatgtgattgattttttttgttttgttagtttagaaaatgaaacttttaattgtgggcggaggcagagtttatatagaggaaacagcctgaggaattcatgaagaaaactgctggctttaggcaagtggagtataattctgaattcaggtatatatttgacacaaggtattcagcctttcgttagtgagcacatctgtcactgtagaagctggcagaatgctgccagtaaagtgacaaagcttagggagaaatcagaaattgaatatttttcactgactgggatgaggctatattaccccataaccgtattagtttaaattaagagtattatttaaggtatagaaagtattatttaaggtatagaaagtttgcattactttggaaaaaagttcttaggcttcaatattagctactttaattgtatattatttaaaaaatacatgaaaggccaggtgtggtggctcacgcctataatcccagcactttgggaggccgaggtgagcacatcacttgaggtcaggagtttgagatcagcttggccaatctgatgaaacaccatctctattaaaaatataaaaattagtcgggcatggtggtgcacacctgtaatcccagctacttgggaggttgaggcaggagaatcacttgaacccagaaggtggaggtggcagtgagctgagattgtgctactgcactccagcctgggtgacacagtgagactctgtctcaagaaagaaaaaaatatgagaaagcagagggaaacattccccaataatgcacttggaagtggaggtgaaagaggtggttctgctctcatttctgtgacctttggcaggttccttaacctcttttgagaccttctgaatctacaaagaaatgcattcagatctctaaggttcttatagctgtagcattataataatataggctattgttcaagggaactttaatgcaagccacatttgtacaattttgaattttctagaaggtacttttaaaaaggtaaaaagcaggtgaaattagtttataatatattttatttatctaaaatagtatcatttcaatatgtgttaatttataaacattgttaagatattttatgttctatttgtacagtcttcaaaatctagcatatattttatacttacagcacatccaatttggattagctatattcgagtgctggatcaccacatgtggccaatggctgctgcgttggacagtgcaggtgtagtctctttgttactggcttgcacagttcagaggctgtcacatagttacagctgtcagatggtctgatcccattttcagatctcttggctgcaataaattcagctcactcaagaatgatctcaaaccttcatgtttataaatgagaaatagcctgtctttggtcatgtgataaatttgtattttctcacttccttggccacgttgacacctattcaactcctaatggctgtcaccctgctgaaatattgacgagcacatgaactgatctcctgaggctcacgtactctcattatggttccttaaggtgtgtgacccatggtccctatctatctggctcctgactttggtgaacttggctggatctgcaagtccacctttaaccattttaattatttccaaaaggcctgacattaaattgactccagccatccacttcatgcttatttcttgttctattggcttttctagatgaaaaagcatcccaaatggtagacatccccatgccctgactcaccacagccaatgcaaagaaggaagtattattttcctttaattgatagggacaatccctcatcctaagcccctttcctcattcatcctcagcctagttatatttcatcctctctcactgagtaagcacacagtgtaccttcagtgtggattctatattgtttcaagaaaaggtcatattctgatttttatcttgatttcttttgggctaattttaagcacatttcttttaacacatgttggctttattaagtgcaaacatacattaaaatatcaaaaggaagaattattgtgcacatattcaaaagggtcccccagtcatccaatactgtgtggtcattttctttcagagctcagcaaaactcttgttttcctttgatttccaaacgtgagtgtccttcgctttttggcctgcatgtactacaaggcagcgcaacgtgcatctgttctcttggaagaaaatatcagtttgctgtcatctccacccttcagccaccccttatgttagtatactgcagaatgaaaatattgctcaaaatgcacttggtaaacattcagtgacaactaatgctaaaaacggacagatggtggcagcattgaccagctgctgctgtgcatggctgctcagggacaaagcggaggacctggtgttctcaatctgtcagccctgcttttcctaggaaggaaggaaagaactttgcaagctggaaaatcattaggcccaatcaggataactttcttcagttctggtggaaaatataccaagtgcaataagttgcagttaattaaataatttaattgaaagggtgctaggtgagctggtggagatgatttgggaaaatacgaaagccgtggcagagttcctgcccatagaacctttcaatgtgcagtctggacttcaggtggaaacgggttccggattactgtaaagacagagcttccagtaacagctttaagatcttttgtaaagtttttctctaaggacaaagacacagattgtttcccaagatttttaatgtctcctgctattgtaagtgtgtatttgtttccattttgttttttatagccccttttttactgcagggaacctctgcttttactgttctttacagtctgcaaaagaaacgctttctgatttgatggcagctgaaggtggggctgatttgcaaactcagggctcaactttaagtggagaaatgggaagagggcatttttcttctaggaaactgggcctttattgaggaaggttggaaagaggtagcaaaatctagctgagtcatagtagctaatgttagtttagcatttcctgtttgtcaggcactagctaagcaatgtctacacatgagttgatgaaacaactctaaaagtcaggcattattattactcttgctgtacagatgtgaggggagcttagagagattaaatgacttgcctaaactcacccagccaatttgtggtggagctgagctccctgccgctcagctcggtgccccacacttctgcgctgtgctgtcttccgggaatgctggctgttggggaatgctgatagagctgctggctgaaaaaaactattcaggagctgtggaggggcgatatagacccacctcagccagagaactattagcctaatattggttgtctgtgggagaatttcaagacaaaacaaaatctgtgctgtgaaaggcaggaggcctttgatgactccaagggtgatggaatgatgaaatgcaagattttctgcttatattcaggagacaatgacatatttgatcatttggctacagaaaaaaggagaaagaatctatttatccggttcataaagcaaattgattgatgagaggcgaagcacctttacattcacacactgtgtacttgtccttttctgcatagaccaagggtaaaaggagaagagatggtgagaaatccaggcaccctgtgggctctgcctttgtgaggaatcgtagctcagtatcacgagaactcctgacaaccttctctgagaaaacaattaggaacacagcctagaagatttgaatgagggctgttagaagacgcagcatcagctggatgcagtggctcatgcctgtaatcccagcactttggcgggcggatcactttgagctcaggagtttgggggcagcctgggcaatacggcaaaagccgcccccatctctacaaaaaatgcaaaaattagcctggtgtggtgacttgcacctgtggtcccagctgctcgcgtggcggaggctggagaatcgcttgagcccacgaggtagacgcttcagtgagctgagattgcaccactccagactggacaacagagtgaaactctgtctcaaaaaagacaaaaaaaacaacaacacagcatcgattcatagaagttgtgggatacgtcacgtacttcagagtcatttggaaattgtttgtgttccatgggcagtgaattaaccccctaacgttccatctgttttagtattagcattcctcctgcactgtggaattgtttcttctttgcaagctcatcttcacaggaagttgttttatttaatttttacttttctatctctgaatccctttggtttctagtaatattgaattgttttcaggactttcagatgagagctgggtttttctatagattcctatggctccaccctggggagatggcaggggtatgtcactgggcttttgggaagtcgggttgagcacttaccagagtgaggctttctgggcttctttcagccatagtacgtcccacctttctgtgggccatgacctcagactggttttcacattccttcctcctctcttcctccctgctatgaaagagccgtgctccaggacagcttgctgtcagtagggcacacacttttatttctccattatcaggcaagccaaaatcccagcttcctctgctatttgcaagaccaggagccaagctgatccaagcctttaccccagctctgccactttgtattttttttctggcccattgaagctgcgtcttttttttttttctttctttttttcttttctatcattgttgtgtctgagtgaaatgggatattgaaagtgtaaactcatagcattttctttacccagaaaagagagacatatttcaagtgagcataagaaaaatgtctaatttaaatctgcctgaaagaaaacgggctgacttgggagcacaaatcataaaggagaggttgaatgattgtctcttagagaagttttaaggagaatgccttcttccttctttggaaggggtggtgaattagatttctactgagttctctggtgggtctgtgagtctggctctattcagggctgttgtttctgcagttggtgatcccagatgggtgggctttttctgagtatttatgtcctttttatggcctttaagaccccttcttgcagtttattagaactatctacttttactgtgtttaatctgtgcttttagcagtgcagaaacaatgtcaagcacaaacatcagaactaatttagcatcaggcatttttatttggacttcagtagccagctttgttggtattgcacgtaaaagaagagactaaagaagctctgggtcagaatctaaggatctgtctgggagtaagttccccagtttagggaagtggacagactttttgacatttataggtctggatttttagttaccacattgggtgaaccatgtggtctgcctttttagaagatgaacacaattttagacataattggtagacgagcaagttttacatcctggtaagtcacctttgtggaggagaaagaattttagttggaagtcaggagaaccaacgttaccatgactctgacacttctaatcatttggtcttgagaaaattccatggtttttttgcacctcagtttatcaatctgcaagttcactgaatttgattaagcaatgtttaaggtttcttcatctccacaggttccaaaaatcacatgccactgcttccaggagggtctggccatatccagaagggggttgagttctttatttaagggttccctataccttagcagttaaggggttggccactggcattaggcattcctatttttgaatgccatctatatcgtgtaaactgtgtgatactaaggaggtcacttacctttccaattctctgtttccttatctataagatggaaatgaaaattacattaatatctgtcttacagataatgttttaaagtttaatacaataattcattaaaggactttgctcaggcatggcacatagaaaggcatcggtatgggcctggcacggtggctcacgcctgtaatcccagcactttgggaggccgaggtgggcagatcacaaggtcaggagattgagaccatcctggctaacacggtgaaaccccgtctctactaaaaatacaaaaaattcgcccggcgtggtggcatacgcctgtagtcccggctacttgggaggctgaggcaggagaatggcgtgaacccaggaggtggagcttgcagtgagcggagatcttgccgctgcactccagcctggacgaccgattgagactccatctcaaaaaaaaaaaaaaaaaaagcatcggtatgtccatctttgtgttactgtgaactcctggagagcaatctttctaccttatctgtcacagcctagctcatttatctctttattttgattgcttagttctgggttttatatgaagtagtgttcaataaacaaatgatctagtatttttgagaaacatgactcgtacaaatatagaatgaatacatgtcaaaaaatttgcttagctctttaatgagggagcctgcaagatagtaaagctgatttatcagaactagagaaaaagaattatgtacttcgtatcaaaataatttttctaaatttgatgcaaaactgatcaacgtcctatgagagaataaaactataaactttaaagcaatcatctcttcttgacatttgtgtctctataggacagaaatctatgttaacctacagttacacaattcttaggcctgcgaaacactattttagtatgacattataaggacattcaaactcctttttgccatttcaaattttggtcaatttttctaattagttataagactaaacccaaagtattatttatcttagaaaaagattaaacagggatatgattctagtatataagtatcaatttcctgcctaaacttataataggtactaggtctgtccataattatgttttcataatgtttcattaaggaaaatagagggatattcaggaaaacactatcaatttccaagatgatactatagagggcaaccatttaataagtacttatatgggccatgtaccatgttaagtgctttatgtacattttagtttaattagtaaacaatcgtgtgaggtacgtattattatccccattttgaaaatcaagtaaatgagtctcagtgaggttaaataatttagtcaaggttatgcagccagcatgagtcagaattgaaattcagtcttattctgagttttatattccctcctatgccctgttatactaccaaagtcttaaactctgagaaatttacaagggtgtttctagttaaacgcacgcatgaatgggtttagttttgcttgtgtgatagaacatgtgcaaaatggtcctttttcctttaaccattttgtaactgcctgtgataagcgacctttctgttccctactcactgaatgaaaacatacatgttttaaagaaaaataaaaccattctgtttagctcttggaagcctctgtttctcaaactgttttctttgtaacttatttatctttcttatatctcttctggcccccgatacgcctgtaggtgggctggatcctttccatcctggatgaactgcagctgagccctcagcctcctgtgggggtccttcctctggggactgggaatgacctggctcgaactctcaactggggaggggtaagaactgctctcggggactgcccatatcatcaaacaacaaaccggattccagatccactgatgttctaatggaagaggggggtactgctgctgctgtcccaggcataagttagagttgagaatcaaagtgcccttgagcccttatttgatctggtagcttcttcagtttaaacttaaaatcagctagaagggaaaggaaagcttggtatgagagaaatatagtggttagtacacaggcctgcggctttttgaggtatccactaaaagacagtgggtgagtttggcctcaagtctgcgtgcaaaaggatcatacagacttcagttaatccagactctcagccccagctaggatagcacatctggttcaactttacacaccttacttgggagagttatgactttttttttttagcattttattttgttttgttttgattagtgtcatcagagctttggctgtataggtacttacctgtcctttccacaatgaagccaacttcaggcaagcttgggggaaatcgttctgcagtcactaaacagccatttatttacttacgtatgttatagtactaagatagtaagaaggcgcaatatatatacacacactgtgtatatatacatatgcatacacatatacagccccaccaactttttttttttcttttttgagatgcagtcttgttgtgtcgccaggctaaagtgcagtggtacgatctcagctcagtgcaacctctgcctcccaggttcaagcaattctcctgcctcaaccttctgagtagctgggattacaggtgcccgccaccctgtgcagctaattttttttgtatgtttattagagacagggtttcgccatgttggccaggctggtctcaaactcctgacctcgtgatccaccagcctcagcctcccaaagtgctgggattacaggcttgagttactgcacctggtccccaccaactttttatctgctcatatgagagcattacatgggctgggctctgtgaaaattatattcagatatttagtagatgctagttgacctttgggcaaattaaccttccacaggtctttttttaaagtaggcagtgtagaaataaaaaacgtatttacatggggcaactaaggttatcatcagtgttaacttctcccttccaaatcagagccttgcatatcctattgaggacagtctatcgtgctgtcagtaatggatcttcaaggattaagtagctccctaacagggccattcctcagtgagacttgcttcaggtcacgggaagaatggtgtcttccaaggaggtcagggagaggtgattgagagggagtgttaatagataagcattgtcaatccaatccctccttgattctttccctgcctctccaaacacatttgttttgtgtttcccccaaattcctccagtgagagccatggggagtcctgttttttactctgataacaaagtagccatccagcctccagtatgacccttaatgtgtaccggtgactattggttcttgctgctgacaaaaaatattcctcagctcaaaccagccagaactagtgtttctatgtatcttacttatagtattgtctcaaattctaagtacctcaaggtaaaaaatttgctcttcaaaccttgctaattataaaataaacaatataacggcttggctcttccttgcgtaaaatagcattggcttcactgttctccactctggacagcaatggatatgttctctgattcctcagggctacactgatgaacctgtttctaagatcctgtgtcaagtggaagatgggacagttgtacagctagatcgctggaacctccatgtggaaagaaaccccgacttgcctccagaagaacttgaagatggcgtatgtaaggttagagagttttttgttctgcagaaaggagccctggagcatctgcctgagctacaggaaaaaaaatcctggctggagagtcatgtgctgatgaattcctatgagataatgtgataatatttgagttgatggctactggggctatgtgtataatattaccacctaatgattctgccccatagacctctaaatacctagattccgtacctgcttccaaagctcagggagctcttctctgtcttcaacttctgcactagaaaggcatgtattttgtcttaatcattcatgttaatagcaaataacctatgagaagatgaaaaaatatgtatatttgtaagcattgggcacttgttctttcagtagaaatataacctcctgagatttctggcctgatataaaatatatcttacgttgaagaggtattaactatgccagtgttaccacttgggtgggacttgaagatacctcaataaatgttttgacttcatgttatttaaaaaaaaattgacttttattttagattcaaactgcatatgtgcaagtttgtttcatggatatattatatgatgctgaggtttggggtatgattgatcccatcacccagatagtgagcatgttaaccaacaggttttcaatccttgcccctctccttccctctctactctagtggtccccagtatctattgttgtcatctttatgtccagactttatgttttcttttagtgattgagcttttatttcaaccgaaaagcaaaccaagggatatatgaatagttgtaattagtactgtgagccttcagttggtcctttggttctaaattatggcctcaatttcagataaatttggtaggtttctgagtagccacttccctcatattactttccattttccttctatgattgaatttttaaactctgtatgtgtaagaatctccaggtgtgtttgttaaaatgcagattacaaggcccagtcaccagagattctgattaagtaaatgcaagttaaggcccagacatctgtactttaaatggtatcccaattatagtgaaccatgccatttattgaggctaagattttgtgggtatttccatcttataatagattaagccccatatcattttagatttagatcaaaccaacacccatttattagcatcgtgatcctgatcaatttaattacatatattataatttaatagattttcaagtttctaacttggctaaattagattaaaacatgttttactctgtctttatggttttttcacctaaaccatgatcctgaaattctagtagatttctagtagatatcatgattgctcagctgaattcaagtttataatgtcacaatgttgtttaaacaacaagtgtcatcttgagatacgaagcttttttttaatgtgtttgacttatagaaattggatagaaaacagctaaagtataaagaagagtaccatatggatattgtaagtttcttttcctactaaacttggaatagttagacgtgcaatagaaatccatatttaattctctttccaacagcttaagaaatggaaagacttcttggtgtagccagggaacaccaatccagataattaaagggtttatttaaaatgggtttttaaagagatgtatgggaaactggggcaagttttcctggaaaatataaataacttaaaaacagactaaattgggatatgatttaggtgatggtgaccagatgttctccttagctatcagtagatgttaagacatgggttagaattgtggccaaaagaacataaatggtagaggaggtgaacatgtctgtgcttttggcaggatcaccaacccatgctgtcattactaagaactggtattttgtttaagtgcaggaactggatattctcaaataagaaggctgaagagtaagacatgattttggcattgttctatgtgtttagtttctctctcggtccttcatttagtggagaccatttctaaggctcacttggactctgaatcattacataggctttgaatcaagagcttccatgtggggtcattccttactttcattagagaccaagccaatccaattttcttttttctgcatttatatctgtcttgttccctctcttatttcacttttttcttaatgaaaggaagttctccttctagtgaaacagaaaatcttgctaatcaaggggcatatgaagcactgtaaaaaacatacttttgaaatcttgagggttaaaacacttatctctcagagaagacaggtacagttcaatttgggacacaaaccggataattagctggaaacatttctcgtctttatttactttaatatttaccttccacttgagtcgcagaaggaaaagcgggagaaccagccattcccactctcacattttccgcatgctttcttaattgttctaacatttaactgaagcttaaaatcacattagttttgcagttttaatgcaggatttgaggctgcagagttctcttcattcagcttgcagtggtaacagccagagacccaaaggactctaggaaggaaagttaaagcttccatgtgtatctgtgtggctgtgttttcagatttcatggtcataataaagatataagggttgatagattaaatgagaacttgaataatagtaataggtagttttgttgttgtttttctctctaggccagcaataaccaatgggtcacattgccctattttttatatgacttttgtaaaaaagattgtgtgtgtgtgtgtatatatatatatatatagagagagagagagagagagaaaatgggtgatggataaacaagttaaatattcattttacattacagtattggtttgctgaatataaattcttgaaaaacgcacatccactgattaagttggttagacattatctttacaactggatttactttctaggtttgcttagtgaattcttctctgtaactattgcaaatatatatccttcagcataacaagttcctattattacagcatctataaaaatgattctcatttaataatttgtatttgtgacacatttcttatactatttataattcttgagaaaattacttgattttagctttcactcatgaattaatccaataatttcctgttctttctacataagcaccctccactttgagttgtggctgatctgtctcctagggacttcttcagagataggggtccagctttaggttttattcttctctttctgcctggccacacaaaattttgcctctgtctttgtttatcattgcagctccctctgaatgttttcaataactacttcagccttggatttgatgcccatgtcacactggagttccatgaatccagaggtgaggacaacgtcccatttccatctcccagggaggaagtttctagcaggtgttttgcatgttcccttttgtttgtatatcacttacgcgtttacagtgtgcttcagtgttgtttcattttaaccttcaggatgactctgggagctagacaggacaggaacttcttataaatgggaccctgagacctagttgttcagacaaatgggaccctgagacctagttgtccagggtcttaaagacagtaaagggcaggactagatgtgtgttccaggtcttgggattgttaatctttatgttctactggaagatttgaagtgagtaaaatactaagaagtgatagagactattactgaagtcactaggatattctttagcttcacaaaacactattaaagtgcaatactacacaaccacagccattgaaatatggtagcaaaaacaaaaatgtcccctctgtttgtataaaagaaacaacaggcatcttagaacaatagaggagctataggtagtttaggttgaaagcataggatgtaatggtgatgggattaattaggaaggtactagggatccccactggatgatacagaggtgtgaatgagaccatgtagtgatttcaggtactaaaagagatggagtcaagattaggggaacagaatttttgaaagagaagatgaaataatgatatgctattaaatatttcatcaacattttctcatgccatttagaactgataaagtttatgggtttgacttatgttttgtagtcccgattgatctctctctctctctctttctgtctcattctgtctcttaaactctgttcttattaatatagctatactatatatccatgtctatgcctgtatctatatctgtacctagtgccttctgaatatatataaccagaaccatgctaggatgtagattgttaagagacttgtgagataaagtcataaatgagaagtactttacttttttccctccaggttatgtaagaaaggaagtggtgtttagaatttttgcatactttggaatttgaaataacagagcactaaaagctagaattcagattttcagattctggtaataacatgaaaattctgatcatgcacttatgcactagaagtcaagagtgatgctacaggattaaaaaccactagagtataaaatacaagtaaggaacagatctttaaagtctcttactggatccagcaatgttagcagactttgaccttcctggtttcccaaggttttgagaggacaggctctgtaaaggtcaaattctgtgccaagcaggaatgatgctgtttgaagagaaagccatagtttggtattcctctctgattggccagaaaaatcacagctagaaggcatgattgataacagaacctcaaatatcctgagtcagaaacactaccactttccgcctccctgccttagacagttcttggatattaggtattcagagggacttaccttggggccaacatttatgacctgttacccttcttatatttaaggagagttaatttgggaagtacatgggggattttattcttcatttcttaccccattttttatctcatattctttagcaggatccagatcctgggcttcttaataaaataccccaaacttcttaataatacttgtaaagtaacacaattatcacaaatacatggatttccaaaaataggcatgaaaagaggtctaaatgaataagtggccaacaatgagctcattcaatgagctcaatgagctcaagtgagtctcatatttagtctaacttatccggaagtttttctaatgattcacttccttgaactatgatgaagtttctatgcatcagagtgagaagggagcagggagagacccttacatgggaagaccaggcttagaagaaaattcttttggggaaagtgatttttctcttttattttaagctgtaggactattttagagtggaatatgcaaattgttgagtgtatgaacatgtacatttatatgtatgtgattataaaacaattagttaaagatgtcaagcattaatctttgtatagtttattgctaaggcttattgtgttttgatgcagtatgaaatggaattgtaaacatttcccctgcatgtaaatcagagcctttgaggaaaatcagccactgaagggctgttaagggagaatttatgttaattggaaataataggtaaatattcatgcaggtgggatagaggtggtaaaaaaattaaataactataagatattggaaccagattttgctgatacacttagaccagaggtatggacttttcagtagctgttattctgctttttttaaatagtaaattaaaaaattatttgtctatgaaatatataattaagcaaatagcctttttttctttctttttttttttttttactgtttctgttcatttgtattttccccctatttttaactagttagtcaagaaatcttaagctaagctatagaagaaaaaacaggataagcaagaccagatttttaattgtggcaagcttacttattttgtcagtagatagtgagtggctgttctcaaaccaagaaaactcatagtgagactttaaactgttttccaacacaggcactgtctgcggcttcatggatcacttgccataaaatacctaaagggtaacacaaaggctcatgaaagccattgtgaaaaaaataagcttggatagtagaatctatgaggtattagtcaagaaaatgtaatacttttaagttgagaattatgccaatacatctacataaaaataggcaattaatataaatctcattaaaggagaatttttaaaaatttaactatggaaagaatttttagcacagatgtaaatatagcccatcaaatggacacttctcagcataactacatatattgtatttcttttagaaggaataattaaactggcattaattcccaattttatatctactttattccaaacacaaatcaaactcaaaaacatgtttaattacatttggaagctgcatacatagcttacggaagtcatgccctatgaaagtcaaagtaaataatcgcttctccaccttcttccaccttttcctgttatctcagcccgatatccctggaaaccctccaatttttacaaagcatctagagtgcctccatctttaatgtgcttgagaatcacctggagagctcccctccacagatgtatagactccacactcaagtcattctaattcagtagatctggctagggcctaatcatttgcaattctaacaagctctcagctaatgtcagtgatgccggtttggaactacacatttatagtcctggattactgtccctgtagcactgggctactgtactaactggcctggaactgggggaaagatgataaccaaaccatgggatctattggatctgtaggataggagggagctggggaggaagtaggagtgctaatctaagtcgctacctttagtgaggtctccataacaaaactacttttcctctttcacagaagcaaatccagagaaattcaacagtcgttttcgaaataaaatgttctatgcaggggtaggtatacattttatttcataattactacatattacttattgccaattcactgtgtatcataaagttgcaaactacatgagaaataatcacatatacatctcatttatatatgtctatctatggttactgtttcatggctgggcttaagaatgaaagtgaggtgtatttcttaagttagctgtcagaaagagagttggtgttcctcatctctgagcttttaagcaagccccgaggcttcatgttgaacaagagaagatgctattcaaaaagggatgtgagaaacaaacatcaaagccagtgtaagaaatggaggaattgtgtagactgaggatgtctgaagaattttaggtaagaacgtagttttcaccagggtgcgcacattgacgtttggattagaaactggcagaatatggggtgtttttcatggacgcatacgtgaggttaaagggagtgccttctttttccttcttttgtttctcaggcacgttcatagtagtaaatagagaatgaaaaaaaggcatccaaaatatcagtacagtttaaatttatgccaatcgataggaggagtttaaataaaaggcgtttgggagctgcatacgtagtttatggaagtcaaaccctgtgaaactcagagcaaataaggaaatcttagtggaaagactgtatcagcacttaatggacaaggcaagtgttcagaaaaggttgtcaaaataaaccttccaatgaccctcagaattgtctatttttcactctcattctgtgttcttaaatttatagtgaaactgtaaattatagtttggaaacaaagagaaaaatttcaacttgacaactactgcactgctttactttggattctgcagaaagagaacatgtttagaatttttgcatactttggaatccttggaatctaggatatggaagcaaggatttggtatcaccatgtaattacgaatttcttcttctttatttccctgtggtataggcagctttttctgacttcctacagagaagttctagagatctatccaaacatgttaaagttgttgtaagtattgaatatgttgatttatttaatttgaatatgatatgactgccacaaaaaactcccaaatacttagtttatatattgaatcactggactgcatagaactttggagatcattttgtgtagttcattcaacctacacttattatgtgtcaggcactgtcttagttgctggggatgaagataaatgaaaagactagtttcgctcctgaagaaactcacagttcagttttgaagaaggtcacataagtcacttcagaacaataaaactgttattcaaccgtgtgtataatatggttgtggcacaaagggagaagtgataactctgactatggtggggtcaggaagacctttataaaaaaaaatgatgttagctgggtcttgaagcataaatcggtactctccaaacaagtatctttattccaggataatctgaggaggatatttattccaggataatctccattttagaacgaagtgttgatttcattattttgtggtgactcactctcccacctggtcaaggttcctcaccactagatggattttttgtgtatgtgctgtttcttcctgggtctctatatcaggttgcggaaatatactgcttgggggcaagggagagagaaatttatctttctcaaggtgacacattcaaaaatagaataaaattaggtattaagaaaaacattaatgtttccttatagtaaacaagttaaaagaaggaaggaacatgactttgttgcacatagtcgtataagtaaatgacagaatgagaaagagaaaaaagatatatagatggaaaagaagtgatgagaatatagcaatgtttgaatttatcaatgcttgaatttatcttattctaaagaataagaataattttgatgggccaggcgcggtggctcatgcctgtaatcctagctctttgggaggccgaggcagctggattgcctgagctcaggagttcgagagcagcctgggcaaaatggtgaaatcccatctctatcaaaatacaaaaaattaggcaggcgtggtggcatgtgcctgtagtcccagctactcgggaggctgaggcaggagattgcttgaacctgggaggcagaggttgcagtgagccgagaccgcaccactgcactccagcctgggcgacagagcaacactccgtctaaaaaaaaaaaaaagaaaaagaaaaagattaattttgacaagagagaacagaacaaaatatatacatgaaaatagagaaaaatatatgatcttaagctaatgagatatgaagaaatataaggagcatgaaaatataaaaattaaaatgtgtaatcaccagtaaagcatgtataagacatgaatctcctaaatcagttgaaacaagagacaaaggcctttaccgctgctattagcaacacttggcatccctttcagatgtttcagttctcatacaataaaaatataaagcaagtatcttttagtggtggagacgcttgagactgaaatattgccttcttaaagctagatacaagaacacagggcccattgaactatgaggattattatttcaataaaatcgtggctattaaatttaagtagcagcaaccttacattaaacttcccctgtttcttcagctgcctgcagcctagcaaaaattaaactttactgccctttccagtgtgttttgcatttacaggcgcatccacagtacctgccaggagacccagtgcatgctgggtggtggccatatagaatggcagtgtactgtgcaagtcaccggattgatatcaaactctgtaacttcctaactgctagagagttttctctctcatatctcagtccccttgatgatacatgtctcatgcatgggtgactttatagtagagtctaaaagatgcttgcagagaggccaaaatggcagcaaataactaggaaagatgtgatatcagcctatatatgtaatattaaaggtggaatgtttatataaattatatcttatgaggaggaaaaaaatcattataactaggtgtaaacatttgggatttagttaggtctacctttgctaggtatatgactttggggaaatcatttaacctttcagaggagtttgctttcttcatctgtcaaataggtgtaacaagacatgtctttgatgcaatggtttttgaccattgtgctgtgacatagagagacacaaggatacttttgcaatgacatcattctatgttttcctgagtgtgagatgaaaaggatggaaggttagtgagagtgattagatgtctccccaacaacagagcatcttttctttgtcagagggtgaagtcagtgtttctaatgcaatagctagtaatgtctcatagagatataaaatatgtatttgaatattagactgagaaaatacaaaatgacagtaaaaacctacatatagccattatttgttccactttccatattttcttcttgttatttatcagtatatgagcttatacaaaggaacatattttggatgcaaatatgtccctttgtgtgtatttgaagttgggaaaaagttgaaaactgctattctaaaggaattgcacagtttattgcaataatatataaaaaaatctctgtaaagcagtatacagtgtaaggcccacattttcgtatgatttgatgagttcccagaatcactaacatgtttcccagaaggaaaaagtagaaagttaaaaaatgaattctgttctaaatacaataatatttattataatctttctgcaatgcaaccataatgctttatacactattaatatatcacatcctaggttttaagttttagttgcttataacatgcaattttgacatttacaatgtctacttttttattcattggcatagtcatttataactcatttcaagttcttaagtaagttggaagatgtttgcttagtagttgagagtactagaaaaacatctttaatgtctagaattttattactaagttatatttgaaaataatttgtttatttaaaattgtaagatttcttggaaacaattctttgagaatactcatgaaaattaggctgtatggagatcgactgggaaaaaaaatgcaggtgctggagacaacctgaccactagcaaaatcattatacttagattgaaactgatcctaaagaactctttcagaatttgcagggagcttggggatgctttgctcctctctccaaatgagaaggtaatggggaaatcctgtgataagggtataaggaaagcaaatacgagagcaggctttacgcctttgacatcggaaagtctatagtcatgactagagttattctcttttgacttttgtcaccagtgggaaatgagaaaggaacatgaaagacttttccttgatttatcaaaggatgatacccttgcagaaagcgctagcagatcagggaagccatccatgttcgagggttgttgaggccaagctaggctgagacccttgattcccaggtctaaattccaggaagacagtgaatcttagaagtctaaagtctgaatggccaggcgcagtggctcacgcctataatcccagcactttgtgaggccaaggcgggtggatgacctgaggtcaggagttcaagaccagtctggccaacatggtgaaaccccgtctctactaaaaatacaaaaattagctgggcgtggtggcgggcacctgtaatcccagctacttgggaggctgaggcaggagaatcgcttgaacctggcaggctgaggttgcagtgagctgagatcacgccattgcacttcggcctgggtgagtctgtacaagattaagtttctaagaacaaaccacgaatgaagataatactactgtatgatagatatcttttcaaaagtttgcggtacatagactttttaaaaagtcttcaaaatatttgacatttgcaaaataaaaattgtctcaaaaaacgaagaaaataaatcattatatttgtgacttgtttgaatcagataatgatggtggtgaatactactgctttaacttgaggcttttttcttttcattcttttaagtgttcataaatcttttaatgttgacaccatcagtctagataactaataatcatccattgttaagaatgataatatttcctttgattgtgagaccagagaagaaatcattttaatcaaatggaggttttgttcttaccttaagtgcgaacaaaaccaacctctgtaccctgggtccagtaaagctataaccagaatatatttttaatcactgtgaccggcattcacttaagcagagatagggcaaggagaaagagaccatggtgtgtactattgtcaaactagttatctttcataggtttttagacttgtgactacttcaaaaccccttttctgttttcattgtttcagtgtgatggaacagatctcaccccaaagattcaggaactgaagttccagtgtatagtatttttaaatatacccaggtaggctctgtttgtattgtttccttggtttgacgtgaactctgacttgaggttatctgttttcataacagaaaagtttcagatgtaaacaatgaagatcagttatctaaatgggtaattaaagatttctaggtctgataattcattctccgatttggtttatttagtgttctttgtggttggtggttttgtgcgtcatgtggcatgcattgtctgtacttacccatctttaagaaacccaggcacccctcttgactggaacatcttaatttatttctaaattactgttcttcccctcttcctccccatctaagaatgagagaattgaaacactttttttgttctcagtttcctaaaaactgttgaaaaaccatccagtctgattcaagtgcggaattcattcaaaattgttgccagatgatttctttgaaaaataggatgagttagagtattgttttctagccaggatgtcaactctccatggtgctattacgcacttcaggagaaagggatatttaagataactagactcaaaataaacatattatctcagtggcataaattatgttctaggccctgaagccaagattttggaagggatggatctataaccatttatttgcctgccaaacaactcagacacaaaatctgcaaatacattgtatttagactgaatttaattgaaatgagagttgtatgtaaatctgtggctaggaaaacacatcatagtctcctgattattcttggcagtgctcaatatagtcagttacaattttattccagaaatatttacagcttaattgaagtagaaggccttgattctcagaaagcattgtttattactttgctttattattctttctcttgtccttcctctcttgtccttcttcctctcttgtccttcttctgtcttttcttgcttctccctctttccatctgtattcttcttcctctatttctccaatttcttctgtttcccattctctttctaatctcttatctatatttcatctcttcttcactctgtcttccatagttacctttcccttctcctgtgagtacctcttattttgcttatgtattaatggcaaatgcttcccacttcatttccctgtctcttttctactggcatgcatacatcttcctttaagaccaaattctgaaaccacctatagataattcatgatatatcatagaaaacagacatacatgaatcatagtgagaaatatagataacgaacgaggagaaagttggataccacaggatacttttgttgcaaaattatggcccgttttcacagcttggtattttgtagatgataagaagtgcatttccttttctaatggaaggtgtgtaccaagaatggaaaactgtttttatgtttgataaacattgggtctaactacaaactaacacctcatgatagtcatgagaaggatgggacatatttacttctgtctttaatcttctcttgcagatattgtgctggcacaatgccctggggaaacccaggtgatcaccatgatttcgaacctcagcgtcatgatgatggttatattgaagtcattggatttaccatggcctctttggtgagcaatataactgttttattaaaatgaaatgtattttagtcacagagtttattcaattcacaggactttagttaactttttctcctgctttatcaagttacacattttatgaattatagagttgcttaggaaaaacaagaaaaaaaatcatcatttatgtcactaagaaaactgatgcacatttgtttgaacctcaagaataaatgagtatcacttcttacttttcctgattaattttctaacagaatgaaaagtttttatgctaattaaaaacattacactgggctgggtgcagtggctcatgcctgtaatcccagcactttgggaggccgaggtgggtggatcaactgaggtcaggagttccagaagagcctgaccaacatggtgaaacctgcctctactaaaactacaaaaattagctgggtatgatgtgctgcctgtaattccagctacttgggaggctgatgcaggataattgcttgaacacaggaggcaaaggttgcagtgagctgaaattgtgccactgcactccagcctgggtgacgagtgaaactgcatctcaaaaaaaaaaaaaaaaattacactatagaaacatcccagcattggcacagaagccatagcattttatacttttttggttcactgaggagttttgtgtttaggtaaaaaagagacagtagcaacttgtggatatccgtcttacttatgagtaaaatgatcatctccattatcacaaaatatctgaatatacaaagacatcattattgtgatattagtgcatactcagttgccacaatattgagatcaccttgtattttaattttgtttgcttgcattaaggaaggaaatttatagtgtaagtatattttcaaacaggttttagccatgcattcctgcttattattaaatgatgtgcggaccagttaaaattatgcttatcatttcttgtgtaaatcaggccacactgagtttgtaatgcaaataaaaacaaagcttctgcttgtcacctttggttggcacatgatttgtgctgtaccttatgcataaaagaaagaaggttgtatttctcattctaaacaaatcaaaataggtctctcttttactcatcttatgaattccaaataactctacctcaaattagtgaagtttaacagaaaaatctattgtgcttatggcaagaatcttcatcacctgattttgtgatggcccttgttaactcatctctagaataaaatagttgtcatggtagaaaagattggactggggttgacttactttccagcgttgtaacacaatatagctccttatctccagagctttttatgtttattgcaaatgaagatacaagccaagagcaaataggattaagtttaggaaggatatatgcagggaagaattcttttttttttttttttttttttttttttttttttttttttttttgagacagagtctcactctgttgcccaggctggagtgcagtggagcaatttcggctcactgcaagctctacctcctgggttcacgccattctcctgcctcagcctcccgagtagctgggactacaggcgcccaccaccacgcccggctaatttttttgtatttttagtagagacgagatttcaccatgtttgccaggatggtctcgatctcctgacctcgtggtccacccacctcagcctcccaaagtgctgggattacaggcgtgagccaccgcacccggccagggaagaattcttggaggtgacaaaatcatgcccgtatatgatggaaaaaactctctaaactgtccatacgtgggttacttattctttattcactgatcgagtgaacatttattgagtggttatcatgtgctagagcctcctagttctgactgtggtagaaggctctcagggattgtctgcaagatgacaatcccttacctaggcctggaagtccaaggggaatattcagtatttccccattgctcttaggatcaaaatctctgtccttatttggcctgtaaagttgaggttctgtctggttctctagccttccctgctctcatctttgctttctagctcaagcagctgacaagtgaagcacagcatcggctctcccttgcttcttttgtaccaccaagccattgcacgtgtgctctctctctctgaaatgtacttcaactgtttcttctatgccttctcagactatatctgtgtcttgttcttgttctttttgtagtcttttctggtatgggtgttttttttttctaacaattgtataattagtataatttttattatactaattcgtatatttagtatgataattagaatattacactaattatataggagcaatactgaaactgggtaattagtggagagttgaatggagggctctttcacaaatagtgcactaggtttatgagaaaccaattcttgagctgaagataaaaaggaaaagaagataaaaaggaaaaacagtaccagaaaaagaactacttggaaagggttacgtgataggagtgatatttgcaaagaggaagcaagcaacctgtgctcacctggcagagagcaagccagggacataaatacagcgactgcccacttcaccttgacctctagatcttctgctggtgggtctatctggagaagtctgattggaagccagaagacatgggagccactgatgcagtccaaatagctcagcctcacagagcagaaaagagggcagggaaggctggagaggcagctggggcagcaaatggtgaatatccatcactccactgtgggtggccagtccacaacagggagcctgtggcatgcagttggcaatgcgtgacgtgactgactgaattttaccaggagaagaagaatggaacttggcattctggaaaaaggaaaatttacaaacatttggaagtaggaggaattgtagtgctttgtgggaactataagtagtttcatgtagtttaaatgtaggtgaaaagagagagtgatcacaggtggtgctaaagatgtgggtaagggccagatcatagagtgcatcacagcactgatctaggagcatttactttattcagcattcttgaggagttagtaaaatttttttaaagataaatatttatatgggaaggtttcagtgtaaaaatagacaaaataatacaacaaactcccaagtatcatcactcagcttttataattttcaattcatggacaatcttatatttgtcccacctacaacctcttccattatattattctggagcaaatcctagacattacgtatatacaatatatgtcatatatacatcatatgcatagcatatatatcattttatccatcaataattcgaaatggacttttaaaagatactttcttttataaacacaaccacaataacagtatattatttaaaaaaatgaaaataatagtacctgaatatcactaaatatttactcagagtttgaatttccagttgtctcacaaatatcatttattttcttatgcagtttctttgagtcggaatccagataaaacttacacattgtggttggttgatatgaccttaaactctccgtagtttccccttcaactcttcctcatttatttattgaagaaactggtcatttgtcctgtcaagtttctgagtctgaattttgcagataggatccctgaggcatttattaaaatgtgcttctttcttttttctgtacttgatagctggatctacatacactacatatattttcccccaaatctactttgtaagcagtgttttctttttctaaaaaagaatatataatgtctggctttctttctccttttttaatgttggcagatattgatggtcaatgtctggatgtaggaaacattaagggttgcaaaatagtgatattctaattctcttttttttttttttgagatggagttttgctcttgttgcccaggctggagtgcaatggtgcaatctcggctcactgtaacctctgcctcccgagttcaagcgattctcctgccttagccccccaagtagctgggattacaggcacccgccaccacacctggctaattttgtatttttagtagagatggggtttcaccatgttggtcaggctggtcttgaactcctgacctcaagtgatccacccgcctcggcctctcaaaatgcttgggttacaggcatgagccaccatgcctggcctgatattctaattctatccttctttacctagatagctaggtaaaggataaatgcattaaatgagatagaaaacataaaagagagaatatctcaaaagaaatacactgtgttttatctattttaaattcaaaatctctgtaagacatctaaggaaatatagaaatgggcaatttaaaatatatgtttagagttcaggagatcttttcaggagagattgttttggagagggaggggttctgccagatcctttttattcttctcctatcatttgtaggaaaaagagaaataatcgcagatggtagttggcaaaaaaggaaatggaatactaaaattaggtccattatttttttctcttttcatcatgtgaataaggtaatccatatacatcatcagctagcatcaaatgcatgattgaatctcagattccagtgactctaattgcttccaagaaagagaatgctatctaagaaaagcaaaattaaatggagtttaaactgtatggttttgaacattctatgacctctaaatgtatactggcatatatttctctctttttagacacattttatcttactacttgctactcatatagcagtaaagcattgtatttttttttcattcaggatgaaataatctaatttgcagtcttcaatttcacatttcttgaactactatattgcttatatttctaaggaagtaaattatttgaaaactcaaacatttgtttaagatgattatgtaaacagacaaatatagttatttgggtatatgtgtatatatttttgcatatttaatatagctgctatataattaaaaacataaccagtaggtcaagctttttagaaacaaactatttttcttagaaatttatatgtgtgtagtaattaaaggctataaacttaaaatcatggaatacactaataaatatatttgtacattgcttatgatttcagtgaaatccaaaaaattgaaaattcagaatggcacttttattataagagagctttgaaatagaattactggaatgagaaaaaagactgtttcttttagactctttatcttgtaattgcaaatttcaaagtagaagtcttcaattcattttactggttgaaatgcattcctgctaattaagatgattcttcattgggtgctgggtaatctgattacctttttggagtttacacagaccataatcagacattgtaatttgtatttatttctgccacaattttctgccattattgtttctaaggtcctttcatgttgagtttgtttctaagtaatttaaacttctcaagacgttcaaagcattattcagtcagaggaattgggaacctaatttgccattcagtatgaaatccaaagatttcagtctcgtaaactttaaagaaggcacgtccagctttctttttgttaattgaaataaaactgtgtaagtttctttatagttatgaattaggaaagcaagaggttatccagtgagtaaaaaggacatggagaaattctcagggttgaagttttacacttaccatatatctttgttttaagaaaaaggtaatattaaatgtatgcttattttgataatatacataagaattaaagtaaattatcagttataattttatgactcataaataaataactatatttgatgtgtttctaattgctttatttttacatttttaaaaatacatgaaaccatattataaggaaaacccatactacaaatggctacctacttttttattgtataaatatagcctaatttatgtaataattattttatgcaaagtttcctttatgaagcttttaggtttttgatgttttatattgcagataatcctgtaattaacataattgtttgtaaacctctcttcacatttcaaattattttcttatggcaaatcctaaggaaattacaatgacataagcattttgaagcctcttactaaaaattatagaattattttttagaaatgtcatactgtttacttgcccaagagcggcatatagagttcctggatgagaagtgatttagtagacagagttcctggggccggccgcgactgtggcggtgggggcggtaggagccccgcaaggcgttgggggtcgctgaaggccagccagctgcattccaggtggcacgagggaccgcccttgtgctcagagaagtgatttaaatatccaacagatgttgaaaatgtgttaatggatacagacataaatgatgtttaaatattatacttgatgaaacagggaagagaataaacttccatccctggaaggaagtaaaggaattatatatgttttatacagataaaattctggaacagacaattatgtccttacaaacaacaacatttgagagtaaggataagtttatttttattgttaccattttgttttttttaaaagaagtcaaatgtgtttttttgcatattttaatgggctgtttatcatttattgttgaaatagaagagatatattctggatacaagtcttctgacagatttatttattaaaaataaattctttttgtttatacttttcctttttgtgtttttagtgtttgttttgatgagcatgttttaaacatccaattttatgaaaaaggcttaatttgtattagagctttttgtgtgcttcctaagaaatctttgattactcccagaaagattgggaggccattctcctatattttcttcttgaagatttataattttggcttttatatgtaagtatatgattcagctcaaattaatttttgtgtattgtgtaagatacatattcattcataaaaaatgcatttatccagctttttccagcactatttgttgaataaactttccttttctgtaaaattgctttggtgcttttgcttggtgtctagattctattctgttccattgatttgtttatcctcattgccaataccacactgtcttaattagctgtatggtaacccttgaatctggtaatatgaatcactttattgttctaacagtgttttccttgttctagatctttgggcatttgcatataaatattagaatctgttattatctgcaaaaaattaggattttaattggaattgcatttaagttttagataatttggggaggaattggaatattaacaatatgaatgttccaatccatgaacatggtatatttctccatttatttaggtatttaatatccatcaacaatgttttgtagcttcagtgcaattttcaggtttttgcacaccttttgttaaatttatttctaagtatttttaatgctatcttaaacagtaatttaaattttacatttaattattgctaatatatagaaataactatatgtgtgtctatacatatacaaatacatatttgtttattgaccttgtctcataactttgctaaattgacttattagatccagtagcttgttttttttaatagattccttaggtttttctgcaaccacaattatattgtttgaaatagagttttactgtttccttacatgcctttccatttttattttttatttaaaaaatttttatgccactctagaaaattctttaaaatttctttttcttggatgttcactaagatgttgaataaaaatgataagaatgcacatgtttgtattgttcctgattacatggggaagcattccatatttttcataaaatatgcttaattgtagtttttttttattagtgtcctttatatgatgaaggaatttccatttcattcctactttcctgagagcttttgatcacaaatgagtggtgtattttatcaaaggttttttgtatctgtgaaattgacatacaattttcccctttcttttgtttatatcactaatttcattaatttttaaaaatcttatactgatcttgcatttctaggataagcccctcttaggcttgatttattatcatttttatattgctagatacagtttactaatattttgttaagcatttttgtgattatgattatgagggagagcgataaataaatttcttttcttgcataatttgattgggttttgatataaaggttctactggccttggaatctgagacaagaaatgacattctcttctatttcctgaaagaatttgtgaagactggtactatgatttttttccttatatatttcataaaatttcctaatatactatttggctttgagatttctttaaggcaagtatagatatagaattattcatattatctatttcttcttgagtcaactttattaagttaaatatttcatgaaacttgttcattattttgtctaaattgttgagtttatgtttacaatgctattaatattttactgtttgtaggatcccccctccattctggatacaagtaattttatcaatttacctatctttttctcataatccttcttctctttcttaccttatgctcttttttattttttgatatggagttttgctcttgttgcccagactggagtgcagtggcatgatcttggccactgcaacctctgtctcctaggttcaggtgattctcctgcctcagcctcctgaatagctgggattataggtgcccgccacaagggccggctaatttttgtatttttagtagaggcgaggtttcaccatgttggccaggctggtctcgaactcctgacctctggtgatctgcccaccttggcctcccaaagtgttgggattacaggcgtgagccactgtgcccagcattaccttatactcttacttccatacatctttcacattccatatgagctccacaaatcagcattaatgtatttgctttgaacaattgttacttttaaagaaattaagagatgaaagacaaatagaaagtcctttgttacccacctgtctccctttccagtgctattcactccttcctgttgatccaagtttccatctggcgtcatttttctttaatttcaatgatttcctctaacatttcttatagtgaagttctgttggcaacaaatagttttaaattttatttttctgaaaatgtctttattttatcctcattctttgaattatgtttttgtagatatagaattctgaattctggactgacaggtttgtttttgttcgtcttgctttagctctttaaatagttgttttgttttcttctggcctccatattttataatgaaaagtcagctgtcatttgcatcattatttccttgtatatagtgtgtctttttttctctgttcttgagattttctctttatttgttgtttttttaaaaatcaaaattttaatttatgagtagtaattgtgcatattgatggaatacataatgatgcttcaacacatataatgtacagtgatcaaatcaggataattagcatatcgatcatctcaaacatttgtcatttctttgtgttgggaacatttaatatcctcctcctagttttttgaaactagatattactgtcaactatagtcatcctacagtggtatagaacactaaaatttatttcttctatcttgttttaattttgtatcctttaacaagttttttcctgtccctccctttccttcaccctttctagcctctagtatcctctgttctactttttacttctgtgagatcaacttttcctagcttccacaaattaacgagaatgtgtggtggttaacgttctcttcctatcttattttatttagcataatgttctccagtttcatccatgttgccacaagatttcattctttttaatggctgaataatattccattgtgtatacatactacatttttttttttattttttgttgttggacacctaggcagtttccatatcttggctattggagcagtgctgcaataaacatgggggttacagatgtctcttcaatatactggtttcctttctattggataaatgcccagtagtgcaattgctggatcatatgatacttccatttgttgttttttgaggaacctccatattcctctccatggtgattgtactagtttatctttagttttaaacctctttgtagctgtattactttcttattgctgctgagaacaaatgaccacaacagtggcttaagacaacatacatttattattttaaattcatggagatcagaagtctaaaatgggtttgtaggcctgtgttccctctggagattctatggaagaattagtttccttgtctttttcagctactggaggctgcccacattctttggcttacagtcctgtgccactccagcctgtttctattcttgcattgtcctctctgactttcattctctagaccctaatttttctttataaggaccattgagactacattgggtccactaagacaatccagaataatcttcctatctcaacaaccttagtttacttacacctgaaaaggcccttttgctccatgaggtttgtgtggttcctgggagttagaacatgggcatcatttttggtggttgtagtggtgagcactgttctgcccaccacagtggttttctttgcatttatgctgttttaggtccactggtctccttggacctaaaggtttatttttttccccaacgaactaggaatatttttattcatgtattttatgctcaattctccctttctctgcttctgggatttaattaaatgtattttagattgcttgttattgtctcataggccatgaaatagaataaaacatttctgtctctgtttttcagatacggtaatttctattcatctgtttttatcttcactggcctctttttttctgcagctttcaatttgctcttaagttcactcagcaataattttgtttttttcattttattatggatgatgttttcttgcttctttgcctgtgttgtcctagtggatgatacatcgtatgtgggtctggattgtgtttcgttgtgacttagtgtgtactgtcttagcattacattctacttagttctccacttcctgcttcacaagataaaaaatcagtcttatataagggacgaattctactggaccagtattaaaagatggatagggtatatttcttttgttccagaattatacaaatctattttattccattgctccattatattttattgattctgtcactatactgccagaatattgcagattttagaggaatgattgtccatatagctacctttaaagcatacaaatgatttttttctcaaaccgcatcatgaatacgagtctaaatctcactaacagctatgaaactggacaggtccacaagagtggctttttttttttcctgcttctcataaactcactttggtagtgactagaatctactttcattaaacaaaagtgaaaaaagacacatgtatacaagtaatcccaatgagagttttgagatttttacaagactttttcatagaaaaatttttgacttatagtaagtatgcaataattgctactattttttttaatttgcagaagggaggtttttcaaatgcagttctttctttttcactctctagcagtttagagtggctggacaatatcacatcacttatatagtcaaggaaagaaacagggctctagatgggaggaggtggaatttgagaacatgattatagaattgtaggtacaaggccaggcgcggtggctcacgcctgtaatcccagcactttgggaggccgaggcgggcagatcacgaggtcaggagatcgagaccatcccggctataacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaattgtaggtacaacctagaatcataaaacgctagttctgaaagtgattgtagcagcatactgtaatcactttacatatgaggaaactgaatttatcgaattatttttgctataaatatttattagtgtggacaataattaataccaccactactaatagcatttaggttccctacagcatgttttaccatggagctttaaaacacaccagtgggctgggcgcagtggctcacacctataatcccagcactttgggaggccaaggtgggtggatcacctgaggtcaggagtttcataaaacgctagttctgaaagtgattgtagcagcatactgtaatcactttacatatgaggaaactgaatttatcgaattatttttgctataaatatttattagtgtggacaataattaataccaccactactaatagcatttaggttccctacagcatgttttaccatggagctttaaaacacaccagtgggctgggcgcagtggctcacacctataatcccagcactttgggaggccaaggtgggtggatcacctgaggtcaggagtttgagaccagcctggccaacatggcgaaaccctgtctctactaaaaatacaaaacgaaattagctgcacatggtggcgtgcacctgtagtcccagctactcaggaggctgaggcaggagaattgctttggaggcagaggttgcagtcagccgagatcgtgccactgcactccagcctgggcaacagagtgagactccatctcaaacataaataaataaataaaataataaaaaaaacccagtgcctagaaatgttaattcttgataaaatgaaaaaaatcttaatgatagatgttcctgacagtaaaatagcttgtaaaatgttgtgtcaaaaactatgaattagctgatattggtgccactgcaaattatgtaagtaaaatttctcattttggtgactagctgagtatatcaaagaggaaaataattcaataggagatagatccattgaggctatttagtacaggaggctagttatgggatgctagaagaactgaaaagaggtcaacccatagattagcaattcataaatcgacaactgcaggaagtctctgtcacctctagggctagagggacagcgagagaagatggtgttattagcatcaaggagctcaggctataaaacagagctggaacctgggagaagtggccacctgagaggcctgttgatgggcatggtgggagggtcatacggcagaactagaactctggagaagggaatcgctccaggagagttggagcctcagtgagggctgcctgtctgagttggagccacagggacaggttcgcctggagagagtgcttctcagtaggaaatggaagctcaaaggaattactagctattgccagacactgattgagaaaaagagatgggaagaaatacttactctctcctccctttcagcccactaatatttatatttgtatttttatttcttgttcctttgtgtatgacgtgaggtagaatactgattttatttttctctatatagtgggaaatattcccagcctctttggctaaattatccatcatttctccaataatttataatgccacatcaccgtagttcatgtactcgtatctttgagtctattctgttctgttattcatttccactggctttcactattttaatgactgcatctttaagtattatatatttcggattctaacaggggcagtctgctatccattgcccctgttctttccaactatccttagtaatttgtggatctttatccttcaaaattaattattgaatcatttttataagtatattagtcaagattctccaaagaaacagaacaaaagggagtgtgtgagtgggggagagagattgagatttattttattctcacgtgaattgtgaattggaggctggcaagtcccaatttgcaccaatttgcagggtaggctgacaggctagagacccagggagcagttgatgtttaagctcaagtccaaaggcaggctgaggtcaaattcttcctgttctgggaaggttcttcttttttctttttagagtcttcagcaagttggatgaggcccactcatgtttgctttactcaaagtctactgagttaaatgttaatctcattaaaaaaatactttcatagaagcatctagaatgtttgaccaaatatctggttactgtggcttaggtaagttgacatgaaattaacatgacaacaagattccttaaaatagtatttctattattttaatttgaattacattgaattggtacattaattttggaaaattaacattattagagtattgaattattctgttcatgaatataacatgcctctccatttacttaagtcttcccttacatctttcaataaagttttaaagttttctgcataaaagtctgcatgtactgtttttgttgatattgtaaatggcattttatatcctattgtatttgtttatttaatgctagagtagtagaatactattggttttttaattcaacagtgtatcagccatctttcttatgagttttaacacttggcctgtgaattttcttggaatttttgtgtgtgggatgatatcagtagaaatattagtaagtttgcattttttcttttaattctttttttttctaattttatttctttgtctcattgtgttggtcagtacttccaatattatgttgaaaactttcgttgctgatggataactttgtttcttgaaaggaatgcttctaaatttttttttattgtgaataatatttttttctaggtatcttggtgggtgatctttatcagttacaaaagctactttctgttcttagttttctatgaaattcatttttatcataaaaggcattgaacatctttttttgcttaatcttttgagatgataatgtggtttttctcatttaaataattaatgtactgaaattacaatgatgtattttctgatgttgagtaattcttaatttcttgattcttaacaataaaccataataactttaacttctataaaagagaccactggcagcaattagatgtttttaaatgattttggcattatgatcatgaatataatttaggataaaattttttgttttcttgtactgcttttatctagttttgttaccttaaaagctatagcatcatattttctaaagcatcttgtactaaatagacactgtctttccttaacatttaggtaggacggacttataaaacatctagcctctttgacatttttggggagggggtagtggggcaggtaaaatgaggaacattttttgataactctttcaatttttaaaatagccctaatctatttaatttctgtatttattacaccaaacttcgtaagttatatttttccacgaaatttctttcttatctaggtttttcgatttattgttttcctaaaattcctgcatgattttcagaactctgtattatctctttagctagctccttattttatttatttaattttattttttagatacagggtcttgctctattgccaggctggagtgcagtggcgtgatcatagctcactgcggccttgacctcctgggctcagaagctcctcctccctaagcctcccaactagctgggactacaggcatgcaccaccgtcctcagctgatttttaaattttttgtagagatggagtctgactatgttgccctagctggtcttgaacttctgacctcatgccatcctcccactttggcctcccaaagtgctgggatacagatgtgagacactgcacctggccatttcttatttttaataaagaaaataattttggccaggcacagtggctcacacctgtaatcccagcactttgggaggccgaggcgggaggatcacgaagtcagaagattgagaccatcctggccaacacggtgaaacctgtccctactaaaatacaaaaaattagccgggtgtggtggcacatgcctgtagtcccagctactcagggggctgaggcaggggaatcacttgaacccgggaggtggaggttgcagtgagctgagattgcaccactgcattccagcctggcaacagagtgagactccatctcaaaaaaaaaaaaaaaaaaaaagaaaatagttttatgttttctattcttttttgtttagtcttacaagaggtttgtttaccttgttagtctttaaaacacaagcagatgatctcttgcgcttgatctccatgtcacagattttttccttcgggtactttgttccaggaatgaggctggggctgatagtggcggtgaggaaggaaaggagagtaaggtttgctcttgcttcacccctcccccaacccaggattgcctgttctttccatctgacagcaagtagaatgacttaggcagtaaggaggaggatatgctttgagaggggttgagggaaaatattccagggaagagtgtagtgtgaaaagatagaaaatctcaagacatagctgcagtgcaaaggagagctatggtcttgggtcaataaatggcaatgaatgcattaggtcagggactgtctcagttttcctctcaagtcacagaaaagcaatatctgacgttctcagaagactaacacatgctaggttaaatagacagcgactgtcacgaataaatcaaagtattactaatagtaaatgattcattctagaaagtcttggggctttctattagggctcttagagactatgtcttataagatgctaagcctagaccaatctgagacatgaaaagtatgtatttctaataagttttaaaaaattacttatactctaatttgttccaaaaataatttaatgtgaccgtgctaacaataatggaaatgtctctaccctgaaaagctaattacagtacttcctcttgtctctgtgcaaccatcttggattgattgtgaaatgccggtaggggcggcattgacagttattaactctacctgcttgtaatatttgctgttgttttatttttgagtctgagaagatggcttaaaagtggtctagactactgtgtatgacttcaaataccaagaggttggaaggtgttcaagccattttcagtccggttagactcagcagaataccttcttaccaggcaggttttacattttatctgtcatgaggcctactcaagtctacaaaataaaaagagtaaaatcatatcagataataaggcaaaaagaattttagtaacttctcacatcattctcctctgctttcttgctcaccagtcagttggcgggaggtgtgtaatagactaggaaggggcacgtaggaaccttctgggtgttatacattttccaaactttggtctcgatggaggttcacatgtgtatataaaatatttattaaactgtataataaaatttgtgtgctctatgtatgttatacaacaaaaatgtatgatttttcttttatttcctagaaggataaataatactaaatacattttttttttactaagtcagaagaggttatacaaatgtgttgctccttaatgacagacttttaatattgtcttgaaactccattctgtggctaccatgatgaactgagttctgtctttcattttgatccttaaagctgctttgctttccagagtgttttaaattaagtaattgatgttattttgcattttgttgatcttatacaggttagagatagcttgtggaagtttagataaaaagcaaacacctatttaaacttgaaaagtaacaatgtgctgcatattaaagtattggataaatacaatttagaggttaataaactacctgctttatattcttcatattggttttgttctactttcattggttatttaatgagaatagataacacaaagaaaaagctttgtattaaactaacatgcttaaatttagatttgaaacatataagagcaaaaagtgatagttaataggaatttatggtaaagctcgtcaaaattgtgaatatttggtttatttgcattaatggtttatccaggtttcctactatggtggtggttaattttactaattttagtatgtttatcagagactccttggttatgtacaatggacttgggggtttccagctttcttttccttttttttctttgagatggagtctcgctctattgcccatgctggagtgcagcggcttgacctcggctcactgcaacctctgcctcccaggttcaagcgattatcttgcctcagcctcctaagtagctgggactacaggtgcctgccaccatgcccagcttttttttttttttgtatttttagtagagaccgggtctcgccatgttggccaggctgctctggaactcctgaccaccggtgatccacctgccttggtctcccaaagtgctgggattacaggcatgagccacagcgcctggcctccagctttcttaaataataactaactccttgctcccctttgactcttgtttttataggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgagtgagtctgctcatggcctaccttgcttaacatgaagaccttggagaggagagtgcagagcatgtgcatggtctggggacctcactgtgttgggaagaggaaaaaagtccaggagactcagtagttccttggtttctctcataggaacacatagagtttttttctccttgtttattatacagttccatgcccttcttttagtagttattactgtacatgagatagatgattcttcttcactgaccacttgagaatatatttactgggactagcagaaaatcattgagagggattctaggatggtaaaccgtgttcaggtaaatgcgtttttgtttgttttgttttagggaagcacatagttagcctgctctttacccaggtcgcttggagagtgttggtttctccagtcacgggtggttggcagagctggtcagtggcttgcctctatccacattgcatctctttctgcctgccagtgaattgttcccttcctgatgttcccattttggggtcctccatactctggggcttcaactcagtgttggctttctgggcagcatcctattgtccagacatagcctgacccactctttctacccctgaacacatggtatcccacctggagttttcctttcttaggcattttaataaactgacttgaggtaaggtaatattggctagatatttagaattcatattcatcttatagtgtgtctcactccaactagtgattaagtgtctgtggggttggagaaggggacggaaaatgaacataatttttggcatcttttgagtatttcctctatatcatgctatgtgcttaaggccatttcaggacttagccttttgtcattctctatcacagtgagggactctcaaaggtgctcctcccgtttgtggcctgtaatgcatggttacctatttgcactgagtggctggcttccttgtggtgcctgtaaagcaagggcgtgctttgccatgcatttattgagtcaatataacggtatgcagaagtccttacaatagccagcaacacaggtgccctcattcactaccaacacttactgctctctctctgtggtggcacatgttggttgaggaacaggattagacagtgctctcagagtgttccagcttttggcatctgggtctcagtttgaagctggggtaaaaaatcctgtctgtcctctccttccttctctcccagaatctggacttcccccagaatttttcctagatcattttccagaggtgttttttagttacatgtctttctttgtttacattttgcatttagtgaaactcctcgctcattcctcctgtcctccgtgcctgctgccctccctgcctttaccttctatcaggttaaatacacaattgctgaggttatatgttaaaaaatgtggcatgccagtggttgtatatggttcatccaattccccctagaaatgttagagttaaatggaccaagggtttgctggaaatctatgaactactaagtgaaaaaccatctctgaaactgtgctatagcctatgttgttgggtcacttgtagatagttaagaagatatgcagaatctaaaagtttttactatatataggcagagaactcacagtcttagacctgctgcttctgtatttaataaccttatcagacatgaaatggttttcaggtatttagttttaaacagcttttacctttgtgttgagaattcgtatttgctcagcaaccatattgttaagagttcatttgactttctgcatctatagaagcacataaaaagaatttttttctttttgtactcaaggcacacatgatatatgatggcattttttgtagcacttagctttgcaggtgttcaagaagcagcctcaacttaaaaatactgttactggctgggtacggtggctcacacctgtaatcccagcactttgggaggccaagatggccagatcacttgagaccaggagttcaagaccagcctggtcaacacggcaaaaccccttctctgctataaatacaaaaattagacaggtgtggtggcatgcgcctgtaatcccagctactcaggaggctgtaatcccagctactcataagaatctctaggaccacaaggcagaagtttcatggagccgagatcacaccactgcactccagcctgggcaacagagcgagactctgtctgaaaaaaaaaaaaaaaactcaaacaacaacaacaacacaccccaaaactgttacttactttctaccagaggcagtgatgcctgcatccaagccaccccatgccctctgaaagacttatgagaaatgggaataatagtataattttcattttattaatgaatatttataagacttaaagataacaaaaatctttattagtacttgtgaaaaattatcattcaacactacattttgagaaaatcaatacggatagcacattttcaaaagaaagcaaaaaaacctagtcatcatgtaatgtttgcttactaaaccttaattgctctcattctgatcttatttaccttctaacctatgattaaatatttctttcaattttaccagaaaaccttgttttgaaatctaaggtcttccactagatttccaagtggagtttcaagttcaaggtcagcctttccttcaagactgttctataagtgttcttccaccttctgagtccttcaagcctttgtctgctttgaccatcaattgtgtgaagtgcaccatttgaaacaatgaagaaagagaaacttgaaagacattttctttatttcctgccttcctgtctttgcctgtcttcttttttcctttacttgaggagaactagtcgaaaatatctttagcatttttagcttaaaaacctctgtgtgtgtgtgtgtgttcccagtaagaagaaggtggttgtttaattcatctttaaaaattaggcttctttcacacagcatgttaattggatattcgagacgtaagtgctgtggctcccgtaacaacagttccctttccacttagatgccagtgctccttgtggttctgccctttctctgggagactgtatctctgatctgtgtcttcagcccagaattttcttctaaaaattgaagactcatacccaaatatcttagttgacatttttaccttaatgtctcatagtaacctcaaactacatgctagaaactggactcattaactttatttccttgacttttctaccccaccatccagtgagcctattcccttcacagctgtacacatgaaactaccatccattcatttgtcctgttcctggcctctggggttccctcagtcgcttctacttctatacacctgtgttagtccatttttgcattgctgtaaagaaatacctgaggctggataatttatttatttatatttatttgtttatttattgagacagaggctcactttcttgtccaggctggagtgccatggtgccctcttggctcactgcaacctccgcctcccgggttcaagtgattctcctgcctcagcttcacgagtagctgggacaacaggtgtgcgctaccatgcccagatgtatttttggtagagacagggtttccccatgttgctcaggctggtctcgaagtcctgggctcaagtgatctgcccgcctcagcctcccaaagtgctgggattacaggcgtgagtcactgtgcccagctaaggctggataatttataaagaaaagagttttatttggctcacagttctgtagcctgtacaagcataggaccagcatctgcttcgcttctggtgaggcttcaggaagtttacagtcagggcagaaggtgaatggggagctggcatatcatatggtgggagagagagcaagagagacgggggaggcaccatactcatttaaacaactaattctcacatgaactcagagtgagaactcactcactacctcaaggagggcaccaggtatttatgagggatctgcccccatgacccaaacacctctgaccaggccccacatacaacatcggggattccatttcaacatgagatttggatgggacacacatccaaaccatatcagcatccatcagggtagctactacattctttgaactctatcttctgtttatttcccaagtctttgactctcatctcctctatcttctctaccagtaaagcagccagagttcaaaagtcacgtgagctacctctcagcagcattactaaaatatgcttctgactattttctgttcctgcccttgctgccttcacataatctgtctcttctgatatacccgttagattgatataagaatcccaagcctgtgttccttagctttgcagacctttttgatcactcccttcttcattctctttgctctttgttccagggaagattgctgttcctggaacagtagcctgtctcctacatcatcctggttttgctctctggtcctcttcttgcagtgccctctgcacctctttatcttctgctaactcctcgctcacagcttaggaccccattgaaatgctactattcctaataagccttttctgtctacttctagctgttagatgtacctttacgtgtttcagtggtgctcttggttatttccattacaccacttactaaaaatagtgtaatcattgattcactcctcccttctctgctctgtggggaggccctaggattttcctcttaggatcctcagtgtctgtcatagctcctgagacagtcacatcttgcatcagcgactcacacatgaatccattctataatgctgtctctgctgtgtttctcagaaattgctttctaagataacataaatctaaaattttgtgaatataaaactaatatcaaatgtgttttggtcacattgtcttataagtgaaagatacatatttaataatttcaagctatggtccacatggacagaaggaatttccatgagaaatagttaactaatagggcttcatgatgccactagatcttcatttatgcaaaaggaaaaattaatgttttctaaaaaatatttcttggcttataatcccatttgctattattatacacaaactaaaaagctaggtcccactgtgttcagaagctccttatatatatgggagcatatgtcatttatcatagcataggaatctacacagagtatgaactacagtaaataccttccccacaaaaagtaataagcagatttatctaggttcatattcatatgctagttacctgatagccaatatgctggattatgttctttatttgaaatgtgccattgaaggagaatagaaacaaaattacccaggtgttttgggagatcttcagtgaactattaataaatagataatattatccttagttcactagtaattaaggctacattattaaagatgatcgtttcatccaatgaccaggtttctagtcagcaaactttgaattgagcaatcgaattccatcatcctaggctgctgagaactattattgtttggaaacgatagtacttggaggataacacagacagagagagtcttgggctggagttacctcatgggtgactttgcatgagaagttatgtatgctgcagaacagagagatccgtggaactaggtctaatgtagttataatgaaactctttaaataagagagtggagagaataattatgtaaagtcaacaaaacattttgggtttagtttcttaaattctacattttgtcttttctagcagctgctgtagactccaatataaaagaagggagaaaagggagaaatctgtggtttcatttttctacccagaatgtgggtggaatgatagcaatacagtgatacaattagactttcttggtattacctttggagtttttaaaaagcctttgttgtttaactgaaggaagttgaagttttggttgagacactctttttaagatgattgtcttttggtgagtgttcctataaagcctggggaaacctgatggctgtgtgatgaaagggttaaattgaccttgaatcttttcaaagatgagtttaccatgccagcctaccactcaatatgtaagtgtgtgccttctctccttgggtgtcctgatgggcctgagcaagggaggccatggtcatccccctacaccccccgacctgccgtccagcatcgatcccagcctggccccgctccggtctgtgacttgcctagaaccagcgccttccgtgtgtcctgttggcttcgttgctatcaccggctttttttggattatttccgtggctggcttggttttccttttcctttccttcgctgttcggtgatgcgctcatttaatttctgtttaaattttgtgtgtctctctttctctcccctggcttgttccttgtctgtccacgctgtcgctgactctgtcttcgctgctcattccctgctgcctctagtattcatcaggtgcaaactgcggacctgcggcgagtgtctgctccccccggctccttcaccatgtgagtacagtgccattctgtttctacattttctccccagcctcgtctcctcagggttggactacctgtgtcccttgccttcacaggtctgttcgtcagataaggaagccacctcaccagaattgctttctgttgccctctttgatttgaaatggagctgtgaagtttttcatgttctatgtgcttccatcctctaagttaacagttcaatttttggatgagatactttagggtccatggttgcctggggttgtatagaattccatgctaagcattggtttttatgggaagtgcataataccgttagactatgtcattacttacggctcagagataagctcgaggaagtgcctgcagccctcaatttctggatgaaaccttaagattatgcgtggagttttgagtgtgtgtgtgtgtttctgttttggaagatccatagttacagtaaaagttcaatgaccccaaactgtcactgagttagcaaaatgcatttttatgtatatttaggagtttttgcttaatgtagtccagggtattatttttttctagtgagaacaaaaaaatatgttttttagcatttcagctcagaattattttgtgctgtgtactctgctttgtcctttgttttctccatatcacatatgcttacctagcatttattatgtttcagggactgttacagatactttacatattaattaatttgctctcccaacaacctttggccatatgtggtataattatctcccttctatgcatgaggaatctgatagacagagaggttaagtaacttgcccaaggtcacacagttaataaatcatagagtgggattcagactcaggcagtctggcttcaaagttcatgtttttaacaattcatagtctgctgcctttcgtctgtcaggatcctgtatatttctcaaggcccacttgaatgattacctttccaaagaattcttctttgattcttgctgtcagagttaattacaccctcactggagtttatcattcatgtatctgttgcagttctcaaggtttaatttggtgttaattacattaactctgtgtctgtgtattttacacagtagacttaggctatttgagatgattggcaatatcttaatatgaatcttgtgttcccagccatgttcacagattttaatatgaagtattctgaagccaaacaatgattgattggttttcttggtggaatgagtgcataaaagaatacatgtctaaatagaattgcacaatatctaacatctggtgatatgtatgacaaagcaattcctaaagttcagttatataatctactttcaactctcatcttatggatactaatttacttattatttaaaatatgtatttattcaaaaacctttattttgcacttgctctgtgccagacagtattttatgctctgtgtctagtggtaagcatgacagagcactaccttcctgaagcttacacttgagcagtcaaagaatcaataggaaaatgacattcaattgccaaactgaatgttgtggctggagtaaaattctatattctatataggccagttcaataaatttgagtttaaggagtggctgcatgtgatcattatttttagtggctccgttgattgtgatcaaagaattgagaatgttaacagcagaaatgcatatgatagtcatcttgtttctattatgggttaagttggttgtatttacactttagttgtgtatcttaaattggactgtttatctcttattccatgagtgtgcgtgctacatacagtaaagtaaattgtccatacttgtttctgtagggtgcagcaggctctaagttgtggttaccttaaaacttgaatgttaatttgaaaatattttatatctacatatgatatatattgaatattacatgtcatagattttctacctatagataaaacatttacataataaacattaaatcaggatattattttaaaaatcagttaataaaactatatggaatacagcaaggaatgtggagaaaagtttaagcacaacatgtgcattttgtctttttatgttatggcagtgcggatagccttgatttactcacacactagtgtttgctaatttcagcaatgttgaaaaaaccatggtaacattgctttggtcctgtagaagttaggagccccagtatcgttaagtgagattttatatatttttggcggggaggggaagggggttgctatctaatcagccactctctgctcagaacaactcttttttacagatggtcttttctttgggtgaaccctctctttatgctgctcttgaagcaattgttgcttccttcaagaagcttgaagtgatctttttttttctctctagctttcagaagactttttctccaggaatggagtacatggtggtaacaatgcaatgtatgaattattaggaattgcaacatactactaatgtctgtgtatgtgcaaaatttccagtttattcaaagaaaaatcatgaaattttatgttttgaccatatatgacaacatatgaattgatgaattttaatcaatggtatttactggtctcatccaataggacaaaacaaagcaaatagaatatttctccataaatcttgtatagtgcaagttaatgaattaataaattctttataattgattggcttcataatgaagtaaagtcctcattggaagacacatgtacacactacatttcataaatcatgactagtcatggtaaatgctgtaattgccaactcctattcagctaatgccaaaaaagtataaaactgcaaaatgtgtctttctagaactctcttagcctttagtagctacctctcattaggttctgtttccctcctgctcttcccccatcaaaatgaaataatgtgttccatttacacctaatttattcattgctttcatctttaaacaaacattattgagtgtttacttcagttactcaatgctctgtgggatattggagaagcagagacaagaacattaaggtttcagttgtgttgcctatgacagaattacgaagccatgtgacaagcatccaagtagaggttctggttgttcttccatatgaacgactttgtattgaatgtttattatatttgcttttatttttaatatttaaagttaacatactgtaaaacggacttttctggtgtacagttccataaagtttaagacatatagagattcatataaccaccaccatagtcaggatatagatcagtcagtcaccccaaaagagctgcctcatgatgtattccactgtagtcaaaccctcccatctcccaacctctggcaaccactaatcattatagttttgtgttttcaggaatgctatataaatggaagtatacaatgtgtagtccattgtagatggcttctttgactgaacactacacctttaagatttatccaagttgctgcatgtatcatttatttgttcctttttattgcccagctgtatttcattgtatggatgttttagcttgtttacccactcccccattgaaggatatctgggttattcttccagtttggggcaataatgagtagagttcctataaacattgatgaacaggttttatgtaataagctttatgtctctaggttaaacatgtaggaatgggattgctgggtcatatggtaagtgtatgttcaccttcgtaagaaactgacaaactgttttccagaatggtcgcaccattttgcatttctaccagcaatatatgatcattccagttgctccacacccctatcagcacttggtactgttagcatttgggaagcatatgtccaagtcttttgatcattttttaattgggctgtttgttttcttcctgtgaactttgagagttcatcatgtattctgcacccaaggcctttgtgtgctttgcagacattctctcccagtatatatcctgtcttttcattctcttggtgatatcttttgtagagtgaaaccttttgacagaatccagatgatttttttttttctttatagagttgtggttttggtattacgttaaagtactctttgtctaattccaggtgaatattttctcctttgctttctccctaaagttttataggttttctattttgcatttagttctgtgatctattttgagttcttttctatgagatgtgccatttagcttgaggttaatgtttttgcatatggatgtccaatgcatttggcaccatttatgaaaaaattatcttttcctattgaattgcctttacaactctaccaaaaatcaattggatatacaaaaagtcatcccttagtatccataggggattttttccagagtcccttttcttagattctagatgctcaactccctcatataaaacgggtatttgcatataacctatgtacatactttcatgtattttaaatcatctctagattgcttataacatccaatacagtacaaatgctatgtaaatagttgttaaatgcattgtttggggaattgtgatgagataaatagtctgtacatgttcggtatagacaaaaccattctatttttctgaatattttcaacctgtggttggttgaatctgcagatgtagaacccacagaaatggagaactgattatacacacacacgcacatgcacacacgtatacgcacacacagacacacagatccagtgtagactctattctgtgccattgacctatggcttatgcctttgccagtgccatattctttctattattgtacctttatagtaactcttaaaatctggttgcattattcttccaaatttattcttcattgtcaacactgttgtggctatttgagttcctttgtctttccatacacatttttagaatcagcttgcctatgtctccaaaaattctactagaaattggatgactggaattatattgagtctatagatcaacttggggaatgttgatatctttactgtgttgagactctcagttcataaattctctgtgtctcttcatttattttatttgtccatcatttcttggtagttttttgcataaagattttatacctattttgttagatttgtgcctaagtagttcatgtttttggagccattgtaaatgttttttttttttttttttttttttttgggggggtttttaaaatgtttgtttccaattgctcattgttagtatatagaaatactatggatttttttttccttttgatacagggtctcactctgtcacccaggctggagtgcagtggtgcgatttcagctcactgaaacctctgcctcctgggttcaagtgatcttcccacctcagcctcctgagtagctggggactacaggcacatggtaccatgcctagctaacttttgaagtagtgtggagttttatatgttgaccttgtatcctattggccttactaaattcattttttagttctaggagtttggtagcatcctcaggattttctacatagtccagcatgtctgtgaataaggatacttttattcctttctctctcatccttatgccttttctttcttttgcattgttgtcctggctaggatttagagtacaatgttgaataagagtgatgagagtttcccttcttgctttctttctgatattagggagaaatcattctgtctttcaccattagattgattattagttgtagaatttttgttgaagtgttttgtcagcatatctggaaaagattagggtattatttgttctttatatgtttgttagaatttaccaatgaaactctcagagccacaagattttttcctctttcttaagctataaattcaatctctttaggagttgtaggactactcaggttatctatttcaccgtgaatgagttttagttgtcttatagttgctcgaagtatttgaggaattggtccatttcatctaaaatgttaactaatgtatgtagagttgttgtatttctttctctctttcatgtctgtgaggtctgcagtacaagtcctcttttattcctgatattagtaacctgtatctttttcttctttgtcaatcttggtagagatctatccattttattggcttttttgaagaattggcttttgttttactaactttcttggttgtttttcaatttgcaattttattgattcctgccctttattatttccttccttctgcttgatttgggtttattttgctctttttttcccatttttttctaaagtggaatcttttatttatttgcttcagtatgcaattgactcaagttcaggccacaagttttgactaatcttctaagggttgtggttacaacgttagttttattaccaaagtctttgcattgctattcttatctgtctggcttatgcatgactaagttgccagtatgggatctgggtggagttctaccctgtagttcagttcccaaagtctatggtctggtgtttagggctagattcatgtatttacagcctagagataaacacccaagagttcatgaacatctttatggagttgttttctgagttccttcctttctgctgtcatccctggtactttctggtctcttggggcttcctttgtttggtccttgtgccagaaagctaagggtttagttacctcactctgctgcatactgcctgtaactgtgttcatgtccagggccaaccaatgataacagaaagaaaaagaagcaatgatagtttctgccactctcttggcgtcacagctcttgtgattagagaggaagcccctcttccctcctaattttaggtgccagaaggctttgtcattgcggctgccagaaatagtgaaaaggcctgagtagtgtagtgggagaaaatggaggggggaaaaaagaaagggagatccttttccatttctttcggcattcagagtcccttcttttcttagagctggagcacaagcattttgccagagctctttctctctgctcctggtgtccccttttgggctttatgctgcctggagtccaggctggggcttattggagagagagggattggggagtttactaccaatttgatagtatcttaaaatctgatgttcttcaccaatctactgctatcgtttacttttcaaagttctcaaatagctgctttatgaaacctgtccacattgtatagccgcatgcagtggggaagaaataatgctgtgtgctgacccaccttcaccaggataagatctcccctgttttttgaagcagagaactatcggactgcatttcttcttgcccactgcagtgactcagcgagtgtcatagctaaattcagcaaaacaactctgcagagacaccagtgtattttgaattacaactaacatatgttaagtgtaatataccatcttgcacagcagttgcaatttaaacataaacaggatatatcccactgctaaattgtgtgggtctgcttattaccttgggaaaagcaaagttagaaaccgatccatgaagaaagtatgaattgtcatatttgaccactgaatatgactcagcattccaaaattccttgtgataaatgaagacttcttggtaaggatgaaagtaaattgatttttgttccaggaagaaagggaattttattaaaagcaagggaaatattttcgatatattaaaattttttatggttctgttttaggttgagtttaagaattttatttttataaaactaccaagacagagcaaagaacctttgatcttcacaattgaagaaaacataaattagccatagatggctaaatgtttgcatgcctctggccagagaagtaaactagaagatcttttgaaaagctttctaaaattctgtaattctattctacaactagtcacatcaaaacttttgttctaacatttacttgagtttgtataattatattatgaaaggtctctttattctgtttacttagttgtggtcctacaattagaaaataagacttgatttgtgttattcagaaccctctttcctttcctttcctctctttataaactctgccacaccttaactctttaaggaagtaacaaaaatgataccaaagtggaaatttacatgcatgcctttgtaaactataaggcttacctctaaagcagctgagatgatccatcagatatggtttgcctcaatgaattaagctgctggtggctaatacacaaccttcctgagagtctgagaatgaatcgcactcatgggccagtggagcctccagaaatgtgcttcatgtctggggcagaaatctgtccagattctgattcgtggattataatttttgaatcatacctcctggacccaaaaaccaatttcgagggtaccaaaacagcctaagtacttcaacttgtgtgattaggtttgttggtcatgcttttgttattattattattgtatttctaggtgattatctctgaattgtaggattatcgataatttttttttatttctgtattttctgatggatttccatgaatggggagtacttctaaaaagggaaaaaaagcagaacatttcatatttttggaagaacaggagagaattgctacattcgtagaatttaaaggcatgctatttgctgaatcttaaggtcggatagtgaagtgtaagagttagcttcaggctacctggaaagcaaagctatttgctctctaaacttctgagcaaaggaagatgctaaactttgcccatcgtctcttcttccttcctctctctcccttggctcctgaatttcttgggtactcttactagtaatttcacttcagactgtgcacagtttcttgactttcagtcataccatcatgtcatcccttctttcctcttgttatgccactcttccctgctagttccataaaacagacatctgcaatggacaattccaaagaaaagaaataatggttacttggacttcagctcatgccagtttccacactttatctctcagtttccatgagagcccaggctgcaactcggttaatgttgttttttttttaatttgttttgaattttttaaatgaatttctcccatgagttccctcactctgcctgggcttccattccactctgagaggtctagtgacacaaagaaaaggggcagtggaagcagtccacgggtctgtagccagagcgtcttcctccttattctgcaacccctctttccttatggtaacatccttctgatttgagtatctgggggaaccctgcatttgtctgtgtaacatcagccatgtattaaccttttgcatttcagtttttcagatatttaaaaactgcagttggtccttcgaattcctatcagctttgaagttctgttatggtagaattcaaagcatgatcttagaatcataagaaaatctgccctccaaaaatctgtaacatgaggtggatgagacttgctatgggacaagacagcgttgtccttggttctgagtactgggcaggggggccgggccctgttcttcattggtaagcatagttcatgtctcaccttcctgttagcaagaaccaaagtggatttttacatttagtcagagacataatatgtacctaagcaccttgctctgtgatcaaatttaacaccctactaacttctaaggtcacagttgctactagtctcattccctagatgagaagacagagaacaagaaatggtaggaaacttgcctatgattgcatgctatacattgataaagttgacatcgtagcatttaaggcatttatctctgctgtcaatatcacttctggtcattttcttgtgtgtgcatatatgtatgtatatttatctctattatttatatattttaatccaatcatattatataaacttttaaaagaaacttgattatgaagaataacagttcaattctgagtgttgcaaatgtgtgaatctttggtgtcataggtttatagttcaagtgttgttataataaaatttcagaatgacaaatttcaggtaaaaatagcaccactaagtaatttgaagtcttttagaatcgtaaggagtggcatttgaactgagaaacaggcttatcaggaaatgtcatgctgacatccacagtggaggaatcgttcctgtgttcttatattagtaacagtccacccagagctcggcaatcagtccacttatgtaaaggcgcaatacacttagggccccttccacatttaacattctatcttattgctttcaaatttatttttagaggtgaattatttatgtcctcataggtgtagaaatagtcttaccactcagcacttttcatacagtaaaaggttacttcaaaagtgcagcggatatttactgcgggttttgttgccttgagtgtgcagggaataagggagctcttgcagaagtcagacttgggggtaaaggagaaagtttgcaggaaggtttgggggtagtacatgtgccaggtatgtttggcagggaaaaggagggggaaacatttatgaaatttttaaaaaataaaaataaatttcacaaatagaaatctgactttagagatacaattagtccaacagatacaacacttgttttttagatttttctatgtttttaatagataagtgaaaattagggtctgaatagccagggcggggatatcaaattggcagagattcccaagccagattgaaatttttgaaaattaaaaattagatttctctcattcttccattatatatctttttataaacactagttgtaggattagaacaaaaggagttagttctttttgtgcatctttttagtagatacctgtatgagtttactaggactgccataacaaagtaccacagagtgggtggctaaaacaacagaaatttatttcgttacagttctggaggctgaaagtctgaatgaaggtgtcagcagggttggtttcttctgaagcctgtctccttgtcttgtagatgctgtcttctcatgtcttcatatggtcttccctctttgtctgtgtccaaattccctctttatataaaagacactagtcatgttggattaggctccactctaacaacttcatttaaacttaattacttctgtaaagaccctgtttccaaatacagtcacattctgaagagctatgggttagaacttcaacttaccaatttgggggacagataacttagtacataacagcatcatactggataaatttgattgaattttagttatatttctgtgtcaccctctgaagactaaactttgtgtatattatttatataaatattttagttgtttaaaatatttttttattaaagggtataaagagagctgaagaacattaccctattattcataacagattttccatattaattatatagatacaataaggtgattgacatctctggacccaaattcactttctgtaaaataaagtggttgaacaatatgtactttaaatttttgttcaaatctgaattcctaaagcatgattatagtaaaaacaatctgcagaaatacatgcagactataaacgggaaggaaaaggaatacttttgttagtctttgtgagtaaaatatttatttaaaaatggactccccacccagaaaacaaagcaaaacaaaaaacctaaatatttttggaccgaccattataactgcaatgttattaatggatttactgcattcaggaaggaaaaagagacatttcaacttttactccagtactagaataagaactgacattatcctctgacatatcaacaaagaaacctagatgttcgttttgagcgttccaaacaaataatccaaataatccaattattttggattactttgctgaagtggtaatgaagtgtgaggtgcgtttcatttgtaggagggcttcaatttaattataccaattccactgagttttgctggtctctcataacaccctgaaacacttccatgaaatgaaaagagtacattttaaaaggcataaaaagaaagtactcgttgatgctacatttaattaatccctagaacacatcacattttgtgtcagaaaatgaagttctatacatgattcaccaagttccaaagttatagctcaggtatttgactgaaatagaaatacttttcatcttgggccattataaaaattaagaaaaaagataaataaaataaaatgaaagtaccattggaagaatcacaaatggaaggaaaaggccaaagcctttcagtcttataatatattataaagacctatagttgtatttattttgaaaaagtaatcacttagaccttactgctcttaagaaaggtggctatgtcctctaattgggacgtgattatgtcatttggcttgatgttattttgttgtccaggaaaagtaaaacaagtatgttttcttgagtaaaagctcttgtcttataaatacattggtttgctgcctttaatagagacttgatttactttaatgtggtaagtgaaaggagagaaagaaatggaacaagcaaaggcactccaaattattttcacattctattatgatattatcaataaaaccattattttctttctttttcattgttttctttttagtatttgtagcatcaaaatatctaactattttgtgtttgtttctccttcatccaagtaatttattttatatatttactttcatttttttctgagacagggtctcactctgtggctaggctgaagtgtagtggcactattatagttgattgcaatcttgaactcctgagttcaagtgatcctcccgcctcagcctcctgagtagctaggacaacagttgcatgccaccgtgcttatttatttatttaaaaaaaagtttttagagatgatctcactatgttttcagggtagtctcaaactcctgaattcaagtgatcctcccaaaatgctgaaattacaggtgccactgcacctggccccaactgacccattagtccacccattaaagtatattctagggaactctttttctcaaccttgctatcaaattttgtaaaagttatttttgttgatgaataattgttatattgatataattattgtgtgattcttttaagttctgttctagaaatgtctttattctgtcatttttacaaagacaagaagaatgtttccaagaaataagagcagtttataaaatccctcagtcattggatcaggaattagagaagggaaatgaaaggtttcctcccagttggctaaatgggctgaattgggaaagcgggagggtcaggtttagaggactctcaattattccttcttggatttccgacaagaaaccttgggctggtgggaacacatctgagctactaataggagctgaagttcccaccaactgtagattgatgaacagaaatatggggccatctatatctctttccagagccaaatgtagctccccactgaggattgaggaccttggcaagcaattgtcaacctgtccaggtaaaatattaattacctactaatgaagaaaaacaaacaattctgcaataattttttctctgatactcagattttaggagagtatatacattgtttcataaaatgttttatgtgaagggctaaaaccatttaagaaaatgccttttatgtaatgccgcttattgtcaggtcaatccttactttttatttccattataaaaacaaaacatgctcttcccttgactgagcctgtttcctagaaatgcagatctactaccacacaatctgtagagtagcttttcagtagtaatgcgtcctgtagctcatacattccattctttctatacataattgggttatgtgatttccccattttaagatagcaatatctgttttcacttcatcattgcttcatgaattttggctactgttttttttgatatttttatttataacacattctgaatctttgatttttttttctattggtttgtagatgaaatgtgttcaatatttaaagattatgtgtagtctattttggttaaaatgctgttttaaagttacacatagacactcaaatatcactaattaattcgttaaagtgcttagagttactagagggttagcaactataccagtagttagaagcctagtttcagtgttcttcatggttggtatgaaagaccacaagtgttttcttctgtgaaatgacatttttaaaatacgcaaatcataacacttcatccacacccttttttagcaacgaaagtgaatttatcggttgcaaataagaacaggaaaatacaactgtttgtgattgcaaatcctggggaagatttttagcattttaaataacaattaagtttaagagatccctctgatacatagaaactgaaagctgaagcagaaaatgtctgtcttcctgaacacatgagatctaaatccattttgatggcttaagagtatcattgtcctcttatgtctcattggttcaagcccaactgctccttgctccactaagtatagtgatgaatggtcctccctccaactgacagtaaaagaattctccatgctgtgagaattccatttagtaccattgattgcaggctatggtattaaaagtaactcatgttagtgttttgtgatagaatctttaatcatttttaataacaaggaaaccttcattacatggatttacttcttaaagtggaaatgattttggcctgatgtgatgaaagacagggcttgagtttttacttgttcccattccaacagttcttaatttttcttcatctcaacagttggaatttgcagaattcttctatgagaatgcatgttacctctatgtctaatttccatttgtttctatttcctgtggtacttacttctcctttgccttttattaggatatttgtccaagttttatactccttaagcatgaaagaatgtacaaagagtgtatgtgggaacttaaagtctaaaattcctaccttaaaatacttttttaaaggttgtcatctctagttgccagttcaccaatatcagggcagaagacggcatcttcgtaagacttaaatttgcaataatatctagtaatgagtagaaattcttctcttttgtattaagcaggggcaagccagaggctcaactcgatacctgaaggtggtacagcaataatgtaatgcataatcagtgattttatttcttgtttgttgcttttagttatgggagtaggtttttcctttgaaccaaattcttttgagtggtcccattcaggccaatgattctggcctaatcacacatgattaggtgtgatgaagaatgtagtcagatgtcagaaaaaagatgtttttctcatcgcaaatttaggaagtccatatggggatcagtaatttaacacatattgaaaacctcatattaaacatatgtagtgggagatttaaagataactatagttgggcatcctgtccttgaagagctcatgatttaatggggagagcaacattgtcatatcatgattacatttatgttttaaacagtgtgcagtgtgatgaaatttttggatgcatggggcccaattagcctaggtgcaagatgatattaacttggtctaaaggggttttagtggaaggagcaaagaagcatacgtatttgaaagatttagaggaggataaactgcagcagagagaaagaaggagcttctggtaacttagttggcaaaccagaagagtgttttgaactgaattccaaaagtaaagagcttcaggcagcagggagttaaccacagtgtggaaggctactgaaaagtgaagtcaggtgaatttaatatgcatggataaaggaaaaagagaaagtaacaatattgtatagtcttatggagagggaactttgagtttctggggcaatgagttgttcagtggcttaaaaaataaatctgtgactctggtaataaaaagttataacatggccgggtgcagtgactcacacctgtaatcccagcactttgggaggccaaggtgggtggatcacccgaggaggtcaggagtttgagaccagccttatcaacatggtgaaaccccatctctagttaaaatacaaaattaactgggtgtattggcacactcctgtaatccaagctactcaggaggctgaggcaggacaattgcttgaacccaggaggcagaggttgcagagagccgagatcgtgccattgcactccagcctgggtgggcgacaagagcaaaaagtcataacacatgtatgtagggatggatccatgtaaaattccagaattggatcaacgagccagtaacagtgatggcattcactgccacaaaaggaaacaggtggccagaagaatttgaaatatcattcaaggttgttagtatgtctattttcctttaaaacaaaaatgatgaaactgctatacttgttaacctgctctgcaatgccactgagggaagccactgcttgcttgttctatacctttgcttccctttaaataccatgaacacgacactgaacagaaaacacactctagaataaccatgtggtaaattagttatgggagtaagtttttcctttgaacagaattcttttgagtggtccctattctggccaatgattctggcctaatcacacatgaaaaatctatgctcaaaagcatagattttttttattttaaaaagttttgtaagtctgtggagtacaagtgtaattttgttacatgcgtagattacatagtggtgaatcaggccttttagggtatctatcaccaaaatagcatatgttgtacccattaagtaatttctcatcattcacgctcccctaagcacagaaatttattacaaatttccatggaggctttaaaattttaattacaatgtgactttgaagatctccagaaaatttaaaaaataatttctgtttcagccaatgtcataaaaatttattgacatttgatgcttatagtctgtttgcaatatgttagccatcaaggcagcaaatatttctttgatatgcatctagctttggtggttaatgtttgcactcttttgacattagtccatgtgactgattatttttgtaacttaaaagccaattccctaaaaatggtggtagatgggctaataaatagagactgcagagaggaaaatttagactgcagggagaatttgcaaatgattaaggtagcctgaacaaagactaagccacttccattagcatcttactgcttggtgaggatcaagcagagacttagaatagccacttgaagatgcagtcataggggcgtatagaattagatggaatagcaaatactgaattagatgagatcgaagattgcttttgactctataatgcttccatgatgatcttataagaagggctggaagaatagctgcctcaaataatttgtaagctgtaacatatcctattacctcctcacaaatggatgtcttagagactgagaacttactcaacttccatcaaaaaagaattaataacctctgaaggtactttctccaggaaaacatgttgggcagtgggagtgcatgactgattgctgctaatgtgattttggtttatgcttggtttaagaatcaaaaacttctgtacaatgtgtttcagatttccgaggcattatttaattgaagaacaggtagttcagaaaaggtttacttacttttttgatggggacatctaccatttgtaggttcttctgtctttttatttgtgtagattctactggagataaaaagtgggaacataattcaacatggatttatttcctgatccagaggtcaaagaacagaaatggatgaccaaatcagttatgactttttcacaaagggaaaagctgctagaaagcagctcagaaatgctccaatgccaagctgtgctatagcatcagaaccatgtacagttgcagaggaatttgatttccttgcattcatttactcatttgttcaaaaacatttattgtaagcaacatggaccaggcattgttctagctgctggagctgcaaagaggaggaagagattcatagtgtgaattcatagcctttcacactgtgaattcacactataaattcatattttaataaaactctatttataaaacgagccagttcaaatgaattctattagattagttagaaacaaattttattatatctagattatgatcaggtagaattgcttgaaagaagttaaggcaattcattattactattaaatcagggctaaagggtgaaaggcagacagagttatgcttttctgtctcataaaagaaaaacaactctatatgagtagcaaatgcctggttgaattacaattatttataaaaatcaatgtttctacatagtgcgtgttacaaggggcaagccttacactgaactaagaaatgttaatgaaaacaggatatttataaggtacaaaatgtagaatgattacataactttaaggatcttgtctcaacatgagttaagatttatattcataatatctttaaaaagtaaaaaaaaacttgcaaacattcaccatccctacttgcattattgtccaaaagactgtggatagcgacattccactgaatcttgtatccctactgatgttgacggatgcccattctgctaaggtttcctgtctactaagtgctaattagagctgcaactctggcttcagctatgatattattatctaggactgaataaacaatataaggcttatggaaattgcagaagcgctagggcgataataatagtaacaacaactattattatttttgaccacttattatttgccaggaaggtgctaactgccttatatatgtctcatttagtgctcactacatttctattatcagtcccattttcagatcacaaaatggtttaaagaaggtaactttagcgttctgaccatttagattggaactaaattttttgaccatacgtcttgctttatccacttgctatcatgtcttaatattaacggatatcactcctatataattcatgtttccagtgacagaatgagttaatggagtccgtggtttaaaagtgaccctggagaaccaaaacgctcagcccatccactttatccataaagagattaggcctgggtgggagattggatgagaggcgtctcttatcagtccgagaggaatagtgtatactaaagaaattgatcaaaaggaggaagacgtttgagggcactagggaggaatacgactctgatggattgaaattctacatgggaacaattgaaaaagaagctattggcaacatctacaggagagcagagaatagcaagattaagtgtaaattgaatagcagtgagtgttcagggagttgtcttaatggaaagtcagtctacctcccttccaacatctcagggtaaaaggtgtgtataacatggataagggaagctgtggcatggaggttactggaaacccatctgagtgattcaacaagtgctcttattatggttcttgagaaagtgttcatgggagacatttgggaattaagtccagagccacgaacttccattctgcataaggatctcaatcacagtgttgcagagaattggggtagtgacctaaacctgtcggcttagtgagaaggcgacaggtttaggtcactaccccaataggaaagggaattcacagactgctaaatcccttctagggagtttgagatgttccatggaagccgggtttagaacccctgatccagagcctaatcagtatggcagtatcttgtggcagatgttggcaggaaggcaaatttatttttacccaggatgtttgtctcttctttgctctactaacttcccagacaaaatttaaatttagcaaactaatggcagtgctattccccagactccaaagaacagctttgtcatcctctaccttcagtcagccattaatgggacactaatatattttgacataaaggtatgaaattgaattacttggctttcatttaatctctatgcacttcccccgactcccccatgttctagctgtctgttttcatgtttttagttggccttttaaaatactaggtgggagagcacccagaagtgtaaaatgtcatgccaccagccaagctagacaatctccccccagaggtagcccagcaccttgtcagaaatgtttagggaggttccttcatgtgctctaaacattttccaatatctggcagaagcagcaaatgctgttgattattaggtagaaccttatctaggagaacgattttcagaataattattataatgataatagctaaaatctattgagcactgacaatgtgccaggcatttttctaagcatatcacatgtattggctcatttaattctcttaatatgcctatgaggtggatactgatatcatctccactttacctatgaggaaaatgaagcatagagtttcctgattaactaggaactggaagaactttacttcaaatccaggcaatctgacttggagcctgagctcctcaccactttgctgtgttgcctcccatacctgctgtttacaccagggttgcaaatgattcgagaaggtttaccattattgaccctggggtctaatgccctagaatttgctgatgagtctcaactgggacatcttttgataggagtttaaaaaagaaaacagataccccgcccagaagactaggtttaagtaagctgctgctagtgggaaagtggaaactgttgtaggttgttgggaaaagatgggagctaagagcaagagagcaaaagtgtaggaaagtggatgggagaaagtgttaagcggtggttagagtctgatttcttctgtcttgcttagctgatcattctggagatgaactgagatcatatgtgaattcatttgggatctataaagtttgattcaaataatagtgtcttttatgccatggtgtgccccctggaagttagggtggagtagtgggtggccagaggttcaggagacaacagtgcatgggttggaatcagagggcatagatgagaacctgggaggacatggcacagggagcagccactttatgggttttgagaaaggtgatacacactggtaagccccaaattggggagctccaggaaggggagtccaggaactggtcagcagtcattctccaaatctcatttcccatttgcaactactgcccaatcgaggtcttagtcctgatacctccagcccagtagagaagactgaagcccactgccattagatttactatgatctcaaataattgcttaggtagagttcattcaacctctgcccctcctcaacttctcctattagggtctgataggccactacattctatggttccagcttcccttttatctgctgtgtgtgcaggaaaatattttctaattacagtctttgcagatcagttgagtgaacttggaaataaagggattatcagacccctttaatttggggataaaaatctaatgtgaacaccatgtggtcactctgttaattgcgtaaattttttcctccctacttgcatctaattcctaacactctttgctataggccttatttttattcttgtcctgcattattgtttatttacatatggacgtgcttttaaaataactatattaattccttaaaaattatacttgatataaaataatgcccaggtttcaccacacagagataacaacttgcaacagcttgttggacgtgtctccatgcacttctcttgcatgtgcaaactcctgaagtccacaatttatatgaaggagcttatgccatatataattattcatgacttttcttcacttcacagcatgttgtagccacacttccctctaaatgaataaagacctacacattcatttgtactctctgcccagtgttctctggtttacttaaccaccccgcctgatgattgtttattgataaagaaagaaatctgagcagcacacagagatcatcagactctgccaatccagactttatagttttgccgtcaaatccatgggattcttggtatttatccattgacaagagagtctgaactcctcagaggagcagagaaagaacatgaaactgatgagtgaagggtccaaggctttgcgtttagcactgctacttagtggctatgtgaccttaaaatcacttcacctttctgaacttcagtttccctacctgtaaatgatattgtgagttttcagtatattcaaggtctgttctactaactgaaggtctgtatctataaatatactgtcaagctgtatctccaatcacaacttaaatgcttcggctttatttgtccatacctttttgatgtccagcactatggtaatacaaagtaaatacccaacaaacacaatttgagtgatggatcggtatagctgttgaatctgtcttttcaaatttcccccagaaatatccatctctgtagttttatactgatttttttaagccagtgaacctcagacatttttacctgcctaccatctctctttagaatttgtgcatgtatatctacacttttaaatagccacagtttaaatctctctctctgtctgtgtgtgtgtgagagagagagagagagaaagagagagagaatgcaccatgtgtgagtgtgcacatatgtatctatagtttgatatgtatgtgctattttgggtgagtaaagtgggattccatatggagggagttactatactttgcactaaaatgaggctttagacaacagaatgagattatttttttactccctcttccagagttttactgaaattaaatgggtgtgtgtctgtgtctctgtgtgtgtgagtttgaagtgaaggtagagaggggtgtcctaatattgtagacacagtattcccttctttcatgtattctttcttatctttcctgttttccttctttccctccctcattctctcccttcctctctccctccgtctttctctttctttttttctttatttctgtttccttctttccttccttttcctcctttacaggaacaaattaaagaataatgccattctttctactttagtcaatgacgttagtcagtggtgacttttgtcaccatttaatataaaaaaaaagagaagcctctgtatgagaaaattctctcaaccaatgaaatcccagtataaggtcgtattgaaagacaagtaggtattttgttatattaatatattgaagaaatgtattgacccatcgtggtggtgatgaaaaccaaattattccactcaactaatgcccaagattaaaccactttcaaaatatcgcttaagaaaatcaaggagtcgagttacagacatttggggagtgaatagatgttcagaaagtttggtgctgcaccattttattgcttaatatgtgtctggagtcagtatgcattgaattctttcaaaatgagttacgcacttcattctcttcctaaagaaaggacactgtacatatttaaacatttttcttcattttggaatgctcagagccaccattacaagcagtgtttattgcaatatgctttgactgagaggtgctgtcaaaagaggctattgagctgtgtagagctacttcggtctcaaccctgtggcttctggactcttggtctgctttttaaagatagtttttccatctctctgagggtcaggctgcccctgaccatgtcttactgtgatgtgcatatctgcctgtggttcttaaagctccactccacctcccactatttcagatttgctgaatctaatttattatgtaacaagcacatgatcttattaaatgttttaaaaaatcaatagaaaatacgatataaaagtgggctccaaaggctctttttgcatatttctatattcttatgtaaattccagaaacttttggtttctggagaagtgttctccagatcactgttcaattctgataaggaacccacctttctggtttgaatgtgaactcttccttctaaacatgaagagacaatattgcccttattccttcaggtgcatggctaccaattccgctctctcatttgtatctgaccactcggttcttgttttgcagtccccagtctgtcccagatcgtctgaggatccgggtgaacaaaatcagtttacaagactatgaaggattccactatgacaaggagaaactccgagaagcttgtaagttggaagtgcctcattgatttcatgcgatcagcctatcttcagcttcttgatcctccttggtttgatgggtagattcatttatccttgtgcctgaaaatcatggttagagaagtgaagtgaaacacagtaacatgtgggctccaagtgataatgtatgggctacagaaaaaggaactggaaaaggaaagcagctgaataaaatcattctgctgtggatgccaagtcaggatctcttggcttattcgccactttagtctcagatttgcctaaaatgaggaaagcaaaaagttcgtgataccaatggtatagcaccatccagaaaactcttgagacaacacagatctcttcttggaggctgcgttatcaaacactgccctcattcgtcacagagatgtggcaaagaggcacattcagcacttctagatattatgctattatataatgtcagagaagggcctacgggaatgttgtgatattaaagtgattcattgatgatgaggtgccattatttttgaaacctgcacttgagtcgacgtatgaattacttctcaaagtttgtattttctgtatgcttctttgaatacatagctaattgttagttcatctcactagtcaatcagtatgtattggacactttttacaatctggtacattctgatcactgcattaaatctgtctgtataataatttatgaggtaattggttaaaataagccagaagttaagaccatgagagtgttagatattagggttctcggctccttcctaattgtgggggccaatagtcaactgcaataaagtcaaagaagataaggaaaactggtgtccaagggaataggcaatgatgctgatataaagaaatgacttttatatggaaccaaagacttacgaacccagtccccaaatggtctctaagtgtagacctggctacctgtgtaaaagaggaaaatagttagaactggcaggattaatagtaggaaagccttcctgggatggtcttttctgagctctggtttctgagactgatctgaagtaagctttagtggatggaaattctgaggtccaaggataatcccaggggtgggtacagagggttctacaatctggagttgccacgaggtgaggagccatatccctggtagcctaatcactgaatctactagagaatttgctgtgaattttctttcttaattctctcagctgcttcagcttcctaaaccctttatgttgttttccttagacatcaatatcttttaatttctccccagccttctcacttccatactttaccctcatttccttttataggaaagtgtgagctggaggaggagcaattccccaaacctctgaatttcttccttctgtaaacaacatattacattttctaatctaagtgaacttataagcgacagactagcatataatctgtttgatccataaagtgttagacatatatttttgcgatgggaagtgtagctacaatgcaaattaaattgagttctaaaggttactaatcataaagaacagtgttttatgttctttcttgtttgaagcttccaaacaaatagctaacagttcttaaaagaagataacagatctcaaataatattttgcagcttacgatcaactctgaagaaattcaatttggagtggggacacatttgaaatttttagctgaaatgagatttgaagcttatttatagctttcaattatctgttttatcttttctgtggcattatctgtctaccattcctggaggtaattgtggtttgaggttttccaacaagatgacattttctggcaagggctttactcagcatatgtgataaaatttctatgtgaagaaacttcttaagtcaaatatggcataaatgtaagccaaataaattgaacagtgtctttgggaccccaaagaacacatatactctctaaaaggggataaaggagttattctaaagatgtaaaaattcattccaatgatttggatttgaagaaaacaataaaagaattggaattaaaagtgaccaactcaatcattctacttttaatatgcggtgatggtgcttctaactgtggtttttcaggaaagtttatcctttgaggttctggattcactcctactaacctttactcttttgcctggttccaacttgaaacagaatacagattcatgggaaggctgacagggctcaaactgagtataaagacaaaagcaagcttaagtccatatatgaggtgcatgccaaaataaatgttatttcagaagcattaattaagtgaaatttgcacaacacatctagataaaagggactctaggaatgtactctgacctgcatcccagaacaaagagagtgaatcctcttaggtcattcatttattgtcatcaatgactgacctagagcagtagcatggtactgcgtttgaagttagttccatttcttgatggtgtgccaagtgatatcttcaggcagcatgtggttcttttccatcactgtttagcagaatcttgctcattgttcccgttagataacaagctcgcatgtttgtcacctaacaaagcccatcttccgtccataatgcagggctccctgacaataatggatggcagccctttaaattgctttgcttattttagcacagagaaagaggactatactctttcagatatttcccattcctcttccacttagccccatctcactggggggcaatccttctaaaataatatcccggaaaaatttagtccttgtcaatctttccctcagctcttgctggtaaatttcagacttatgtaagacactaaaagtcttcctcactccataggatttatcaaccctcagataatagttgtggtttgcaagaggggacagtctattcaacttaagaggtagaacataaagagaaagtggccatattaaaaaaattaaagcaaatctgtaataatgatatcagaaaatcactctcataaacagaagtatacaagtgggtccttaataaagcttataatcatataatctaggcaaaggatgatctgtttttaaaaatctgttgtatttctaaccccagaagagattcactgacacatgatatattttttaaaaatctgagataacttgatattcccccaaatttaactctgttcccatgcaaactggttaaacttcagtttgagcaccagtttattctgcacttttaaattgccatgataatttacacagatctagggtttaaaacacaagcagtagaaaccagcttgaagccaattgaaaacagatgtagtctataaggatagggaattaacatttgttgtatatcaaatacagtgtttgacaatgcttttacatacatgatctcagtataattcagtattatctggatgtttataacatgtaatgcataatatatcaataaatagggtaaaatcctagtatcgttagtgttaaccaaactaggtatttagttaagcatttgccctaatggaatttccttgtttggtgatttagtagaaaagtcagaaattttggtgtttgaatctcagttgaaaccttgacaaagtcatttaatttctctgatgatcaaatctctcatctgtaaaatgaaaatataattataaccccattcagtgctgagggttaaatgtaatgctgtatatggaacccttggtgtgaagtctggcacattagtgtgctctccaaaaatggtagctatgatgcttgtggtggttgttgttagagaggccctgctgtcatactgctcatcagtcttcaagtccataaaaccagactcaaagtaggtcatagaggctgacttcctctatgtagaactcttcctggcttgaggcagctcacttcaaactgcacacaccaccaccctccaactcactttcttactttcaaaaatagaattgaaaatactggtaaatatcacagaaagattatgggaagaaagtgtaactaaatcattcaatttacttttattgtgtctacttgtgtaaacatctgctgtaatgacaagatacttaaatctatgaagcatgtaaatactgaatgcccatataggatgatctgaacgtttacctgcaaatttccttccttaagtcctaatacattctcttaagtgtgtcatctgttatccaccactgaattttttgcaacaaatttttattttggaataattttagatttacaaaaaagttacaaaggtaatacagggcattcctgtgcattcctcccccagtttttctcattgttaaacactttacattaccatggtgcgtttgtcaaggaaactgatattgctacattactattaactaaacctttggaatttctatcccaggatcaaatctaggataccatattgcattgagttgtcatagctccctagtctcttctgatctgtaaccgtttctcagcgttctttctttttttatctttctttctttctctctctttctctctctttctccctccctcccgccctctctctctccctctttctttccttctttctttctttctctttctttctttctttctttctttctttctttctttctttctttctttctttctttctttttcttttctttctttctttctttctttttcttttctttctttctttctttctttttcttttcttttctttacttttcttttcttttctttttcttatgaccttgatggttttgggggaatactgcttcctgtagaatatcttccaatctggctttgtctgttgttttactcataattacactggatttatgggtttttagaaagaatactgtagaggtgaagtaggctttttgccccatcatgtcaagacttatgtgatatacacatgacatccctggtgatgttaacctgatcatttggtaaaggtggtatttgccaagttccttcaccatagacttacaattttttccccttccctactctattctttaggaataagtcactaagtctaacccactttcaaaatgatcagaggaggtggatcaagattttttaaattgtttccagtttgcatatttgagctcaactgaatttgttaactatgccaaaatggtagagccattcaaccattcatgcattcatactttcaataattacatgtttgcatcagttatatgtcagataccacactagatgttagtcattgaaagatgaaactagaaaatccaacattataacataatttattcagtgtacctttattgagtccttaccgtgagcaggggttggaagaaaaaaaaacaacagaattcgttcctgattttctggagctttttttctttttttaaaaaatgtgataataactgtgatggggctatggaaacattctgtacctatttttctagcaaacgtcatttaaataatgaaagaaagataaaatatataagcaagaatgagaaaatccagtctaaccactaattaagtgtgtgaccttgggcgatgcatttgtcttcttcaggcttctgtttccttatctgttaaatgcagtagttaaactagacatttcttaagaacagattataatataataaatgtttagttttatagaaattacacaggattaaaaaatttttcatcagcatatttccttagtagagtttttaaagctccaacatcattcataatgagtataagcattagaaaccatgtaagtacattgtgcttcaagagtttgctaaaaacactgattttttttccctatcaatagcttcatctaaaattgaatctttccccctcatttaacaagttgacaacagggctgttcagtagagattaggcctccatttggtggaggtaggctttccaagttgaaatctgtctgaggagttaaatgatgtcaatttgtcctctgaagggcattgtccttcctttttgcaagtgtgtttatgtttattcctattttcacgatttgacatttacccagagtttcgtgcttagtttcttttactgtcttttcccatctcttgtctgtctcttatatttatcattttattaaaaatataataataataatggttaacacacatcgtactattgctgtgagctaggaaatgccttttttacatatattgtgtaatttaactcacccgacatctcagtgtgatagatagtactgttattcccatttcacatataaagcaattgaggcacagaaaactcagacagtctaaggggctgacattttgaatacttatttaatcactgtgttttctgcttcctccaagtagtacttcctatttttcatataaatgtctttaataacataagtaaaaatttacatgtcagtctttcacaattccatttcaaatgtcttcttacatttaaactgactttgacttagtttatcacactcaggtttgttggacaagtttctgtttttggatcttcctccaacctcaaatcagccattcataaattcaacaaatattaattgactgcttaccttatttctagtactatttcaagtatttctagtactatttcaagatacagaaaagtgcttgccctggaacttatgttccagtggagagacagacaattgaataaataatacaatatggcagcaagtgctataaaggaaagtaaagcagaacagtgacagaggatcctgtttttgataaggtggtcagcaagagactttctgaagaagtgacatttaaagagagaccagaacaaaaagagtgcatgtatatgtggatttctagaagagtatccctgggcagaggaaatggcaagttccaaggccaagcatccttagtatatttaatgaatgtcagggatgtccatgtgactggaacctgcttagttgaatggagatagtcaggaagttcttttaaagggtcagcacatggagggggcttataggccatggagaaggctttggattttattcaaagtgtaatgagaaggtgttggaactacttgaggagtgtatcatgcctgaatttattctagataaatttggctactaggtagaacattttcaggttgcaatgatggaaatagggcagcaggtaccaggctaatgtgatactccaggtgacaggcaataggaatgagagagttaaagtagtagagttggagagaatcagttggattctggctacattttggaggtaatgctggtaggatgagatgatggattcgctgtattgcataagagtgtaaaattcagttgcctctgatgttttgaccttggcaacttggtaaatagaggtagggaagatgcagaggattcagcaaaggagaccaagaaggagcaataccaaggaggagcctatggttagctacaaaaacagcaggagagcttgttcattggaatcagagagaaaaataactcataaaagctgtctagctgtcagcgtttcagagaagttgagtaagatgcacactaagaattggtagttggattggagtagagggtagttagtggtagcctcacgagattgtggagtgaaaaatgtgaaagtgcatagagaggattcgtgtgcaaatagggtcaagtgaatgtcagatgtgagctgcataatgacatcttgatcaatgatggactgcatatacaacagtggtcccataagattttattttattttattttttttaattcttcagctaaaaccgcggaagaggtgatttattatatggttgttacactcggccacaaataaacacagaaatagtccagaatgtcacaggtccagggcagaggaccaacatgggcattttgttcatgagcaaggtgggtctcagaggtgatcggcgatcagagggcgatgaagttctagatccattgagacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcgcagaggtttccaaaaaaatggcgctaaggccgagagcaagattttaataccatagttttactgcaccttttctatgtttaggtattttagatacccaaatgccattgtgttacaattgcctgcagtattcagtacagtaacatgctgtacaggtttgtagcctaggagctacaggctataccgtatagcctaggtgtgtagtaggtgattccacctaggtttgtgttaagtacactctatgatgttcacacaatgaagaaatcacctaacgacatgtttcttaaaacacatccctttcattaaatgacatatgactataattcaccacagattgctcttttaaggtatttaactataaaactaaggaaagaaatgggatgatgactataaaagaatatagtagaatcaaaggaggattcttttttttaatttgtaagataatacagcaagtgtgtatgctggtgggaccaattcactagagagagaacttgattcagaagagggccaaatgcaggagcagtgccttcgagtaggtggtaagatggaacctggtgagcaatagaaggttgtgggcaggaatgtggggcaggttctcccgagtacagccagagaaggcagaggagggagtacagatacagatagcttggtgtacttggtgctagggagaaacagaagttctattctgattgcttttattttctcaggaaaagaagaagcaagcttactagttgaaagttggaaatggatagtatcagtgttctggaaaaaaagaggaaggtttgaaatagcttgaggagagagacagtgacagggttcggcagaattgctgacctttactttggaaatggatgattgaattcattgtttttttgtaagcacatagagcctgacttgccggtttctggctgtcttggtttatagatgagcctactctatgtctttctaatttcaaaggactctgatacccggggaatattgggccaaaatatgatcttattattaatataaacttttttgccatctaattctgtttatgacctaaaggctttctttctttataagaaaataaaatatgctctggtgctgtgctatattagaagttaataatgttagatttcagacaaagaactgggcctaaaatgatgatgatatttgatccttccttcactgttaaaacttagcctttggcaatgagagcaatcaattgcaggtagatccttaagtctctgcccaaaataatattttctcttttcattggtttattttatgtaacacatactcaaaattatggccaactcttactatttatagaccagcctagtccatttggttgctgtcttaccaggttgacaactctggaatgtaagctcagatggtagttagacttccctttgaagactttcttctaagatctttgtataaaattattactttcattcatcttgctaaggtttgagtagtgcagtgttggccattgcagagtcacaactatcctgtttaataataaataataacatccaatcattgcatagggcttcatggtttacagagggctgttgtatacactggccacatgcatcattacaaggacacttaagattgccttgcacagggttacattgctgtggtgggattttaataagaaattatatattttctctcttaatccagggcactttctagtatacagcctacttctttataaagacaaatttaaaagaatttgcggtcataggtcttgtcatcatttgagtttctggggaaacagactgtgagactgagttttgtgtacaagggttttattgaggatttcccaagacggaaccacagctgtgcagggcaagaaaagtgggaccaggaagagggagatgttgaactttgctgtagtcacaactgaggactcccacagggacctttggacctgggacagccattttgagttttctaaattgaggcaagggttattggacacagatcaggctctgccctggaaggggataaaccttgagtgaggtagcagcctttctggagaaggactcagctgtgcgctatcagcaaacttttagcctctgggaaaatgagtgcctcaatcctaacatgaatgcattgcttcagttccgaaagcagagtcttgctatgtattaataacctgatttttgaactaaggccaagaaagagccacccacataccaaaatccttgagttcattcattcaactcttcatttaacaacgatctattgaacacctactatgtatcaaagactgttctaagtgctggaaattcagcttcagtgagtgctagctctgaagtgtttctcttgttatatcttttaacctgatttccctgctatgccaaattcagggaattggagtacaagttgattattcagaagtgtctgaattagcaaagtaaaatggaaacctaaaaggtgaatgctgacctttccttaaaagttctttctgatgaattattgccaagccaaatattctccatttggaatttgagtaattaaaagtggaaacctgaatataaagccacctcaatttctggctgtcacttctagtctgacgctatagtcagcagagaaaacttcagagtttgattctcaatgggatgtgtattttttatatattcatttcttccttcactgttaaaatgtagcctttgctaataagagcaattcattgattgaactaaacagaatcaagggcggaagtgtaagctaatctgaaaataacatctttgcagattgactcagaaccacaattttatgcactagttacgtggataaaaacttcaggctttccctagttcacactggtggaaaacagtctttctcagtaccgagtgggtttcctgaatcactggtccactgccagtctcctggagtcatctgtaagcagaattagagatgtccccaggctgtcagctgctagggatgtctttgtttgagactgccctatttcacatctcctcatagaagctgtccatgtataatttgtttattcattttatttcccaaaagaggcttggggccccttcagctgattttagaaaatttttctgtcatgaattcttcacatgtatctaatcaactcagaaattccaggctgcatgactgaatgtgtccccagcatctagttgttggtgaccttgaccatcaccctgcagtgtaacagacagcatgatgtagaaattgtgaaagagatttggaccagtgtatctaatcatcatttcaagtattgaagttttaggtatggttgtgaatctttcctttcagacatgtaatatttcatcttgattttcagatgtatctggctagcctggccatgtagccaagattccagtgtcacagtcaagcctttgttatctccctcccaagtacttgagcactggtagtaaatatcagtagtggttctttctgtgtctaagaattttacgaatattcatttccattgtcaagggcatgctaggacctcacagttaaaagcttatatcacatttaacaccaggaataattgccaaaagattatatacatcatcttgttgtactagtactttattgcatgcaacattaggaaccttctttgaaatggaattatcttcatcaaaagtaggcatttacatcattgtcattaaacttacatattcagttggacaaggatgacatgtcatagcactatttggtctggacctttggttcctactatgtattagaagagaagtatgtgggccttctgcccatacttgctcctggataaccacggtcaatgcgtgaaccgcagtcatcagaagtaggaaaaaggccattacgaacagcatccatgattggatctcatgctccacctgacaacttttgtctttgttcagaagaccaggctttaacatctcctttttttttctccctgggattttctttctcatttctgcttttccatttatcatgtcatgaatgccaaagatttggaaagagaaaaagaaaaggatctgttactaactcctgaggggttgtgggctgggcttcgatgggcacctggagagtgtagtgttccctttcattctctttcttctgttctttcttctccagccttcagaattttctttccccaattctgtctataacacattctaactcagaaaccattttcttgtattttaggtgttatcaaactgcctttgaggcattgacaagtggtctttgtcctccatcatcacagttttcactaattttacattattttcacagtctctctgctgccgccttctttgctcttttttgctctctccagctcagcaggccacaagtccatggtgttaggtaagtgtatcagaaggttgtaacccccacagctatgcaaaacgacttcactgtcactcttgctccttttccctcttcccatccaactggccacagaggagttgcttccttggacttcgtatctctctcatatgcccttcccttcttgtctttctgccactcctctattccagacctcaccattgctcagctcattgactgtattcgcttcctcactcatcctccagtcactcacctaatttttcatcaatttgtcttccgtattactcccaatgatttttctaacattttgtccaagaaaaaggtgggagatttttaggcactgagatgagcgagtggaaaagtactggaggatgttgtggggaggttggtcaattgccaacccattgtatctgattattgtcatccatcaagtaagaattgtagttttttgataaccttggcacatttgaaactaacagaataaaaggaaagattccacttgtgtttacatcctcccttaggaatttgtttcttttctctactcccctgcctctcctccttgagttccttatttccaccatccttttgacttcctgagtaatgtgaatgctatgagtaacaaaataggtactgataattgttctatgtcaggatgatctcatcagcaaagtatctgtccatagcaaactcagaacagtttctttttcttttccctttctcttgatttttctgtaactaggcatctgtgtttgctaattgtctcttattaccaataattatttaggctcttacccacccacagagcctgagagagaggggctctgtctttcatgatgtttacatttcaaaaaatgacttctagctcctggagaaagacattcctgggttgtaaaatttggcatgagtctgggagcagatttacatacatctcaaaggggcagagaaaggatttacaatggaaagtttgctaaagtaaatgctctaagaaacaagtgttcagagccatataatcaagaagaaacctgtcggccgggcatggtggctcaagcctgtaatcccagcactttgggaggccgaggtggacagatcacgaggtcaggagatcaagaccatcctggctaacacggtgaaaccctgtctctactaaaaatacaaaaaattagctggacatggtggtgggtgcctgtagtcccagctacgcaggaggctgaggcaggagaaaggagtaaccgggaaggcagagcttgcagtgagccaagattgtgccactgcactccagcctgggcaacagagtgagactccgtctcaaaaaaaaaaaaaaaaaaaaaaaaaagaaacctgtctaaagttccatcatgctaagggaaacatgaaggctgttttggtcagtatacatctggaaccttcaccttctgttggaaacctattagtatctacccatccttttgagaataaagtctcaacttcttagtataaaaatcaaacctctggtcttagcctcaccctactctactctgtacctacctaccttcctaattcctgaacatttccttttcttcttttcatgctgtggttccttagagcctaagggtggtctgagataatttccttttgtctcaaaaactcttgttccttttgtcaaaccaccttattttcttcacagctcctcgtggaagagtgtctggtcttggggaatgtgtagcccttctggattctaaacacgtggagtacatgtctatccaattcctgccacaaagatatcatcagtaggatgttttcatgtactcccctcctcctccaattctgtaaactccttgagggcaggtaccatgtcttactcagccttctgtgaccaactgctgacactagagttgtccccagcaccagaaagtccttaaaacccgtttgctaaaatgattaagtgaatgacttatagacgtgaaaaatattgtggcataattctttgtatatgcaatatatatttaccaaattaatgaagatagaaaccatgagttgctcttcaagattatcaatgccataagcatttaagaggattttttttaagtgagttgcatgttccttatgttgcccacttaggtagtatactatcatgataaaagcagaattggatctgtacttggaaacccaaatttctagagaacctgttagtttctggaaagcactcagaaatcttatccttgaatagaatccaatgaaaactacataatttacttttatcttgtggatgacatttttaatggactatagacaggacctggtttagctcaagctagggaatccaaactctataattacttttaatcgtaaggactaggagttgtgaaactgctgacaggtcccagacatggcatggcaaggtataaagttcttgggatgttatgtttccttttgaatgctaatatgcccattcgttgctccccattggttccaggtgagcagtgggaaattaatgatgaccaggtggttgtaaaatggacctgtgacccacagcagggaaaaactggattgaaataccatattgcaaactgattctatctaattcttatcagccatcaagtaagaattgtagttccatgataaccttggcacatttggaactaatgaggtaaaaagaaagatcccacttgtctttacatcctcccatattatatttcctatagacaaagtatctgtctgtagaaaactcagaacagtttctttttcttttctttttctcttgatttttctgtttctttttaactaagactatttttcagagcagttttaagtttacagaaaaagtaagtagaaagtacagagaattccatatatcctctcaaccctcccctaccgcaacctatccacacacagttctcccctttattaacattttgcattaatgtggttcatttgttactattgatgagccaatactgatacgttattattgcctgaatcccatagtgtacgttaggattcactcttttgccatataattctatgggctttcacaaatgtgtaatgacatgcagtcattattgtattgtacagaatatttcacaaggaataccttgtgttatgtcttttcatttctcccttcctctcccaagcccttggcaaccactgattattttattgtcagcatagtttttgccctttccagaatttcacataattggaattatacatcatgtagcctttcaaattgccatctttcacttagcaatcttcatttaaaatacccctatgtcttgtctttgctttatagctcgtttctttttattgttgaataatactccgttgtctgggcataccacaatttatctgttcacctaccaaaggacatattagttgcttacaagttttggcaattatgaataaaggtgctataaacatccctgtgcagatatttatgtggacataattttcaactccattgggtaaataccaaggagctgatgctagattgcatggtaagagtatatttagttttgtgagaaactgccaagctgtctttcaacgtggctgtgctgttttctatttccaccagcaatgaatgaatgttcctattgctccacatccccaccagcatttggtggtggtggttttttttaattttagccattctattaggtgtgtagtggtatctttgttgtttaatttgcaattctctgatgacagaaaatgttgagcatcttttgatgactgtatttgctgcctatattttctttttgtcagattttgtttagatcttttgcccagttttttaattggctctcttattgttgggttttaagaattctatgtattttttgggtaccagtcttttttttttttttttgcatctcttatggattctttgttgtaggctcctagatgtggattgcagagttacagaacatttaggaatactagtacctactgtcaaagtgcacaaatttacactctgaaacaattgatttcatggcacccttgccagcattgaacattattttttaatcttattttaaaagaagtgaatattctaatttgcttttatttactaagctttccccctgtattcactcacaatttgtatctagggtaattctcctgtttcaagacagaatgaattagatatgacatgaaccaactacaacagcataaatgagatggtttctctgagtattttccattgctcagatctgattattgatctggtgagccttgctgagacaaaggttgagcttctcaatgcacgttctctccaagaggtaggagagtatcataaggagaaggcatcattatgtccatgtgggacaaccagcttccttctgtcctgtggcctcagtcttttcttttcttttcttttttcagaaatttgtgcaaaatttaagatcagttttctttttgttttttcttctatccctcccccatccccccacccccagaaaggccccagtgtgggatgttccccccctttgtctatgtgttctcaatgttcagctcccacctatgagtgagaacatgcggtgtttggttttctgtccttgtgatagtttgcttagaatgatgggataccagtcttttatcagatacgtgttttgcaaagattttcacccagtctgtggctaatttttcattttcttaacactctcttttcacagagtggaagttttgattttaacgaagtctgacttaaccatttttttctttcatggatcatgcttttggtgttgtatctaaaatgtcattgccataccaagcttatctagcttttctcctatgttatttctatgttattttctagggaatgggttttttttaaaaggctattggtttcttaatactatgcataggttgattaaatgataccaagtacttgcataaactctattgattatgttagtaaatctaaaattgatgcttaaggaaatgtcaagtttttaaaatgtgtatatacatagtgttaacaagcttattctaagatgactatattttgatggtttaccatattgttcaatacctttcctattttctgactttttaattctgtgattatatttattgttcttttcagaaggtgataaccttttttaaaaagcctccacaattcatatatatatttaaaacttaaagcccagtctttgcaaacacagtggtttctgagaagcttttctctaaggtatcacacgttcttataatgatcctattgaagatagtttgtttgtgctttgaataggtcaatggcttcatatggctgcaattctattttaacagtaattgcactgtaacagcaatgtcacataattaaatctttttaaaaaaatgctgagctctcagctctttatttccacaatgacatcttgttgaacacatcatggtaccttgcagagaacgaattaactgctgtgagttttctccctttttataaatcccattatcactttcacatggacttagtgtgaaaggtggctctttctgctttggctcttagggccttggcttgtgtcatcaagcaggcagctgtgattcccctcatctccttgtaggtttggttgattcttttatttacatgctttagtttagactctagagactttggcacaacacattatctgctataaaatgttctcacatatagtctgctgaaattggtttgggaatttatgaaagggcagtacatgttgataatagaattaagggtaaaaatgatgaattaaataaggcttagaggagtgaatataggatggtttttataggtaggacttaatcttcacagtaacccagtggggtagataatatgatctttctcagtacattgggcctttacatactatattgtaaaagaaccaaggggaagctaagctcattgagcaataaaaataatcaaaagtatctggaatcgtaattttcctgaatgtagttattgaccaaggataattaaacattaaaatgaatggtatgagaatatgtactatagcaaaactaccaaattgataatatcacaggctagccagactgaaaactaatactgttaagtaaacacaacatcaaaaatccttgggaaacacctttgaatagcttgtgcctctgatgtcatgaacttttcacacctcaagtgagaacgtgggttttgttttatgtttggtttgtgttaactgtcattgaggtcttcagttcagtattggaaattctgttgtaagaattttaatagcaaaacaagtcacagtgattttctgtaataatcttgattaaattctaggtactcttgttatctctattgtcccaataataattagcatctgctcacaattgtatagttgcatttctttgtaaagtaagcaatacttactttaattctgtgacccctaaattacagacaaggttatatagcaaggctgtcagcagttttgataagcttgagtcatggtctataagttcacctgaatctggcctatcggaaaaggagaggaatggggagcctttaaaaatgaccacatttctgccaagtatgttcacgagaatgtgtctgacttcactggtagtttctgagtctgatggttctggtcctttgtccaggcctggagatgtttcctccctgtttacagcctttccctagtgcttgtgaagctctacatatgggactcgtgagtccatcctcagctgctggtcagcctgtcactggtttgtgccttcacttctctgagctcagtgttgaaaactagtagaaactccatccttatgtgcagcccaagttcaatggaaagtaggaatagttcagaacaggggctcttgagtaagagaaacctaggatgaaagctggtgttccgttttagtggttgtaatatttagggcatgttatctatctgagactcattttcctcattttaaaaatagaaataatgacatccatctctcaggattgtggcaaagattaaataacacagtaaaactggtatattatttatgtgaacgtaggttattttttctccttcctccttgccctcccttcccctttctcctcctctccttccttgttcttcctcctcctccatcctcctctctttttcctccattttctcttccttctcctcctttttcatatcatgtaatcagtattatcattttcatgttcatccatatttgttccacccctccctaaatttatcatatgacacaatgctatgcaacatgacacacaattatgtatctttaatatcacatggatttgatcatactcccagatcgcaggcaatggaagtctgttctggcttatctggcttttccagaagtgtggagtatgattcactcacgtaagaaaataaattacttcagctactctgatccttctctcaatgctacttccttgaacccccaggcttaggccctgtattagtccgttttcacactgctgtcaaagacatacctgagactggggaatttacaaaggaaagaggtttaatggagaaccaacagttccacatggctggaaagcctcacaatcatgggggaaggcaagggggagcaagtcacatcttatgtgaatggcgacaggctaagagagggcttgtgcaggcaaactcccatttttaaaaccatcagatcttgtgagacccattcactatcatgagaacagcatgggaaagacctgcccccatgattcattcatctcccaccaggtccctcccacaacatgtgggaattatgggagctacaagatgagatttgggtggggtcacagagccaaaccatatcaggctccaagcagctgtgcccaggaaaagtgatcctagctcaattcagcatctgggagctcatgtagttggcatgtgtgttaacctcagagttccatctgttgtgaattttcattggcctctacgcaattcagcacaaagatgctgtgctaaaggttgtgccagaatgaaatttgctttagacatccctgggtagggcagtttaacctcagagtcggtctacaagggtcttttggctttcttcaacaaataattcacttgaggaaattatttgactgtcttttgcatcataccaactgaatcaagttttcttaaaactctacactgttgatgggaatgtaaattagtatggccaccatggacaacataatggagcctcctcaaaaaaactaaagatagattaaccatatgatccaggagtcccactgctgggtatgtgtaggtacaaaagaaaggaatcagtatatggaagagatatttgaatgcctgagtttattacagcagtattcataatagtcaagatgcagaagcaacctaagtgtctatcaatggatgaatggataaagacaatgtggtatatatacacaatagattattgttatgccataaaaagaataaaattctgtcgtttgcagcaacatggatggaactggaggacaggatgttaagtgaaataatccagacacagaaagacaaatagggcatattctgtctcatatctaggggctaaaaaagtcagtctcctgaaggtagagagtagaatagtgattaccagagacttggaagcgtaggggtaaggggaagtgaagagagtttggtcaatgggtgtgcaaatacaggtagatagaataaataacctttatggttctatagcacaggtgatagtagttaataataatttattgtatatttcaaaatactaggaagagaagattgagactgcttctaacataaagaagtgataaatgcttgaggtgatagattgcttaattaccctggtttgatcattatacattgtatacacatatcaaaatatcacatgtaccccataaacgtgtaaaattattatgtatcaataaaaaattaacttaagaaacaactctaggcacctttcattgtaacctttaacaacattggtttataaagctttgggcaattcagtctcatatatagggtccctgagcttgatttattatctggctgtttacaatttgtggtgaaatctatgttttataaattatattttgttatgttttatcttggtgtatatagactttaaaagttttttatgaatataagagtataattgtggattggttgctagaagattttgaatttgctgaggttgaatagttttcatttatgcattatttggcataaatttgcataataagttcaagtagtctaacttcaagtatagaagacaaaattaattagtgtgacctgtgggcattttacttcaaacgtaaaatccagagcatgcacacgtaaaatgtataatggatttctcaaccaattaatttaatcacagtctggattatgagacatttaaaccaacaggaaatagggaaagagggttaatggaggtcaggttgaagccatagaagggtgctagggcaggacttatattttggctggaaaggggtaatttgtagtataattttctcagggcttaatatcaccagtaaattccacagtgtagttcctattacctgaatttgtcaaagcttcctcgttgttttagtctgctctggctgccgtaacaaaatactatacattggatggcttaaataacagacatttatttctaaaagatctggaggcaggaagtccaagctcaggatgccggcatggttgggtctggtgtgggctctctttcttgcttacagacggctgccttcttgctatatcctcaaatttgtgtgtgttagtccaggttctctagagaaatagaaccaactggatatgtagatatgtaacaggacatctattatgggaattggctcatgcaattatagtggccaagaagtcccacaggataccatctgaaagttggaggaccaggaaagccagtggtgtaaatcagtgcaagcccaaagacctgagaaccaggggagctggtggtatatcttccagtctgagagcctgataactggagtgcaggagtgggtatcactggtgtaagtcctggaaagagaaccaggagccatgatgtcaaagggcaggagaagatggatgtccaaactcaagaagaaagaattcacttttattccacctttttgttctatccaggccccaagcagattggatgacacgatgacacttgcccacattgacaagggtgggtcttctttactcactccactgatacaaatgctaatctcttctggaaacactctcacagacacagccagaaattgtgttttaccagctatctgagtgtcccttagccaagtcaagttgacacataaaattaatcatcacagtgcgtatatacaatacagaggtttaaatattagtagtaaaataggcaccggtgtacctgccacttagactaagaaatagaacaagtaccacccctcactgttctactgggataactactttactcgttgtatttgccattctcttgataggtatatatttaccaccaacgtatgcatccctaaaccagatattgagtggttttgaaaaaactaagtagcagatctaaatccccctgtgtaaagaaaaggtgatgctttcacttttagcttaagtttcccaagaaagctgaaaagagtctctagttcattgttgagcttcagtttttctgagagtgcacacggactcattctaagagaacttagtgggcaaggtaatgactgactcctgggcagtccttggcaggtgttaagttgagttctagctatcaaatgaatatattatcacagggaataggcttctttgaatttttctgcttcactatgatccaactcttgctgtcaggaataggttcaggcagagcatgtcagggggtaatatagtgtcaatatattttatataacactcattcgtattgcaaattcaactttattggggcagataacccagtagcttcttgacagatcatgggtccttcattcaactcttgcacttgtttgattgtttgggttatctgtaaaagtcttagaactttgaaggtcttgtttcattgtcttccttactgtatggttgcctttgagaagttcaaaaacattccaaattttaatcctttgtatataatctggtttttcctttctataagcttgtagattcttccttttgtccccagtactcttcaatttcaaaacaagatgatgttatattgttctgtagttattgtgcttggcatttgatgaatcatttcagtttggaaactaatgttttaggaaatattcttcattttgttttttatatttattctctattttcttttgttttttgagactcgtattatggggatgttttttgaaactcctcttattgggacctcctggactaggtttctaatttttttagtttttctctcctactttctatctctttttatttttgctctacttttttagagattttctcaactttatcttttaacttttctaatgaggtctctatttattttatcaaatttttattttcaaagggttttgtactcttttattctctgaatgaggttcctctttgttttccttcatattctttgtatcatttaatattataatttttccatttcttggaaatttccattccattttctctcaactccctgaggatattaaagatatcatgtttaaagtgtttttctttgcgcaagttcattttctatttttaaaaaaacttttagattcaggggtatatgtgcaggtttattatacaggtaaattttgtgtcacaggtgtttagtgtgcagattatttcaccacctaagtagtaagcatagtaccagataggcaattttttgattgtcacgttccttctctctaccatcaaggaggccctggtgtctagtgttcccttctttgtgtccatgggtacacaaaggtggggaatatttgtgtcctacttataagtgagaatatgtgatacttattaaatcgatttctgttcctgaattagttcgctgagggtaatggcctccagctccatccatgttgctgcaaaggacatgatcgcatttttttttaatggctatgtagtattgcatggtgtatatgtcccacattttctttatcctctctacccttgatgggcatttagattgattccatgtctttgctattgtgactagtgctacagtgaacatacacgtgcatgtgtctttatgttagagtgatttatgttcctttaggtatatacccaatagtgagattgctgggtcaagtgctaattctgtttgagttcttagagtaattgccaaactgctttccacaatggctgcaataatttacattcccattagcagtgtataagcactccgttttctccacaacctcatcagcatctgtcatgttttgactttttaataatagcgatttgactggtgtgagatggcatctcattgtggttttgacttgcatttctctaatgatcagtgatgttgaacttttttttctatgattgattgccggatatatgtcttcttttgaaatatgtctgttcatgtcttttgcccactttttttttttttgtaaatttgtttaagttctttataggtgctggatattacacgtttgtcagatgcattatttgcaaatattttcttccattctgtaggttgtctgtttattctgttgatagtttctcttgctgtgcagaagctcttcagtttaattaggtcttatttgtcagtttttgttgtttttgttgttgttgcaatggcatttggtatctttgtcatgaaaactttgccaagtcttatgtccagaatgatatttcctaggttatcattcagggtttttataggtctaggttttacatttaagtctttaatccatattgagatgatttttgtatatagtataagggaggggtcagtttcagtctctgcatatgactagtcggttattccagcaccatttattgaatagggagtcctcttcccattacttgtttttatcgactttgttgaagatcatatggttgtaggtgtgtggcactatttctgcactctctattctgtttgatttgtctgtgtctgtttttgtaccagtatcatgttgttttggttactgtagccttgtagtatagttttgagtattgtgatgcctccagctttttttttattattattatttccttggctatttgggatttttttggttcatatgatttttaaaatagtttgttctaattctgtgaagaatatcattggtagtttgataggaacagcattgagtctgtaaattgctttgggaggtatggccattttggtgatattgattcttcctatccatgagcatggaatgtttttctatttgtttgtgtcatctctaatttctttgagcagtgttttgtaattgtcattatagagatctttcatctccctggttagctgtattcctaggtattttattttgtttgtggctattgtgaataggattgtgttttttattttgttctcagtttggatgttgttggtgtataggaatgctactgattttttgtacatttattttgtatcctgaaactttactgaagttgtttatcagaaaaaggagattttgggcagagactctagggttctttatgtatagaatcttattgtctgcaaacagatagtttgatttcctctcttcctatttgggtgccttttatttctttctcttgcctgattgctgtggctacaacttccagtactatgttgaatagaagtggtgagagtgagcatctttgtcttgttctgatttttaaggggaatgcttccagattttacccattcagtatgatgttggcttatgggtttatcatagatgactcttattattttgaagcatgttccttcagtgcttagtttgttgagggtttttaacatgaagggatgttgaattttgtcaaaagccctttctacatctgttgagatgatcatgtagttttggtctttagttctatttatatgatgtatcacatttattgattcgtgtatgttgaaccaccttgcatcgcagggataaagcctacttgaccatggtagattagctttctgatgtgttgctggatttggtttgctagtattttgctgaggatttttgcatttatgttaaagaaggattttttttttttttttttttttttttgtctctgccaggttttggtatcaggatggtgctggcctcaccgagtgagttaggaatgagcctctcctcctcagagttttctttctttttttttttttgttaaatagtttcagtaggaatcataccagctcttccttatacatctgctagaatttggctgtgaatttgtctagccctgggctttttctggttggtaggctttttattactgattctgttttggaactcattattggactattcaaggacttaatttcttcccggttcaatcttgggaggatgtgtatttccagaaatttaccaactttttcctgtttttctagcttgtgtgcagagaggtattcatagtagtctttaagggtgttttatatttctgtggggtcagaagtgtcacttctgattgtgtttatttggatcttctctctgtttttctaccattatgtaatgttgttctttgtcttttttgatctgtgatggtttaaagtctattttgtctgaaattatggtagcaacccctgcttttttctgttttctatctgcttggtagatgttttgtgtgtcatcgcatgtgacctgggtctcttgaagacagcataccattgggtcttgtgtcattatctaacttgccattctgtgcctttgaaatggggcatttaacacatttacattcaaagttagcattaatatgtgtggatttgatcctgtcattgtgttgttagctcattactgtgcagatttgtttgtgtgattgctttatagtatcactggtctgggtatttaggcatgtttttgtagtggccagtaatgacctttcctttccatatttagcactcccttcaggacctcttataaggcgggtctggtggtaatgaattctcttagcatttgcttctctgaaaaggatcttatttctcctttgcttttgaagtgtagtttggctaaatatagaattcttggtttgaaattcttttctttaagaatgctgaatataggcccctaatctcttctgtcttgtagggtttctgttctaaggtcagctgttagcctgatggggtttcctttgtaggtgacctgccccttctttctagcttccttaaactttcttcctttcattttttccttggagaatctgatgactgtgtgtcttggtgatgatcttcttgtgtaatatttcacagggtttctcttcatttcctgaatttgaacgttggcctctctaccaaggttggggaaattttcatggatggtgtcctgaaatgtgttttccaagttgcttgctttctctttttctctttcagggatgctgataagtcatagacttggtctctttaaataatcccatatttctcagacattttgttcattcttcttcatttttttttgcttcatatttgtctgagttattctggaggactggtcttcatgctctgagattcctcagctggtcaattctgctgttaataacttgcagttgtattctgaaattcttgagttttttagctctagcatctcaatttagttatttcttaaaatggtcatttcatctttcatctgctgtatcattttattgtattctttagaatttttggattgggtgttaactttctcctgaatctcgatgatcttcattcctgtccatattctgattctatttctgtcatttcagctatttcagactggttaagaaccattgctggggaactagtgcagtcatttggaggtaagaagactctctggctttttgagttgccagagttctcgcgctggttctttttcatctttgtgggctgattttccttcagtctttgaagttgctatcttttagatgtttttttggtttttgtttgctttcattttctttggtgttgttgggtgtttgattatggtataaggtgggtttggtcaactggcttcatttctggaatattttagggggccaatgctcagctcaacactcctgagctgtgtgctttaactctggtgggctcattttgggccccctgctttcatctctggctcctcagggttaggaacctgttgccttgatgggcagtgacagccaaagagcttcactgggtggtggaagtaagatctgtgctcatttgtacatgccagaagcaacagcagtgtgatgacatgcatgctcatcagctggagtggggccctggtgagccaggggcttccagcctccatacaggcatttgcaagtggcagtaatagtgggtgcgatggggcactggcgggtgtggggctggtggtctccatgtgtgcattcacactggaggcaatggcaacatagggcagggagtggggctactgatcttcatttgagtactggtgctaacagtggtggtacagctgggtggatgggggcaggttgcgctcatgctggcagcagtggcacagtgggtcgtagatacgtcccagcagggaagggtaggcaaggtctgctggcacacacacactggcaaaatggtatgggggtggccttggatgagtgcatgccagcaaagtggtacagaggatgctgcagtggtgggagggtgcgggtgggctgatgtgccttggcagaggccactgggctggagctatttgattgtcaggcacagtcagccagcgcaggagctattatgcatgtccctgggagacaccccagttaggcatctgcggctgcactgcaagcaggagatgccagcatacaggggtcactcaggtcagactggccctgctctgttcaggtctgacagtttgcctaaggctaaagtttcctaggggagcatgggacgccttggggatgggtatccctggtcatgcttcactgtggacattgctgcaccaaaccctctgggctccacactggctggagccctgcccttaccacctctctaagcaactatcccttccagcttaagtttctgtgggggtcttgtggtctcctcctgccaggattctataagtccatggtgagagtatgtcattccttccctgctcaactcaccactaccccaggggttactgagggccaggaactgatgaatggtagcccctgcagggtttccagcttcctcccccttaaacccagcatctgtgtcctttctctagccattctcaataccttccttctgaagatctgcttagagtgtgccagtcttcctgatgtcctggtctctcgatggcagatgttccttctggctgtgtctgttcagctatcttgcctggaggatcctgtttattttgatctttggcttctgcattagaaaaatttctcaattttctgatcacttttgcctttctcttcattattaaaagtgggaaacataaaagctgcctggaagttctgagctcatgcataaagcttattgacttcaagcttcgatgtgggggaactgagtgaactgtttcttgggaatgatgaatcagtgctgtctttagacctatggaagaggtgcttcagctttcgatgtcctagatatgtcccatttctggctttgccctgcttcatgggatgatttgtctaaagtgctaaggaaaagggctcatctagggatttctctacccttttctagactgtgctttggattcttagaattcctgccccaacagctccagacctgcttctaggatctgcgtaggcctcttcttctggtctagtctcacaggagtcatgtagagtgggcataggactaaggaaggccctttggggcagcagtttgcatgggctttggagaaagtttggggatgtggtctgtagtatctgtatacataagcacaagttctttcatgttttgaacatccatggagtggaaagagaaggaggtctaactatggaccacaagcactatgttttgttctaatactccttggagtacaagaattatgagtttcagcatctcatttaggtaactacaaaggaatatttatcaggataggaagatagaacatatttcatttaacagttttggggattaacattaaacttataaatatctagaaatatggaatgcaggtctttatgttcttgccttgagccttataaatgttggtagtgggcctgttctcatgttaatatatttcctcatggttttgtcagattccattgagatgagttttccaatgtttttcctagaaagtaaggttctggctgccagcttttggggaattcagggtgggaagaaaactggggatcactgcagtcttcagatgatcaattaatcttcattttctgtaaggtaactgtgcctttccacaatgggtggtggatatctggtgatctaacatccagtgcttctatcttaaccacctcctttaacctcagctcctgaggcacccggtactgccagtttgcaagccttttgagggttttgcagtagaaattattttggttcatgtctatacccactagtggtttaggatttgactctctaagggctctgagtcagttgccaatttttcatctacttcatctgttattttatccttatttttgttgatttcttttaaaaatctatttattgtaggttagtagtatttctggtgagagattaatatgtgcatgaaatatgccatcttattctggaacacagcttgttcttttcacttagttagaacttgtgaattccatttaatccctgcaataaaagttccattgtgaaggttgagtattaactcatgcttcctggacttaaacaaagtctctgctaccaaaataagatgaattgttgagctcagggatagtgacactggtgctcaggtgataagtgctctcactactcctaagtaaaatagaggaaatgtcaaggaagcttggcagttggttaaccatagtgtagaaggaaggtggtaatttttgaaaagtttctgctttttcttcgccatgtaaaggcccaaatggaagtgtcagattacaatatttttctactacgttgtttttttacatggcaggaagagtagaagttagtttttagaaaactggcatataacttacgaaactactgctagctaatccttgtagtactatgctaaattaaaagatagatgattgggtatgtctgttttctggctaaagatgctcaaaagatagtgaaaagagtaagggagaataaaaattgatgttttgataatttatttttaaatatagtgttgtattgagtctttacaaaaatcctgtatgacatctattctaaacaccgtagtctttaaaccaaggctcagaagaattgactaagtagctaagttgagtaatttgcaagaccaaagcaatactgggatttaaacccagcagtggatgactgcaaatcctttctactgcatattgccaccttcttggaataaatttgacagttgttggtaatcgtgttataaaattgtggtagagaatgcccttttttctttcttttctcctcgcaattaacagctaagtattgctcaatcaaaagcagttactcttactttgctccttgaagaacaggcaaagttgttgattttatacccatattagagatgaatgacacatgtttgaaaacttctttttagctattcctcttgattccatatcttgaatatacaatctctaattgtagtttaaaatgtctgctatgaagtacattgaatttatacttggaccagactaactccaaacactgataatagaaggaaatcagaggtgttgatgggattcctgcgtatgtataaaatatatctcctaacttaagtaaatggataaacattgattaaaatctattttctatttttgcacatttaatattaaaaggaaatattaagcaagattccaatgtggatgcttatgttaattatagctatattccacttccagatttattatctatgtcaaaattccaacttttcctcatcattcctcaaatattagaaattctattctgctcttatcttggtggatcaacttatttccatctttatagtaggtctagctgaagatgattactctaatcactatttttaggagatctccttattgaatttcccttccatttcctgcaaagatgcatgattgccatgctgaaaactttttgatgtttctgtttatcttttaaaaggaggagaaatattcttttagaatgattattactcccccaaagatatgacagttacaagtgctccttatcctctactgactgtcttttgcttaccttgtttcttgtctaccctggacaggtgacttgcacctgaaagacagactttctcttttgcatccaaacagtcgttaagcccatcttcctccctctttttatactcatttattgaatatctaccatttctttactaggcattggggaagtgaaggtaaacaatccacactcactcacaggcttccatagttccacaaaatcatggatgccttaaagatttatgtatgcaggactttagaaacataagggaatggggtggtgggattgattaggtctccctagcagaaaccaatctaggaggtaacattgagatacaaactctatttctttttctctagaccacctttactcctctagctaaaacgtcaagtgaggcttcatgttcttcagagagcctaaaatctaccccttcacccaggcaagaattagcccctctttcctatagttttcaaatgactaagttaatacatttaatacggcctgtgttatacttatcatttttttgtttatatatatgccttctctactacgtggagattcttcaaggttttttatgcattttaaatcttcttctgtgtattatgaatttttaaggccctagtactttgtattttcagacagatttatggatgatggctttaaatatacactcaatgagtgaacgattgtaaaaaattcttagagaacaccactgtcttatcatttgcttgctacttaccagttggttaattcaaaattttgaaggttttatgttagatcatggatttaatcgtgtaattgtacttttaaaatgagaaatttgtagatttttttttaagttttggaaagaagactatttttcagtatttcaggactcttgtgattctatctgaagtaggttctatacactaaagccactgtgtgtgtttgacactacctaagtaggatattttataaggtgcataacttagtcttgtcttattgttttctgaggtcctactgttaccactcttacattggccatccttaaaattagttggattttttaagctttgcctcttctagaagctgttttttgttcttttctttctaacattttatgcctttagttctgatattggccaccaggtagcaacagtgccttgagtagctcaagtctcataaataggaaactgttgtagacagacaaaaagatgaagttgtctgcattcaggaaggaaggagtaagtgtccagaatcctcaatgtttaattcccccggcactgcatcctcatgttgtctattgcaaatgcaagcataaatttaggcataagcataaaaaatgcaagcataattatcaactgtccatgagcagcctccctgttctgccaatccatcgttactgcgacaattcacttcatctcagggccagtgaaacacaatgagatgaggggcaggtggcaaggggcaacatggatcatgctaggaaagtgtgtgacaactgcaaacaagaagagactgaaataataaaaaaggtgtagggagaaagtacttctttctttttacggacatatctaaaaaacccataatatttatgagattgttttttaaccacgagaaacacatttatgctgatatagaaaaatcaaatatgttattttagatttttcttcttccttcacccttagcgatacctctgggtattctagttgtgcgtggagactgtgatttggagacttgccgtatgtacatagaccgcctacaggaggtgagtttatttagccaattttttattctcctcaactttccatttttgtaaacaattaccagccatatatatttgcttctgaaatgatgcatttggagaggaagtggaaatgtggtggctttgtccttcaagcatacgctgtatgtcaccctctcccactgtctctgttgttcactcctcagatggttgaaatgggaaagcattgactacagggtgctgttgccctggtgtgttccataactatagcttggaacttgtcattttaccagacacatacctgtatatttgagatgttcagaatttcaacagggactgataaataatgaaagaaaacagtgatatttaatgttttgtgtctgacacttatgtcagagacagctagattttgtaaacaaaaaaataaataaaacttctatgggaaagaaaaatcctctacatctcataggaatttgtcagaacacaaaagaataatctatttttttttctcaatctagtcttgctttagagaaacagaaaggaagtgaccccgtatatggcactcccataaatgtgaactgcaccagcaaagccaggagacccaaactcatcattacaattgttgttggttgtttttgcaaaaatttgagggggagtcttaaccgtctccattccacaaattgcaaaaagcatatatgacgatttctttatcattttttttgatgaaagatgtatattagagtcacttttcttgggtgtggcctagacatttgtatttttaaagctgttgggttgtcttgataccccttgataagcaattctgtcccagacaacatgttatacataggtaaatattgtaaataaagtagacacatactgtttaaaatccctctgagttgtaaccacttcaccctgaatatttgattctgtttctcttggtagaaataaattcaggggagaggcacatagtgatgtgaaaaattactgattttgagaaatagatgacaaatattgaatactgatgtggatgagagaaagatggtcaacaaattttacacttacggcttcattaagctattttgactgaggatagctgcttaaacaagttaaaatacgtgaatttttagtgactcaggtccaattctgttaatatgttcccaaacttctagtatctcatttcccaaaataatgtttgtattttgctgtggaatctcactccagaaacctgtaatgaaaaaaatgaatcataattggtaccaaacctttttacctttttttaaaattaacacatgtagagctttgttaacaagacttcacagtagaataatattaatacacgattgatgaattgactttgttaaaaaccaacttaactaacttaatagcatgcttaatgcaccaatattcaactaaaagtaggatttttaaaaaagaggcaactcaacaaataaagaggaaaaatttttaaaactaatggaaagtaatgtgatgaaaccctgtgggaaacaggtgtaaggacaaaggtacccaggattgctgacatctgtgaatagaatcactacactcattagcaaggaagcctaggaggcatgacaatggtgacaagttcgttataaaactttatgaaaggagtcaggctttcacaatctgccagtaaaacctcattaatttcaaccctgttaatttgcactttgtgataatgtggaggtggttggtgattttctctttgtagtctatgaaaacccctatttgctaagcgacttatcagtataaacagttaccatgacagtatgtatctggtctgaggtaaagaaaagctttctaagtgtttaaagggatttccaaagccttcttcacaagccaaaagtttatatgcacattaaatataatccccatttatcagaacaaaattgcctgtcttttacttctggtctcctctataggagattgaaataataatataacacttactttaaacactatgtaggacttataggtttcaacagcttaatgaccttctctcagtccagcttggtttgattttattatttctggcattaccttctttatttaacctttatgaatttgggtgtgttcgatactttccagatgagcatagtaatattaaattgggagttcagttgagattgagttgtggggcagcttgttcaaactaattttaaggtatggattttttttttcattttctcattaggacctacagtcagtttcttctggctcccagagagttcattaccaggtaacaaataattgactctccttgtttcttaccttctggccaaatgaagtccatctttcaattaatgtcttattttgatttagagttcacatcttccctagggatagagttcattctaagaatctagtgaaaatggtattctgattcttttgcattttcctgattttggaccagcctagtctagcacaaatttagactgtggattttctcctagatcatttagaaaagattataaaattgagtgctttcagtaacaaataccagaaaactcagctgaaactagcttagcaaggaaagggtctcttggttcacataagcaaaaagtccagatcaaggtggatttctcatcccatttggtcatggctcacactccactttcctgctggtccttctactttgttctcctcttcctgtcaattttacctctgggctagatgactttgtggtccaagatgactgccattagcaaccaggactatgtttttttccatcatctcctgaaaaagagaattacatgcttcctacaaccatcaagcaacagttttaaaatgtaatctgagtggttcatcctgggtcttttggacaatctaataaacccagtctgcatctctctatggcccatataaagtctgtaggagaacactcagttattctttatcccagcagactttgggggtgcagtttctttccaacttccccatcccacttgtgatgcacagatctcttcagccatcctcttatgcattagatttctcagacatgatgtagatcctagtacacagtattactcccgactgcaaggagcccaaacaaagctctttgactggtctcattaaagcccttttatctgaaggctccttaccctgccctgttaagaggaaaggtatgtgggaatcacagcatgccaacaattctctccaaataaatctcttcaaacccttcatacttccatgtggggaggaatataactatgcctaaatttataaatgtgaaaatcctggtttagcacttcactttggatttttgtgtctattttcccatgcctgaaatttccaatttaacatcctttaacataaatagaaaacacaataatttaaagaaaaacctatatcttgtagccttctaggtattccccctaccaatgataccctctgtccttggctgaagcagcatatcttcagccttaatgacaggaatggcctttgtgttcttatttgtgtatttatttctcaaacaacgtatcccacacttccagagttctttcttccatctgtctggccttgaaaggaagaaaagtcacttaggatatgtttacattaaaaacaaaacaaaatgaacttcttctagactgtttttaccaaacactagaagacaaatttccaccaaattttttagatagagcacaactttcatcagagtgactatttgcatatttacccagagccactatcttggtgtaaattttattttaaaaagcatagtgctttcacaatagcaaagacatggaatcaacccaaatgcccatcaacgatagactggataaagaaagtgtggtacatatatactatggaatactatgcagccataaaaaggaatgagatcacgttctttgcactgacatggatggagccggaagccattatcctcagcaaacttatgcaagaacagacaaccaaacaccacatgttgtcacttacaagtggtagctaaacaatgagaacacatggacacagagaggggaacaacacacactagggcctgttgtaagggtgggaagaaggagagcattaggaataatagctaatacatgctggttttaatacctagggtatgggttgatgggtgcagcaaaccaccatggcacatgtttacctatgtaacaaacctgcatatcctgcacatgtacccaagaacttaaaataaaaattaaaataaaaaaagcatagtccttttaaaggtaagagctgatctctaacaattggcagtagtagttataagactatgaggatattgtctttaagagtttatactttttcctcttggacattttgaacctttaaaactttatcaaaatatgttagatttatcctagctaggtttatgaaactacttttatttattattcctggcttatacgatgtagtcatttttggtgtgagagttaaaattgtgggtattttgtaccatatttttttatgccctatctgtaactattcatggagatcaacggatggataagatactacaatatgagtgagttatgtattgcatgtattgtttggtaataacactcagaaggattaatgatatttttctatgtcaaaatattgctgcattattttgtttacttacagtcaagtcaaatcttggtgtcaaaactgctgcattataaatgccacatcaaaaggttttgtgtgctgaacatctaggataacgaatgcagtgatcagggatgagtgtcagaggtgtcaccttttcccatatccttccttaggacaaggaaggcgcaagaagagtgataaaaatcaggggactttgagcatgaaggaatggttggaacaaaaaagatccaagaagcccagaatttgctcattaaacaggaaagaaaaagagactgtgttagaactaacgtggccagagcacagggagaagctaatgaggaatttcctgagcagggcaaggagaactggttgaagcacgaagctgggagagataaactttcatgtttggccaagatcatcaaaggaggaatgagttggaggcataggaaatagagttctgtgttagccgtattagttttgatatgcctgttagatccaagggggttggtgagtaggcagttgggtatacgaatattaaacctcattaaaaaattcaggcccagagatagaaattttggagtcatcagcaaatggatgaatggtgcttaaaactacaaggccggaggagatcacttagggaggagttcagttaaagaggagggcccactgttctatctatgtttattcatgagtcaagaagagtgcaggttcaagacagcaactggtcaagaagaatcatggaaactgagataagcagcagggaagctggaaatcaaggagaaggtggtatcacgaaagccaagagtgaaatgtatttcagagaggaaggagtaatggacagtgtcaaatgccattgagaggctgaaaagatatggattgatttccgtatttttttctaggtgtgtgtattataaaacacatgggatataggtgctattaatttttatgtagaaagtgactggcaggaaatttaatactaaatcttttatttcttagtgcagaaactgattacatcagaattccctagtttgtcccggtgggagtaaggagtgttataggtgaaaaagaaacatgaacgacgaaatgccttaaatgcctgttaatgaagtttcttgtctatgagatgacattaaatatgcttggaggattaactgtgaagagaataaattaataccagtatgtttgaaaacttgagaaattcctgtcagctcactaatttgcagctagggttttagctgactgttttctaagaccagaaaaatctcaagagaaaagcagcatttagaaaggtgtacacgtgcccaagacaccttattagtgagccatgtggcagtttctcgccacttaagcatttcattgctttggtttcttccttttccaaatgcatagtgaattgccaacaaagcactgaagctcaaaaatgacacctcatgttaacctaacaaggtattatgggttatacaagaatgtgttagatatttatagcctgttgaaaattcctgcctacaccatctctgaggtcaaaattcaaaggcccctccatcctaatagcattgatgtaacctgtaactaatatgttttacaagcaaaatgcattgcacttgcagatttaggatattcttgaggttgccaaatgaacaagaattaacataagaattggactctacctgcttatttgataagggtcctttctgaggccacctactttgagataattccttctctgcttcctccctcgaaatcatgatatcccttcttaaccccaaatcacaaaggtactaaggaatagaggcagatgtgccattctagtgatttccagctgggaagaatttgctccctgtaggggacatttggcaaggtctgaagactttgaaatctgttggataaaggccaaggatgctgttaaacatcttagcgtgcacagagaagcctcctaccatgaagaattatccagccccaaatgtcaatagtgtagagcttgaggaaccctgagtcactctgacggttctcagtacataaatgagaaccccagataggtataagacctagatgaggaaatggaaaggagaaagagagaagaggaacaaaagaaaaggtagggatggagaacagaaggaggcatttatagatgtagtagggtagaataaagagagaactaggagcaattagaggggtttttttgtagacaccctgggtttccccatttccccagggtgattctttatggggcattaaatggtaggaattataacttgagattttagtgcataccataggattcacctgtagttgcaaaaatagattcaaccaggtgattactttctctaagaattaactcacttaaaaatagtaccagaatggttggaatatttaaaaatagagaaaacattattgaaaagccttttcattcttcagggtggtacagatgtctttcactttcataagaaaaaaaaaaacaacctcttggtcagatcggagtctacattacttgttcctcctctgatgtcctttgttcctacatgcctgctcttctggaggaccagcctatgttgtattccattaaaattgtgtctagttctaggcaaacagcattttcctataaatatttcattcatcccctttctctttattctggctgtccttattcatctctctcctttctctgaaatctcttcctcctccatttgttttctggagtctagaagagtccttcaatagatagagtgggacaaggtttagagagtcttcctgggaattgatttatcttgtgtgagagaggacagtaccagctagaaactttggagaatgccattcctttggactagattaaagctgtcagaaatgggtcaaatgaggaattaaataagacttgcctagggtcaggtctgttgtctcttacgagtgaagacagtactggagttgtcattattgctaatggagaactttctcacacaaagggactcttgaaaatgttagaatattgcttatttctatcttctaccccactgtcttcatcttcgaaatctgggttgaagaatggctatgccatttctgtattcctccactgtaggagtcatgagtggtaaagtaggttcgagatggaggggttttaagatattaaaataaatagtagcaaacctatttggggctgtagttagacagagacacatacatacctatttgtatgcaacattatgttaaaaaaatggatagatggcttgtatgtgggagatgttggggcagacagatgagaattttgaatgggtaatgagagaaatttaaaagtaaggtgattattgattggccattattaaatgaggcagggattcccaagccatagaacttttgttttgtttctgtttatgtcttttctcaattttatgaaagaaaaagaatttcattcacattgaaggcatagttcaacactaggtgaatattgcttaattggaaaacttactagtgtgtgatggggctgctgtgccttcattaaattatgtgtgcatcagctatgagcaattgcatgtaaattaagggtaactttggcatatgcatgccaaatagtggttcagatcattttctcatcaattttatataatttgtgccagttggctttcagaaatatatatatatatgaggaatgtcagttttgtgtttgtgcatgtgcctatatttttagcacaagaaacgtattttccattaatatatatcataagagaagattcacgtatcagggatttttgaaatgagcagtttttgctaatattattcatttaaagagcatgtaattttagaagattattatatttaaaatagaaaggagcatggtatatctaaggttatgtcatttggcctacattacagagcaatgacagttgcattcatctaaatcacaccatttatatgaagaaaagtcacagatccaaaatgggcaagtcaagtatcttatctctttgatgaatcattgatttgatcatgcaatttgagaggactggggagactagaggccctaaattaccattgaaagctttggatatgatggttagaggcacagctcagggaaatatagctgcattcatacaatcctattgcttcagtatctactgtcagatgcttttgaaagacgcatatttttaagattgtgttttttctctctattggaaaataggtcactgtacatttatttaatgtgcagcattcacaaatcaaacacactctgaccatttgtgttcttgtgtagtgatgagaacatcgccaggtccaacctagagcttccatgaagctaaggtctgtcctggaaccaatattcaccccctttccaggagccattagtttttcttacttcctatttccttccaagtctaattcacggtccacattgcactgcttttcacccttctgcagagactagaggatgcccctgaatcaaggaatccttaatgccagggctacccagtctaccagtcttccagaccctctgagaacagagaaggtgtttacctgatgtgagctgtgtggattagtaacgagagttactttaaacactaattagagaaaattcagtaatacctgtctattaacatcactatcactcacttacactccaattattattatttttttgaagtacaagagaaaggtgtatagatagacgtgatgcaggaattatttgtaccctgcgtacggaagaaacccattcatctgtgtggtcatggtaggttaagaatgtgcgagcataaaaagtttatggactatcgcggtaaattgtgaattcctgtctgatattctgcttctctttattcctgctccatttttaacccatacaatatgcatttctctctgatatcaaggtcctcatggtatatctcttgacttatataagctatgtgtgttctgcaatctgccaggttttataatcttggtttacctcagttttgatattgtacgtaattctagacttctgtttggtttttaactctccacccaatgtagacctttatggtgcgcatttttgttttcctacatttatacaaagttacgcacatagacatacatgaatacatatgtggggattgttgtttaaaaatacaaatgtagctgggcgcagtggctcatgcctgtgatctcagcactttgggaggccatcatgggcagatcgcttgagcccagcagtttgagaccagtctgggtaacatggtgaaaccccgtctgtacaaaaaaacaaccccaaaattagccgggcgctgtagcatgtgcctgtagtcccagctacttgggcagctgaggtgggaggattgtttgagtccaggaggcagaggatgcagtgagctgagattgcaccactgcactcccgcctgggtgacagggtgagaccctgtctcaaaaaaaaataaaaattacactaaaaataaaactgtgtttacaatttgcatgtgcacactatacatattataccacaatttatttttaacagtaatgtaccatggaaattcatcttgctaataggtgaaactctaattcagtctttaaaaattatcactctattccatggtatatatttaatgctgtttctatggatggcatttttaggttgtgtagtattgttgccaatgtttgcaaaattccaataaactttatggtacttcaaaaataaaatcataacagaaatgaaaaccatgcaacatgctaaaaacatattaagattggctatatttgtgtgaagattataagttacataatgcatacagcaaagttacccaaaatctgtaattggatttttcttcacatggttgtagtctcggttcctgtgtctgggttggggttgcctgccattcccattgattaccatatttctgtggaattcttaggcagcagggaacacagtggtgggaagtgggaagagagcaagactgaagaatgtgtgggggcaggaactctgagctaccaggagcaaactgtctggtaagaaacaggaagcttagtttgacatctgtgtaagatccttgactagagtagaatgagatcttcatagccatttagatcattctaggtttgctttcttcctgcttttgtttgagctgagtctagaaaattctgagctctcaaacttgatctataccaaacctcactcttccttcaaaacctgaaatcataattcctctagaagctgtaaaaccctgtgcataaggtcatgagctctgaagtaaaagaagtctgtactctccaccactgaatagcttggggcttctgggtagtttacttaaattctcaccactgcagttctttattgtggccagctcttacatgcaggagaagaggttcaggaagaatagtggggtggattgcaggagaggtaggtaggagctagattatgcagccttcttaataacaaaacgaaaaaagcctgcacatgcatagaagattatgggttaaaattaagctattattgagactgtagcctaatatttctaaattatctctatggcagtgtccaggtaaccctaaaactaagggagatgactatgtgagacttgaacactccaattgtgaattctgatagtaacatatatggctgagtgaaattttatcaagtataaattattcagtagatgaaataaaaaatggaatagtctaagctttatttaatctatagccaccattaatacagaagtagagccatgtttatgggaaattctcagaagcaaaaaatgagcacaccgtaaaaagaaaaaaaaaggaaaattaccatcaccaaaatgtggttcagtgattttttgacagcttgtccggattagtgtttcttatccttcactgccagacagtggagatgagtcagggcagaagctgtaggtggaagactaagagtagggaggaatgaacgagagccagagtcaagagctacctgttctacttgacatcgtgacagctggcctctatgtaacggggttggatgactcaggattgtatctgctggcacttcttggccgtacgtcagcaccaggactatttgaaaactactgctccagaacaaaggtttttagccccaaatttgagactttgaaaggaaagggctttcttaaatgtgaattgagccttccatttggtttgccaacaatgaatttattctgctgtcttctatttttttttttaattaccaagctctgattcttttggcagctggctcaaaatcctttttccaaaattggtggctgttggcagtagccaggaaataaattgaaatcgtaattaaaatagtcatccattgggaaaagaagttgaaacttggtaaatcagacttacagtaactccaagaattggagccagaaagaagcatgcagagcacctagactggttcctagtgtagtggccaccctttaacgacatggtccatgcttcgttttttgtgaccttccgtcacatgccttgcatttcattggctttaataaatacacattaaaaaggttgatcacagttgtatcacaggaaaaagaataatgtatagttttgtgacaactgacaaattagcaagtgacacgttaattttggtgaaactaaggaaatagcaagtaggcagttactattgaatggggaagggagacatcagtaaaataaaatgttccgaaatgtatgcttgttggtgatagaagacattcagccttgaagacaatatcctgtatttaagacaattatataacatctaatgttgtgaacagaggcactggattgctgattaagacaagccctataagcaccaaaccaacaaatggcatgatttcagcctttgtttaaagccactctgttttgtgttcactcatacaaatttgtcctatttctttgttttctccaaaactcagaatctgagtgcaaatgtatttatggataaatagtgttgtgttaggggtagcaccatctaaatgatctggtctgaaatgtggcctgtgtcccatgagaccctcatgtgactaagggcagaattgttttaggtaaaataatgtctcagctgcctaacatgagatataattatctctcgcataattatatctgcacataaacatgtttcggcaaatgggttaagcattttatgtgtcattaattcctcaaaagaaccctttatgatagatattattgtagccattttaaaatgaggtattcaaggaactggataagaaactatcctacactctcacagcgagtagcgggtagggcgccaggattgtcgtgcctctcaaagctggtgtgcttcccatcagccttccgccgcctctgggcttgctgcttaattggggctggatcccatacaatctctcgccttgtttttccatctcattcatcagatctgtctcccctacgatattttaacacctcaaggacaggaacattttttggcatctcaattcttagcttgtctgtgataatgatgatcacatcctacaacaatttcagttttgcgaagcagactttctcactatctttttgctctgtttttcaactcaagtgaaatccagcatccaccaccgccacctcaaccaccaccaacttttctgtccctagcctgctcttcacctcctattctgtcttggatctttgagatatattttcagcacccatttatgcttcgtacctggattttcttgtttcttgttttaccgattactggcatattttgtgggtgtattttgcatattgtcaatctgttatgttggaacatcattttaacattgacttcaaaaaaatctccaatttttagtgtcccgatgtaggtgaagcattttcatctgcttagatatgtacatggaatagattcaagggcaattttttttgagacttgatgcttttgtacattttatatatgtagaatttttaaataagtagtttagttgcattatgaatctgcccagatagtaattacagtttttcattggaattcaaatgacttttaacgtaggacctattatgtgagtagctgtttctttaagaactcacttcttcttaaaggaacaaggtggaaagagcttcacaaaagttggaagaggatgcaaatgtatttcagggaagcatttcacagaagttagaactctacttttgcttttctaacaactcccaaaattgaagtttaattgtcaggtcaccaggaaagtatccaattgttaaaatcagattcctgtgcctttaagtaatgatgtattgtttaacttcaattattaataccatacaatggtaaatataaatacattttttccctttgtttataaaaatgaacataagtagaagaacttaaggcactgaaaacaaacacttgggagagactatggatggaaataagcaaaaagttgagtctttccatgtaaaaattgacctagtttcagtctgctcctaggagaatagccacaagctcagagagcttttgttgtttgttgttttggtattacaattaccagtaactttgcattggtgattcctattctcataaggcattttactgatcagaatcttcttattttgttgaattctctgtgacataaatttttgattctttaaattaatagcttttttagcatcttggaaatctcagatcactttgataatctagaaagcagtggtttttctgtccaggaaaatgaacatacacatagacataccaaatctggcatacaattttggagagttcaagaattgttgaacctatttgaggacccattaaagtattttaaagagctttatggcgacccatgtgttttcaccaaacaaaattgtaatgttatctttagacgaaacctctttaagaacattgagttatatcagatgtttctgtagatcaaacatttttgcaatttccatctatggatcaaaatgtagagtaaataagtgaacaaaagcaaactacattaaaaaagtcaggcatgggcataaaactctccagacacacagccacctgcacataaaaagatatataccatctatatttccttaccaacctgtggtagtcatgttgctgaggcagtgcctcaatctagattttactaacctagactaaataacatccaattttctgtaattagaatagcctagagatagtgtgatggatccttaggtttttaaaacaataaatcaagcattcctgtattttttccattgatttttacatacagaaattaggattttttttattgtgtcctctgcagcatattcaacatcaaaatgcagaaagtgtccttgatgttttagcccctttattcatagagaagataatcctgtttctgtttaatctctttatttattagctttcatagttgccactaaatattttgaatcacttccaaatgtcttgatctataattacatttctcacccaactgagagacgtcagtagctttatctgtttttcaaaaatgcattaagtaccttaagttcctttaaaacaagttgtcacacatgtcaaaatataattctcaaaatgttacacataattctcatataaatagttactaagcacatgtcaagattttacttagctcaacaatcaggatgaaaatccagttcaaaaaagaggaaatatatacacgtgtatatataatatatatgtatatataacatataatatatacgtttatatatgtatatgtacatataatatgtatatgtatatatacatataataattataatatgtatatatacatataataattatatgtatatatacatataataattatatgtatatatacatataataattatatgtatatacacataaatatacacatacatataatattatatgtatatatacatataatattatgtgtatatatacatatattatatgtatatatacatatatatgtgtatgtatataatatttatatgtatatacatatatatgtgtatatataatatttatatgtatatacacatatatatgtgtatatatatttatatgtatatatacacatatatgtgtatatattatatataacataatatatatgtatgtatataacatatatacatatatagtgtgtatataatatatatgtatatatgtctgtatatacatatataatataatgtatatatacacatgtatataatatataatatatacatgtgtatatattatatatacatatatacatatagagagcaagagagagactatatgtaacatatattttttctgtatatattatatagtatctctgtatccatagctatatggatatatttataaatataaatgatatacatattttatatttataaatatagattttggtagcattcctgaatgagaccattttttcctctatcaattatttaattcacagaattcatttagagtaaaactccatacactccaggtttctagtttactaagatgcatccttttgttcggtaactttaggttctttcacatacatcctcagacctatctgaaaggcttgttaaaacacattgctgggttccacccatagtgcttctgtagacctgggatgggccctggaaatttgtgtttctgacaagtttctagctgatgcacactttgagaacaagtgatttaatcccaggctttatttgaggatcaagtagggcagcagggagtgttgattaactcccaggaaagtcagtacaacctctgattgggtccttattacttcttctatgttattcctgttttcttctcctgtcccctctgtacacacaagatcatccacacctgcggcttcagctgccaagtctttattgctgcctgcacagccgcaccccagtgctgctccctacatttgaacatttcaaatccctattaagggccagactcccagtgtcttccccacagagacctggcctccctcgtttgtcccatttctgtcagtgatttcaattccactgcaaaccagggctagaatgctccaaatcacatgttgtaaactagaaggtgctctcctccctccccagttatcactggcaggcttctcttagtagagaaaatgtttaatttttaaaagtttggaatcttaaagagaaaatcctttcagttttcaatctgccagttctctcttctgtttcgtggatgtagccttaattctttataagaaataaaagcttctgagacttcaaggaagtttgggaactgagaattgtagtaagtcagggaagcaagctagtcctggcaatctcttggaagggcagctttggaaggctgggaggtcagaggccaagcttctagaggtcatgtctgaggtgtgtaagtgagacttggagcaggagataataaacataagcttcaggagtttggaagggcaagaaaggagagtttaagaagattatcaaaagatatatcagcttcagtttcagctactcaggaggctgaggctggaggatcacctgagcccaggaaactgaggctatggtgagccatgatcacaccactgcactccagcctggaagacagcctggaagacagcctgtctcaaaaaataaaatataaatgaaataaaaattaaaaaaatagatgtaacaagatcagctgagggtaatttattttggaagagagggaactattgagagcagaagaattaatgagtggattttaataatgctacagaaataaagttcaaaggagaaagaaagatagtccagagtctaaattaagtgattgactttggagagaagagaactatttttatccgaacccagaggaaagaatgatggtagttatgtcaggcagacttgatgttaaataggagaggggaaattgggaggtcatagaaatgagacgcctagaaaatgctcaggtgaatgagcacattgctgtctggatgagtgttggacagagtgattttgtcatgagttaacctggcactacttttcttccttgtctactcctctgtaattaggttcagtggagaaggctgaggttagagatgacctcagtatgcgaggttgattttctttgtttccatgtagatgaacagtccctgtgtatggatggctgctgctttttctcacgtaccgtatgtcccgtgtggccagtagataacgtttgattcattcccattctgtgccagcgccttagacctatgtgtcaatgacagccagctgtcactcattccttggcttcacaaagggaaagaaagaaattcccataaggaagtaaatgtcctaaattagattatttatgtttaatggaataattgaaaatatttaatggaataattaaaaacctcatgctaattttatgagggagtcattttcaaaagttctatgtgaaagaatttcaaaaaagagcccttctttgtgttcctagagaaaaaaaaatgtgatttgctcttctcaccagtgctttgtgtaggaaaggatggcagaatgctgagtgagggaagcccatcaggttattgaaatgcagccactagagtgtgtgtgtctctttccaggaccatgaaacctccttccccagggctctctcagcacagaggctctctcctcggtggtgcttcctagatggtgagttctgcctttcttgcgggtatcgtgggagttggggaagttgaagagcaaggcatcaattgatagggtgggctctagttttccaaaagattattcagaaagccttcatgtgactccacatggctggtattggcatgcggaacaatgtgggcctgctgatattgcactgtcctttcctgaagtcatttccctcaacacagcttggttaactctggctgaactcagcatcaagttgctcaggccgatgtttttctttcatcagccctcttttcttaaagcttgactgcctgccttaaattaattcagaccagtagctggattctatatgcataggatggatataatttctatgttatttgcatcttatggaacattcatattatttttatgagaccattattgcagtatgatgtatacatttctggaaaaaggtggaaaaattcagttgcattcaaatctgctcagatccgcatgatatattgcatgcataataggttagttatcttatgattgtttaatgagtccgtttttttatctcaagtatctctctcctagatgctgcctaatactacatttctatccaattacccgtattgcagtaccttctcacctctgtatattcatgcttacatactaccgaatgtatctactacccattctctcttttgttcatatggagacatgattttcattgtagaccccttttttgtttttctgggtgagcatctgagaggatataaatgtgaatatgagtatgacaggatttgtgagtgtatgagcaagcattgggatggcagcagcagagatctattaagatttaaggactgtccagtagcctagcatgactgcaatgtaagggttttaactggcatagtggaagagaaggttataactttggtgccagatcacagaacactttgaatgccatatatatatttttctagtgttatgaagatgggcacttgtatctgtatgagatctaacccacataaatcatgatgtaggtttttgttaatgtctcatcagctgcctctcagaactttcctccagcttctttattccatagcaatgagaaacataatcatttgtcattcctgaatttgcagaggaacaacttgtatttgagaaaattatgaaaatatttatgttgttatgttctatctaaagtcttaaataaaagtacaaatattgtggctgacagtcttagcccaggtagtagttttactccatagttttaataaaataaaacctttaaaaggtaattgcagtcatggtttaaaagaaaaaagtagagtgaatttctccaaggcagattttattctattcttaggttttagacagcaggggtgatgattggctggtttcttagttctgtcgcctttggagagaagctactcattaaatgtttgtgaattttaaataagtgcttgcattttgagtttttctttcttgtgctgtttgttttgtagaaaatctatttataatatttgggctttgttagatagatttaagtgagaagcacataattctttttggtttgcttttttttttttttcttttttgagataggagtctgactctgttgcccaggctgaagtgcagtggcatgatcatggttcaccgcagccttgaactcctgggctcaggcaatcctcctacttcagcctcccaagtagctgggaccacaggggcacaccactatccctagctaattaaaaaaattgtttttgtagagatgaagtcttgctttgttgcccaggctggtctcagactcctggcttcaagcacttctcccacctgagcttcccaaaatgcagctgatagttctttctaatattaggaatatttaaaataatttctagaaacccaaaatttgtaatttagatttttttcgcataccatagatgtagctcaatctctttcagagaatgcttaaataatttttttgctgttttggcttccttcagacatgactctaaggatgcaggttgaaagtgaaatgattcatttaagaccacatatggtctctggcctgaatcttcaagccattttccgaagtgggaagtcacttcactgagaagtctacgtaactgtagctttttctagctttatttacttaataaatacatactaattcctaacttactttaagatcatttgctaatttcaggaggcataaaagattaaatgaaacagatttttaaagaggcaggtctcttagtctcatggttatctgtgaagatagtctgtataagaagttttaaaaaatgtaaatgtggatggatgcagggtcagcaggttctgtctggtgttgggaggttgggactgagaaaggtttcacagaagcagaagcacttgagctggttctttaaagacaagtatgatttagatggcagaggcaaagggaagggctttccaagccttagaatagcagtggcagaggcatggaagtgctgaggttttcttaatagatttagggactggccaggagactagcatgactgccatgtaggggttttgaccagcatagtcgaagagaaggttataaatttggtgccagattacagaacattctgaatgccatctgcattttttttcccctagcaacttctgctgatcgcttttatcgaatagacagatctcaggtaagtttttttccagcctgcttgtgaaagtgaaaaattcccaagttaatgtgctttattggtagctaatctcataaatttttctaacgaaaaccactgagacacaaattttggaatggtgttcataacttaagcttgaaccttttatttgtcttcacgtgttttatgatttatggactcaagatgatgtggcttaatcttgcaaatgagtacagaaaataagttgacttgtagacattatcaccagcctgtactccaaattttcattcacaaagatatttttactcctttttagccaaatttcatgtctttttaagctcatttctgtttagcaagtttgaggccccaggtgtataactagactacttagtttcagttcgccaatccctggaggtcagtgatgagaaaaaaaaaatggttttgcccaagttaagaattcctcccattatctgaattctcctaggagaaaaatgtacagtattgaacctaatgataaagttgttaaccatgctgcttagctttgaccagatgacggggtagaagtccacttaccatacactcctgctgggccaattgtatgtgggtgtcacttctctaatagtatttgggaagaagatgaggcaagaccatttctagatatatctaagaaaaagtcctggttaattggaaatcctgaaccaaggggattcatctctccctatctcccactgtctgcgttagcgcagctttggggaggatcaccaactgatcaagcttctgacaacacagtgtgatcctttgacacgttgcagaatttcattattcctcgagaccaagaatacttgttttgttattcttcatgcaacagacttcttgttcttctttaggaacatttgcactttgtgatggagatttcccaagatgagatttttattctggacccagatatggtggtgtcacagccggcggggacacctccgggcatgcctgacctggtggtggaacaagcctcggggtgagtgtgcttctcctggcctgtgaggctggccttagggtgacatccatgtctggttcgcctttgaacttgacatcgttctaatgacatcaaatgattttgaagtgtagattttcttgttgtgtttccttagagtggttattataagtctgtcttatgaatggccgtgaagaaacacaaaaccagatttacaccatgtccaagcctctttccccatcacagcaacccttcctaacaaacctagaaagcactagtacttgtgtttgtgcttgtacgtttgtagtaactctgttatctacattaaaaattgacacaggtgatttgacaaattttctcctcttcctcttctttgctatttccaggctgctggagacatgtagattatataataataactatgacataccaagccctttttaagagctctgtcctgtgtctctcttctgtttctaccaccgcttcatagtgacttaatcatcttaagtgctctgtgcttattttctcatctgtaaaatacaaataacaataatcctcactcagagaattgtttggcgattaaaagaattgatacaggtaaagcacttaaagtcattcctggcatttttaaaacatgcattaaacagaatgttattacaataataataatagtcatcaccatcattctagtgaccttgaaaatttggtacaattatccttaattcatagattaaaaaattgagacctaaagggttatgttacttgtctaatatttcacagaaaataagtagaaaaaatgagatatagtcctgggttacctgatgccagagcccatgcatttaactaccaccttctaccaccaaaacataattagtatttctaagttatttcaataattaaaaactatttatttagagaattttgtgtgccaggtcctagtgtaagcacttggggaataacagtacaaaaataaaaacagataagaatctttgtccttgtgaaatttagtgttttactggtctatggggcctgaattgttgaagtaagaattgctctagaaaccatacacaatgtgcccaaatagtaaatgcacatcgtgtacacagactcatacagtatgaataaacagtccactaggctagcacaactgcaatgtcatcttcattcctgttttccccttgtcacttgatttactttttttcactttttttggttcactgctgctatttgtgggtggtttcccactctgccaggggcagttgatgtccaatatgtaccaagtctaggtggagacaagagaggacacaagtggctgcatggcctgatagcaagctgttctcaggaagccagagctgcgatgtcagagcatgggggaaggccgacaggcacaaggggtaacctgatgcacccctgggagccccaaaggtggtggggaaggccaacttcgtggggcacatccatgcatcagacccatcagtagtggggaaagcaggtagagtgttttgtcctactgcagaagcagcaggtgctagagtctgggtgtcctcctaccccacctaacctgggctctgactcttgatctagtaaggagaaagtccattctgccaagttgccctggtctttgctcacttggtcattttctttttcttttccttttttttttttttttttttttgagatggagtctcgctctgtcacccagactggagtgcagtggtgcgatcttggctcactgcaagctccgcctcccgggttcatgccattgtcctgcctcagcctcatgggtagctgggactacaggcgcctgccaccacgcctggctaattttttgtatggtcgttttcttcatgtcaaataatggccaaatgctttggccttgctagacctctgttagctctagctccaaaaataaagtagcctgaaaatccaccaggacttgaatcagtgcctttcttatttctcaccagttgcctcccctgaactaaaccaggaacagggaagcagtgaaacaggatggactttgttattttctaatctgcatttctgccctaggtctattacttcttattcatgtcacatttaaaatgacttaatcttgaaaatcagttttctcatctgtgaaggggacagaatcatacaaatagttcatgattgttgagataaatgaatgaaataataaatgggtagtatctggtaaacacttcataaagatgaattttgcttctcacatttactggcaagattcatcttcagaaagtggaaacgaagtcacgtggctgactttgaatgtttaactgtctggtgcccttctttctctcaggatctcagactggtggaatcctgccctgcggaaacgcatgctgagtgacagtgggctggggatgatagctccctattatgaggactcagatctgaaagatctcagccactcccgcgtgctacagtaagagttctcttgctgttcttttcctctgtgccactgtgattgctgggagaggatgtactgtgggctgtgccccagtggtcaggattctcttttcaatggcgctcaggctgtctcatgcaggtgctactctgtgttttcattccatgcaccttgctcatatttatctaccccaaaccgttcatggaactccaccttccatttcttttgctcctgagccaccttgagccccttgcacgtggacctccacatactttaaacctcaccagtgtcttctttactggagtttagtgtttatcacacgtccctgtttgccacatcataaagacatgcatgagagtgatcatgagtagcttgaaagtgacacgtggtttttcatttgtgaacacattatcttgctgtttcagtggtcctcagtcctgagcctgtgcatgtgtgctgtacccaatattgccacgtgggtttgttggctaaagctgggtgctgcccatgttgtggttgcagtctctgtgggtaagcagtacagcatttgtttgtagatcagaacagtatgtgtgctttcttctgaggtctgatcatggtgagagtgtaggatgcatgctgaagtttcacagcagtgtcgatacctttgtgctcggtgaatccacctccctatcatctcctctggtgacagatacactcatgcgcacctactctttaatttcaggccaatcaatccatctcagaggttatgcaaatccagtgtgttcatgaaattaggctggtttccagtttacctggggtcttaatcaaataatgacaatggccttgtaaccacacagtcttagtcttttgacagaataacaagataactgaagattcttcgaatcctagggttaactaaagaggcaaaggaagtgctttgtttctggagaaagaccagaagcaatttcagtattacaaaggggaaaaaaatgagaaatttggagctaattatttcattggcaaagtttcgaggcacacaccctcagggcagaagacttcattttaattgcttctctgtattacctcttattttcttgtgtgaagacgggaaaggaacaacaatgaattactatggatttttctttttaattaaactgtgttgttagtttctgatggcattttgattgcttataattcaggatgttttccatttcctttttatacagaattgaggcttgtgaatcagggtgagtcagccacccacgaatggctaaaaaagtggccatttatctgttggcagacttattggaaaattagtgttttaattagctacagaaatagaaattaagcctggacaaaccagtatttgtttactgagtaaaaactcagtaaaccaatgagtattttagttgtatatatatatataatctgtttccacaaagcagaatatgagctcaatctagttttctaggtcctgatttttctatatataacatactgatgtacgtatcataataaataaaataattgtatataagatagtaaatattcttcccaagaatgacaaataaatttaccactttatataatagccaggttcttaaaaccagatgtcaaaatgaactctttctgtctgtttgcgttaaactatctttttagggatgtctcttaatttttggttgatcttcaatttacagctataagtttttgcagtcatttatactactttagttctaaaatgccctagagtagtagacactttttaaaaaaacctgaaaaattactttgaaaacaagcaaagtggcattcaaacattcatccccagcctttcagcttctccagctggatctccagacattgtggaacaaaggcaagtcatctctactaggctcagtctgaattcctgtctcatagaagacacagcataataaaattgttgtgttaaatcacttaaaaataaaactaaactaaaccagatgccttacctcaactttttaattaattctttaacttttaaaattattatgtccatttatttcttagaatatctttttatttccttcagacatcatctctgatacaaataggtataattgcagttgtggaaatatctaataatgttaataataactactattgatggactacttcccacttgctttgtatcataattaaatgatcttcattcaacaatttttaaatttagctgttgcttaacagataagtaaactgaggctcctagagggtaaaatatttatcttaggtcacttcaaatggcaagtgtagtttgacctgaggtcggtttggcttctgactccatgctttttccattgtcctacactatcttcccaaagggaccatacaaagtcagcgtaccagagccacagaagtttactttggtttctatttcttttttacatttgtacagtgaaaagtcctacaatataggggtactatgcatgcacattaaatatacaactgcaaacttacccagaagtaaatatggctgagaattaatttttaagcatttttttctttaaaagaagagattgaaacaaaatataatggtggtaaacttcagtttaaaattgctaaatatatataaactatgttctaatcaaaataagcgtaaaaattatatagaaggccatcatgtaccaaccaccttgatttattatgtcattgtttttctatatttgcattatatctttctttcaagccataaacaacacagagtagtgtaaaaaatattgttttatggttttgttttgtattgtacaagttggagtatctctaattggaaaatctgtaatctgaaatgctccaaaatccaaaacttttaaagtgctgacctgatgctcaaaggaagtgcttattggaacattttggatttcagatatttggatttgggatgctcaactggtaagtataatgcaaatattccaaaatcctaagaaaataaaaaatctgaggcacttctggtcccaagcattttggataagggatactcaacttgtatttttgtttttgcctgtgttatataatgcatatattttggaacttgccatttcactcagcattgtgtttttgaaattcattcatattgatatatgtgggtttttaataatttttgatatagaatattgcatcatacatatgctataaattgtttctctatttcgatagtgatttctaatattctattattttttaaaatgcagcaaacatcctgtgcccttctgtgttgcagaatatatatgcagtttcagcttactcgataatgcaaaatttaccttcccagttagagtactgatgaatcagtaactgaaaaggccctgaacacttattgtaataatctaggtatgatcagcatctgttgctttacactttaaagccccagtcaacttgggggataggaaaggttcaatttagcatcctgttgacagtgctaaataactcactatataaacagaaatcaaaagagaaactttcaattcttagaactgaaaatactacttatcagagttttcgagacactgctaacgtagtattcatagtacgttaggactgcagattcatttatcaagggaaaaatgattgtgtgcaaataagcaaagcattcaatttgataaattggaaaaagaatcccagtgtaaagaaatgagaggggagaaaaatgataaagataatgagagaaatcaatgacaaggagaataaaacagacagatgatgaacagaaaataaaatttttggccgggctcagtggctcacgcctgtaatcctagcactttgggaggctgaggcgggtggatcacgaggtcaggagatcaagaccatcctggctaacatggtgaaaccccgtctctactaaaaatacaaaaaattagccgggcgtggtggcgggcgcccgtagtcccagctactcgggaggctgaggcaggagaatggcgtgaacccgggaggcggagcttgcagtgagccaagaccgtgccactgcactccagcctgggcaacagcgagactccatctcaaaaaaaaaaaaaaaaaaaaaaaatttaaaaaattcgttgaaaagataaataaaacaaaattctgagaagtctgatttaaaagaaaaaagtactgaaaacagaaagaaatatacctgcaaggctttccccatatcattcttcctccaaggcacccagggcatttttgtgccaagcggccctttctcctccaaattgcaactgacccggctctgttggatcttctcagcattttcccatggttttaaaatttaaaatagtcccttagatccatcaacctccctttttctcaggcagagtgagaggcaattagtataaaaaggatgaattagatttctatcattactggaattggttgcatttattttaaatgtttccatttagaagcattataattttaaagaaagatatacacatacctacttatatgcagatcctataggaaagactgtaattccaaagtaggatacgcaatgtgtatagtgtctgcaaaacctgtgaacataataacaaatatttaagaaccaattttgaaatgaattggtgagaagtggttgactgacattattactgctgggaccataatgattttttctttaagttaaaaaaattttttttcagtgtccaaggaagttctatttaaaatgacatgattctggaaatgtatttgctcttatcattaattgtaccaccacgattagtgacaagactatatttcatttggcagaagattaatagagagggaatttacttaaattttagcagaccaaatctatttgagttgtaaggaagaattttgccacttgaggatctatgagaaaagaaaataggcatggaatgaaaactctgatatattcttcttaagttttctttgagaaaaggactgactcacctctgagtcaggtgggttaagagcaggcaggtaaagggtctaggagacactgcttttgtttctgaatcagagtaacctttttccggttcttagattttgtagttcgtaagaaacccccaaatgactgaaagagttgtactttttctcaatgtccccaagtcctagtcctgaaagaactaaaatggactgtcacacaaataatatcttgccactagactaagacacaggggaaacagtgtagtgaaccacaccgagggtagatattcaatccagataattgtgtctaggcaggtatctggtacccgatcagctgcacaaggctaatgggtttttatgattggcagaggatttctgtcttcaaggaaagataatgctatcaaatgtttaactataatgtgtgaggtctgatttgtgatttcattgtgattaccctaagaaatagggtaaacaattcagtcaatcgtgtattgaacaaatcagtattgggcaccttcagtgactgaagtcaggcactgaagatatacaactaaagaagaaataattattgcccttgaagagcttatatttaaaggggaaatattaaaccaattattaaagttccttctaataagtgctattatggatatatgcatagagtgttctggaaacaagaggaaatataatttgctgcttttttttttagatttaacttttttgaccctagaaatgatgaatatttaaagaattaacgaaaatgtcagcctcaaagaaaaaaaataggcttattaagtgttctatgtgtattttcttcattttttacatgtgaacagataagtatttgtccttcctcattgtgtaaaccagaaatatctctcaaataatggaaaacattcaatggtagttcaacctctccatatgctatgtgtgctcaaggaaatttggacaaccgagaaattatttggagataccaagatacctaataatactttaaactgaaaaactggcctttttagtatagtctgcaattgcaattctgaatcactatatcgagaagataaagcccggagacctcctgtgttctgaaaactcagatgttctaagctgattatgggagaaacaacatcattcccctctggtcctcaactattttctttattcagtttcttctgggaacattaggttatggcctgaacctaataaaaagggtaattgtgcttattgtgaaagtttcaggttctcaacaggaagacagactgttggacagcgattttgattttggaaatattctttcagcttcacaatcagataagcgggagaaaattaatcttcttagtgggatgcaggttttgctgaaatatatcttagagatgaaatcagtgctgtcaggataaagatggctcctggcatctgtttcactgagatagttgggtcccgtttctacctacctttgacatccctgcttacctttgactgggctcaatcttgctcaccccggatactcattccagctggaaaaatacaggatagctgacatatgtcttccttcttctttttcttcttgacttaccttgagtttgaaatgacttggtgaattactctatttggcaagcacataataacactctattcctatgggtgtgtgaaatatttaataagagatttgcctttgttatttttagaattgttcctcaatcagttatgcatatggaggccctaaaccactcggaggaaatggatttaaatttacctttccaagttcagttagtggaagagttagaacagagttccctgtgtaccagatcttattttgactgacattgaaagaaaaacaaacaaacttactttaatgttaaacatccattttatttgaaataatcccaggaaattctcgcccttcattgccatgagttccaagttttgccaatgattagagtatgaggaaatattagtgttaagtggctctctttttacatttgtaaaagctggcagccatatttattcacacttcaggaatactgtgaatgtgaggcagtattgattggatccctctttaaagcatgtgagttccttggatgaccaaactgtgcatttctccctctgtctccatagcactttgcaccatacctaaaatggtaggcatccaacaaggcaggcttttgggatgaatagaaggatgttccattcatagaacatcccttgatagaaaaggtgctttgtcaaaccaaaataaatacgtgtctatttatattgctatactaaacccagtacttatcaaattataacaaaataatagtgataacaaaataatatgtaaaatgttgaccatttttgttaggctgtgggttccatttatatatttcaaatttgaatataagtatgctggatccagggaattcacagatcaaaataataaagacacacctgaatgcctgacttggagaaatgttggtatttcacaagcgagaaagtaaaaggtaagtatggtcggtataggaagttgtaggcactgttggtgagcacagtggtaggtagagtggcaaggaagaattgtttcccaggcattcacctccaaaataaactgttggtccccggctgcattctccaacttccaccaacactcttgttttctcagtgtgtctgtcttaggtgaataatttgattaaacagatctaaagtgtgaaagagtgatcattttgaaatattttcaaaaaaattcgcttgcaaatctcaagttgctgggatgtggagcagtaatcacttaccatgttcagtgtggagttgaggaatgtgagagggatgtcatattatcactggaaatggtggtggctggggagtcatatcgggcatgggacttctctgcggtacttctggggccctctgaaccccctactctaagaagatcagaacaagagatatctccacaccatgctagcactacttatttggaattcagggagatggagaccacattccccgccccccccccttttttttttaacttttctggatgattgtgccaggcatcacacataagaacaacaatcctccaacagttttctccaatactctgtgagatgctggtcttactccatgactcccttacaagctccttaaaggtgggaatggaatgttttaagttaagtacctcccacagctcttggaatagagttaagtacatagcagttcttaatatctaacactggagtcactgaattattctcacagtctgtcgagcccattttaatttcttgttttcaatattactatgatttatctgcattcattatattttttttcacagagctcctcgaactgatctataactgagaaactctcttgtccttagacacattagagtcaggaggaagcagacaatgtttagattctgttcccaccctctcctgagaagggtggggtgggaggagatgttgtcagaaagctgctggggtatgttacagttatcttcagaggtgccaaaccagcttccaaccccgcctagttttgtctcccattttctaaaactgggatcagaagtccttatttggatttcctaaaaataagtagctgtggctgagcccttactcaattaccacagggagatattgcatatccgggatcacgagataagtgaggtgccttgcttataagccccacgtgctaagactaaacgtggctctcatgtgacttgccttcacaatccagagctccctcatgtttcaacttatgcttaaaaagaaaaaaaagaagtccacatttacaaaatccagatggattatgtctcaacagaagctgttggccggggttcccagagtcactaggataaagctggcagcttggcttttcctaaagggtccttcctcctggctctccgggtatgtctccgttgtctggattttagaataatgtgccttttctatttcttcacccttttttttagaaagtgggctggcaactatattgcagagactgatttctaaaggcaagccacccatcctttattgcttcacaactgtgctgggtttaattatttcttttttcattttgtctacagaatgctaaaatgtgatggctacatcgtcaggataaataagcttgtgaagtattattttctccaacttcatctctttattttatctatttcttttctgtgtccactgtcgcccattcttcctcaatctctcacatttcaaactgctttgccctcattttgttgcagttcttaaaagttaacagtaggtggcagtaaaattttatactcgaaagacattcaggcgactcagcaaactgaggagggtatacagaaagtatggaattgtaaatgctaaaggtaaaacagcgtttttttaaaattagtttttagactttttaattgactaattgcatatatttattgtgtacaacatgattttttgaagtacgtatacattgttgaatggctaaacctggctgatcaatgaatgcattacatcacacagttatttttgtggtgaggacacttaatatgcactctctgtgcattttttaagaatatattatatcatcattaaccaaagtcaccatgttgtacaatggatctcttgaacttagtctgctgaactgtaattatacgtcctttgaccaatatctccccaacctgaacagtgctattttctaaaagccaaatatatctaaatataggaatctatttaaaaaaaaaaaaaacaagatatttcaagcccagctcacatgggggtcatcaaggcatatatttgggtaggtgagtcttaaagactgggaaattatgataataaagggaattggtagaaatttgtatcaaatgaggaactcaccaagcagcctttattatttacatgctggaaatgatttccttccctccacacaaatgctcatctctgtcttcttcctttcattttgctctttctgcaccccttccctctgttggtcatgaatgttacctttgaggctgcttggcattccctgaatgggtttgtgaccacttgaatagagaatgtgtttgtctttctctcatttcaatgccactctgtgtgtttgctgtaactttcatctctcactctcattctcgcctgctctcttttactgtatgtgctttgttcactgttttaagagaaatattcacaattagaaggaccaaaagcaaacaaagagaggattatgtagtcgatggagatttgcagtgctgtgggatttctggtcctattttacctaattagagatgctttggggctagagtgataatggtgaagatgtcacacagatccatggtctcattctttctcccttgggtcctccaaatgatgtcataggcctggcaaactagttctccaggataggcaatgcacccttgagagatgctcaagggaagaaagctattgcacagagatgataatctgcagccatgctttcacagcacagtaaatcatacctttgctcacttgatttgaatgaagattcttgtctaccaacagttttaggaaatagatggaatttgtgtagcatcaccacttcacggtaaaacagaagaaaaagatgaggtttctgcagttgtgatgcagaccgttgaaatgtgcctggagagaatgcccaactgggaaatcggttttcattcgggactacgtaggagtgtaacagaggacaagcatcatggctcaagaagcagggaggaaagtggaacctggggaatgctgaccaggcatgaacattcttacatgttcaccataggaaaaaggtgtgagcacatgatgggaggctgttctatccaggaaagactggattccacccaactgtgacaaaggtaaatgagaaagtccaggaaactctcagggctgtggtcaggagaggggaaaagaaatacaagtaaatgactgaaacgacagagaaagaacattcagagctgacattaagagcttctctttcccttcctaagtaggatggatcatcacctgatgtttatagaaagtggtctttttgctgtggttctcatccccaaagctagacagtaaagaggaaagacaggcatgaaagggaaattgaataaaatacgcatatagtgagttgttttcagtgtgtggacatacgtgtgctgctttgttccccaacaagaacttcacaataaggagtggtgtacttatttgtagtgtgctgtgtagggtgtagaaggagcacggtgtctagcttgcccagcattcccgctttgtttccttttcttattgcaggatggtagccagaaaatgaaggggccttggctatttcagtcaggcccgtgaattggatgagtgtctcccacctcttctactccatccatagtctgtggtcctggggaatcccactgctgagtgttttcagaatatgaatctatgctcttgtgcctatttaaactctgctgtcacacctgtcctgcatgtttatcttaagcccatctctatgtggtggccccatcccttggccaactccccaccaggtgatggtttagcagtgctgagtagaaggtatatgtgttggggacacggaatagagatagacattcatttgtagatgtttctttacagaaagtaagagtcccatatagaggcatccccaatatttatctaatctatcctctgttctttaggaaagactaatggataatctattgacatcctatctccaaagaaggaaatgatgtagccattctgaggaagggccaagtaggaaggccatgggtgcttttaaattaaagccatgagatgatgaaaaaaaataaataaagcaaaatatgcatagagtctaaaaaaataaaaagaaagaaaactggacagtgttattgaaatgaaaaggatattgtattaggatcagcttgtaagttttgatcatttcatggagcttaccaagaaaatgcacatatctaaaacctattgtaaagtatattataccagatataaagactgaaatagtcgtgacacccattatttcatttccaggtttattgactaaaaacgataaaacatcataagaggtgcaatactttataaagtcctttgccttcccaaatataatactcatttgcttttatgtattgctcttttgctggtagaaaactgggcacatttttcagtgcccttaagccttgtaatcgatctactagaaagataaaaggctttgaaggaaaatttgtggattgaaggcaatctaaaaaaagtatctttgagtttcttagagatgcttgagtttagatagagtgctgtctgtaatgcagcagccactagccaatatgtgctgaatgtcttgttccctgatttgtgatatctctatatattaatctaataaaatgattcattccaagatattatagctgtgtttagttgggtaatttcatatattcagactgccatgacaacactccgttccagaggaacaaacttacttccttgggaacctggagacttgtctgaagctgactgcctcaaacacagatatctgttttgtcctgttttattttttgtttgtttgtttgttttcgaagtttgtgactttaaaaattcaagggacttttgcttttggatacataatatgactgtgctggtttcagtatgaaaatattttaatttttaccagttaaattacataatattctatctaaaatagcattttgttttccaagagcttccctttttttccaagtttctctgtgtatgctagtttgaaaagttgtctttattttagagacaatatggatattctcataagcagggttaatattgggaagggtactttcaccagcaaatattcagatcaagattcatggaagagtaaatccaaagtaaaatatatatatatgtgtatatataaagatatgtatataattaaaaatatgtaactatatattattttaattttttattttttcgagacagagtttcgctcttgttgtccaggcaggagtgcaacggtgcaatcttggctcactgcaacctctgcctcctgggttcaactgattctcctgccttagcctcccaagtagctgggattataggcgcgtgccaccacgcttggctaatttttgtatttttttaagtagagacagggtttcaccatgttggccaggctggtgtcaaactcctgatctcaggtgatctgcccgccttggcctcccaaagtgctgggattacaggggtgagccaccatgcccagctattattctagttctttaaaaataattttaaaattgacataaaattattatgtgttgtatacaacatgatgtgaaatatatataaccattaattatgtagctaattaacgtatgcattaccatgcatagttataaattttattgtgagagcacttagcatctactctcttagcattttttaagaatgcagtgtatcatccttaactatagtcagcatgctataccataaatctcctgaactattcttcctatctaactgtaactttgtctactttgaagagcatgtctcccatctccctcaccccgaaatgccccagcctctggtaacctccattctactctctacttctgtgaaatcaacattttagattccacatgagtgagacatgcagtatttgtctttctctacctggcttatttagcttaacataatatccttcaggttcattgatgttgttgcaaatgacaggatttccttttttttatggctgactagtatttcattgtgtatatataccacattttctttatccatttgtacgttgatggacacttaggttgattccatatcttggctattggtaattgtgctgtaataaatgtgggaatgcagctatcttttcagcatgctggtttcacattcttttaatacttacttttaatatttaccttatgattgctgaatcatatggtagttctatttttgttttgttttttgaggaaacttcatattatgtaggttgtttctttgctctggtgattgtttcctttgctgtgtagaagcttttgaatttgaggtaatcgcatttctctattttcgcttttgttgcctgtacttttgaggtcatgtccaaaataatcattgcccagaccgatgtcgtggagcttttctgttttcttctagcagtttcatgtttggggacttacatttaagtctttaatccactttgagttgatttttgcacatggtgtgcagtaagagtctaattatattcttctgcatttagatatatgcttttcccaacactatttattgaaaagactgtcctttccttattatgtattcttggagcttttgctgaaaatcagttggctataaacatgtagatttattttccggctctctatcctgttccattgttctatttgtctgtttttatgccagtgtcatgctgatttggttactgtagctttgtcaaatattttgaggttaggtagtgtgatggctccagctttgttcttttgctctagattgctttggctattcagggtcttctgtggtttcatacacgttttaggattgtttctactaatctgtgaagaatgtctttggtatttttataggaattacgtagaatctctaggttgcttaaaatacgaacattttagcaatattaattattttaattcatgagaaagagatgtctttccatttatttgtatctttttcaatttctttcatcaatgtttcatatcttaatagatttttaattattatttatcttctcttaatcttttttcctagtgcggtggtaccacagtggaaaaagccacaagtttctttaataacaactagttcaaagactctgggcagacttttgctctttttgcctccctgtaactatttcttgatcatttttcttctttaagtttacatttcacaaatgctgtatttacccctacctcccttccttccctccctcccttcctccctcccttcctccttcccttcctccctcccttccttccctccctcctccttcccttcctccctcccttccttccctccctcctccttcccttcctccctcccttccttccctccctcctccttcccttcctccctcccttccttccctccctcctccttctctccctcccttcttcccttccccttccctccctccctcactccttccctccctccctctctccttccctccttccttccctccatttctaaattacacgaagatttattaatcatttttatctgctttatgccatcatctttttagtgtgttctttgcctgtgttttgtgttctcctctggtatttttgcatagatgtcatgctggttcttttctgttattacttgtaatatttgcattgggtgagtttttttttttttttttttgagcttctagtttgggatggatggtcggtcttagtgatttggtgtgctgctcttaagtttgactttgtctctgttatcttcaaacttttgcttatcagcatcctcttctaggtttgggtctacttctggctagcagaacaccctggctcaaagtggaaggctttctgccatagattttgttgtgtatgaaatagtttatatctctttagctgactaaaatcaaaattatctgtttccctaaaacttagctctatttttactgtacttggtagctcttcttcatgtatgatggtttgggcttataaatacctagtttaatcaaagagggtatttcctttaccatttctcatcctccctgtcattttccatgggtttcaaaaaaattgaagggcagaggaattttttttctgtgttactaacatggaagtttttcagtcatagtctttaacttgagctctgccttttaatttgtcttcttgttattttatggttcactctccactgcctgctcattgcagaatgtgtgacttctctgcctcacaagcttgctccatttagcttagaaggtaaattgcaagtacttcaccggggccccacacgccatgtatgaaatggcccttgccacttatttctcaagtccttgcttttgttactcctttacattctagcaatactgagttacttgtatatctggtaggattctatgcaatttcatatctgtactccttttcacacgcctattgctattctgcctggagttcttctccttcctaacttacctaataagctcctctttattcttcaaagccaagttcagatgattcttgtttttctaagccttctttcacacttttcatactgaatcaatctccctgttctctgtgctacctctttgcctcatatatattttgatcattatatattttttacattataatcatttatttacatatttttctttttcactagattatgagttccctgaaattgttctttgtgtttccttcccttggcacatggcctggtaataatagggtctcaagtaataaattgaatcaacataaatggagagagtcaaacctgaataataatgatttaggcttagtaggagaaatatttttaaatgcatggcttgaatttttgttttgtattattttgctgcatttaagcaaaataaaatgtaaaaagtaccaaaataaataaaaacaaagcacaaacaaatatgaatattctgtagctaaaggactcatgatcaggaaagaagtgaagaggacagctataagaatgctagtaatagtttacactataagggcagatgcttgctccaagataaagtatacatggaggaaaaataaacagtctgggatacaaccacatgtctttcaggtgtggtgaaaagaataaccagagggctttcctgcatgcctcagttgtcaggtttaagataattatctctttttgggattgaacctctgttgttaaaataactacttatattgctgatttcagaatatttcttctctcctgagctaacttctttcccctccctctctctctttctttctttcttttttgagacagagttttactcttgtcacccaggctggagtgcaatggcgcggtctcggctcactgcaacctctgcctcccaggttcaagtgattctcctgactcagtcccctgagtagctgggattacaggcacccaccaccatgcccagctactttttgtattttcagtagagacggggtttcaccatgttggccaggctggtttcaaaatcctgacctcaggtgatccacacatgagctaactttttatgccgatttccagcaataatggatgatgtgcatgtctcagtagtgcagtgcagtaacttgttgcagtgaaaggtgaaatactgagtgaggatggaaatactccatatgtcttaaaattccacaaagccaggcatatgggagacattcaacatggaaactcaacatgactaattttcacaaaacactctgaaattgatattttatccactgcctggacatactgcagaatgcgtccccttgggactctaacggagccatctggaatttttcagatttaatatcagggctttgcttttgcacaaagccagcaaagaccttgcttcacaagctctccacttgagacatttagttgtcctttggcatgaattttactttgttcctgtagctctgtgacaaattaattgcaaacaatccaagacacgttttcacttacttctcatcagcaaacaccaggaggaaagatatttccttgtggctgattctagtatgacctaagcacctgaagaaattagctcatcttacttaaaatataggttctcttttagattcagcttctaatttcatttcacctctcattcaatactcccctccccaactttatttttaataataatggaggcagaatatgggtgcctgtgtttctgggtgcttttgatgtcctttggctctgagagtgtccacattataaccaattggagcttcaggcactttcaagtctctaggacttttccttgcagctggcctaggagcaggcaagcttgtcttaaggatggttttacagtaacatgatgactttttgggaagctccagaatgtgtcagtctgaatatcagtgtgatggaactgagattaattcaattcaacacattttaattaagggctcatctgttctaaataagatacagccttagttttcaagggggttacaacccagtgagaaaggctggtatgtggatgataaaaaataagggaatccagtgggaggataaatcaaccctacccagggaggccaaatggtgcttctcaggcagtgttgactagggattgtggcaggtttccgctcaccacccccatgtccatctcccagaagccaattttctttccaccaaatcttgggactctgtagttttcatgaaaaagtctactttaagagatttgcacagttgaaataaattgatactttgccactcattgaggttcaaggccttttctcctttaccactgtgtctttattctttactgttcactcacataataaacagtaatcttactaaccagtagataaagtcatatcaagcatcccaaagtagctaaaaattattttcaaccatttttgtattgactgaatgattcttgtcctgaggtttatcttcatgtctcataaatattagttatagtaattggcagctctattgccaaactcctgagtttatctttggccatttccctgctatggatttgagtgagccaatcattcagagaagaggactccttcaaaataggggaagtatgtgatgtcttgtctttcccttcgaaatttcaacaactctgaatataatgttatatgtctctctctttctcctcagaaaagaataagtgtgagtcaaagccgtagtcttcaagctggaggtgaattcatctccaaacttaggtctatactactcaaagtatttcaactagtagtcaactggggggaagcaagccttttagggttgatatgatttttcatttgagatctgattatcataattaaagcagaactcacatatagtttgcaaaagttgttgataaagttctgaggaacctcagtgattgccttctggcctcatgctgtttctcccgggttctgagacataatgcagcgaatagagggtcagctcactcaaacattaaattccatgaagagtgaaaacaaaaactggtaatgataagggtgcatgctatttcttttacctctgtctcaatttatactgttcaagtagatctctttgtatctacagacacccaatctaatgctttttttatatccctggctggagccatgtccttgggcaatacacatcacaggatttcatctatactacatttctatgagttctctttttttgtgtggtaaatctagacttagctaagtttgttgcagtcctaggacaccatgcatagactgatattttagtaacctgtaacatccaaccaatccaggtaagagttgggaattgttgattgaaatataccatgcaatcaacacattaattacactgtctactatattgactttccatttaattcaatttgagggtaaaattactatgaaattattcttgattatcattataattatcatataaaatattgatcatgcttattatttccttttaggtcaccagtctcttcagaagatcatggtaagaatcatctgtcttatttataccaattcaggattgaaacttgacccctggtctttgcagttcattgtcagagcaaataattgtttaagcaaatgtctctaagatattggctttgtggtttttgaatgtgaaatgtcaaacacttttaaaaacttaaatcaccctagctgaatttgatatctttcaaatctgttccaacccgtctggttgacgaatattgtgaagccttaatttattctgcctgatttcagtcccatcagcagaaactttttgtggttttgtggttttggactagtcctgtgctttttatgactcagatttttatccttaaaatgataaaaatttttgtggtagtttgtggtagatattccctacagtcccttccagaatggacattgggatcatgttccaatcactcatttgtgaagagcactctaaatctgaaaggaaggcaagcagtcagtggtatttgttgttacccagttgagatgaattgtttgcattttaagagacagctaattcactcaaaagagaaaatatctcattttgttccatctcacctttggagttgttcatttatccaatcagtcacaaaagtgttaagtgtctacaatgatcagttatgctatgtagttatgttttacaaatatgctatatggaactttggtttggggcccctttgtatcttacttggactttggaaattctctcataattggtatccatacctctatatttcttttccctagtacactgtataccgggctagcaccaaaatgatcgttccatagtaaaaatctgctccgatggcctctagaatgaaatctttccagccgaccaataattgtgttcagcttttcaatattgtattttagcatggactagtaagcactaaatgatggaatctttgtcttcctccactgcttattgcttcatttaccatcttttcccttctcctacccatgatctgttttccagccatgtgacaatacatctaattctacatcaaatttctggagctcaccatcttttctgccatctccctgcttttctccatactgttctctctgacaggatgctacttcttttgccatatagatggtttctatgcacctcacctcatcctctgtaagggcttgctgatctgcttatcgttgtgcctaatatttttctacattctagggcttaatgcgcaaatttcatgctttatttacctgttttccctattagactatgagttctttgatatagtttccaacgaagagcaaacaaggaaaaagtgtttattaaatgaatgaattaagaaaagggagaaggagttttaggctggcctcttctactgccacattgtgaaatctgacttagtactggaatgaagttgtgttattctctatgaagaatcatagggaaaattatgttcaggcccattaagtcaggatcaggcaattgaccacctaatggtaacctgctattatgtgctattttgctgattgctgttggtattactaggtgtttgcccatttatataggcccttgggcttccatgttcacattataaactagaagcttgtgtttggtttttattttgaactaggattccctttaatgacttttggttgtctttgccttcctgtctatgagaatttattcctcattcagacaaaaatggtgggtgagggaaacttgtgaattataatttgataatccactaggacttcttaagtggttatgaaataatagggggcatatgtcagggtcctttgaagtcctaaagggtgactactgacagaaagacttgcttggaagattaagagcacttcagaattgattattttaagaaccttatatgtgattagttgaagaaacattattgaaattagagggccattataatttcatggcttcaaaaaatttcttacatgttcatacctcttagtttgtttctgtgacttccaaaaatagttcaagtacataatgcaaaattatagtgatgatttacctaatcctatgtaattgttcatcattttctagcccatatattcttgaaaaaaagcttttttctttattaccagaattttctatccaccactcaaaatatatttccttctttttatacatttttaagagctcatgtgtactatggctagtataaaacctcttgaatgttatagcatcaatcttacatattatttgtacacaataatggcattgcaacacacttgtaggagaggtgagaagtagcaatttgtctttctcaaatttattggtagaaaatttaaggcatgttggacacatggattgtgaaattggaatataaaaccttacgtctcttgattttctattttgtttgctttcctcaaatagtcctccctctgtaataactagtcactttggctctaagacaagaacttattcttggaaaaatctaattttgcaacgtccaataaccctggtatttttcattcccatggtactcttgcatagagagcttaaatacagtggctttgtcctttaccttatcttgtttgttttcttttccttgtctgtaaaatggagctaatcataaactgcgtacctcatgggattgtagcaagttcaattgagaaatcatttgtgaaatcactttctgatttttttttttttttttttttttgagacggagtctcactctgtcgcccaggctggagtgcagtggcacgatctcggctcactgcaagctctgcttcccgggttcacaccattctcctgcctcagcctcccaagtagctgggactacaggcggccgccaccatgcccggctaattttttgtattttttagtagagacggggtttcaccgtgttagccaggatggtctcgatctcctgacctctcgattcgcccacctcggcctcccaaagtactgggattacaggcatgagccaccgtgcccggcccactttctgatttgttaaaagcaccccaaacatagtattattcgctagcatccaggcagtagaagaggaagcacaagtttatctgtgatgtttgctcgggattatgttccgcccttgaaaagtttaaagaggacgggagagaataaccgtttttttcattatcattaaattttctctggaaaccttttattacatcagggtgaggaggagtaaaatgtttaatacaccatttagcttatagtgccagagtaaaggctcagttgatgattagatgtgtggtcatatagaattggcaacacaaggtctaaatgacacataaactgtttctatatttatataatagcgcatcagggtcactaagaataaaggctaaattgtattgagtgcttattatgcagaagcactgtgctcgcatgctccaactgccttatgtcctttcatctttcacaaataacactctgtagtcaatgtatcacccccagtttcacagctgcaaaagcaggctcagagtgcttaaataacttgcttaaggtcacatagctagtaggtgagagagttaattttcagacccaattctaacaatcaaactcttaactctcttttatcggccatgtccctggaaaaccaaagacatgattgaatggatagaactatggagataattcttccctcctctaacaagagtatatttactactgtgtaagttaatttctttttaatgacaaaacagagcagaacaaaaataacaacttctccctcctgctggtaatgatttgtccctgtagaaaaaggaaataccaatgtcacattttctcataattagttaactgagtgaaactgaagtttcagggaaacctgccatgctaaaccccagtggaaacattaagttttaatgttacatctggaaactggagccctactccttgttagaagataagcttggcagtgattgattgcactgtcctctgcatttcctctgtattgaatgcctatcacttcgtcatttaaattgctcctggagccatctcctgggcccaggctgcttccctggctctgagaactcatcttcctttctgtcaccttagcctgcttattttacaggctccttggaatgctgcgcttaccgctgcttcacttactgctgctacctgtgccagcacactcagggcaggtcatcttccaactaatgtctgttcatttacaaaataaaaggcattagtggcttctcaaagaaagtgccagcaatctgctgcatgccccactggaacatctgaggcaggcatccctctcctgtcctacctcttagacctgttgtcaactatggccgtcacattctagggcagcttttttgttgcagcagtaacatagtggacatgaattgcagtaatggctatttggaaataaaattgtcacaaccacaatcactagtgtaaagtgttcaataatgaatccactgtcaggcttggagacggctgtacttggcagtaggttactgatatggtttggctgtgtccccacctaaatctcaccttgaattgtaataatccccatgtgtcaaggatggggccaggtagagataattgaatcatggagcagtttcccccatactgttttcgtgatagtgaataagtctcatgagatctgatggttttgtaaatgggagttcccctgcacaagctctctcttgcctgccaccatgtaagacatccctttgttcttccttcgtcttccgccatgattgtgaggcctccccagccatatggaactgtgagtccattaaacctctttcctttataaattatgcagtcttgagtatgtctttattagcaacatgagaatggattaatacagttatgcagtgaaacacactgtggcgtggcccaaactctttgaggcatcaatggctgtacctcatcaattcacttttctttcatgtatattactgaaatagatactattcataaaatatataaaatgttatctgctcagtttaaataataagcaaaacgaactactgtgtacttggccctcagactaagaagtaaaacatttgtaggaatttgggagcttcatgtcatttgcttccctaattatgtccccttccctctccttcagaaataactactattctgcctttttgttaatcatgtccttgtttcttcttgttttactacatatatgcatatcttacatatgaatggatacgtggatatataactcatatatgtattcctatatgtgtgtatatgtgtgtgtgtacatagttttatgtattttgaatttgtacaaattgaatcatgttgttatttgtttcttttgttcaaaagaataatttttgtgattcatccttatggatgagtgccatatgcatttcatcaatagttcatgttgtatactactctattgtatgagtatataccaatttatatatccaatctgctaatgaatatttacataaataacaggtttcttgggggtttgtttttgttttgctcttgcaaacaatattactatgaacattctcttttttgtaactcttcctcgtatccatgcgcttaaacctgggaatagcttaagttaggtggtagattatacacatatttaacttatagcattataacatgttgttttccagagtgatcattttaatatacactcccaacttcagtggataagagttcccattgatctacatcctcaccaacacttgatattaactaatttaaaaatgtttgctagtcttgtgaaagtatgaaatggcatctcaatgtgattttaatttgtagtcaatgattacacatgagatcaaacatcttttcatatacttatgggccatttgtgtttactcttctatgaaaggtctttttatttcttttactcacttttccccacctggttggttgtgttcttcttaatgatttatgaactttttaatgtattctatgtaaaaattattttgtttcctatgtgtgttgcaaattttctccagtttgtggcttatctgttcgagctctttttgatgtcatctgatgaatagatggatattctttattttactgcagtaaaatcattaatgttttctctatggtttatgcctttggtattttttaaagaaatctttcaaagcataatcataaagatattgtcttgtaaaatttttagaatgctttctttaatatttgataacttggaattgatttttgtggtttggtaagagataaaggtcaaatttaattttgattctgttcatatacataactagctatttcattttcattcattttcttcactgacttacaaagtctgtcgtctccctgtaaatgtgagtctctaggttctattttctgttatattgatgaatatatctatccctgtgctattgttttagttgttataactttggtatgagtccagatatctgttggaggatatatcctgtaatttgtcctttgggagtgacttggttataattgagttttgcctgtttcatataaattataaaattagcgtatcaaattttgtggtgaaattttttatgaaaattgcatgaatctataaatttgtataaagaaaattgatatttctatgataatgcatcattctattccaagccacatctcttgacatttaattggctttttcaaatggctatgaatagagttttataatttccttcatgaaggatttggtcatttttgtgttaaatatattcctaggtactttatatttttagtgacaatttgtatgttgtatttttaaaattatgttttctaagtagtctttgctggcatattgaaatgcagttgaattttaaaatcttgtttctttatcaatattcctgctaaagttttaaattcataaatcttatctgaagcgtctttttgtgggaagagaattctatataggcaatctcatctacaaagaattttgtttcgtcctttccaatcattatgctttgtatacatatttctggtgctttctgcactggttaaaaccttcagtgcagtattgactagtaacagagatagtcagcatcattgacttgttcctgatcccaaagtgagtgccatccacaagtcacaattaagtaagaagttcactgccaggtggtcatgatgcaggtgacagtacttgttttgtggatatttcttataaggatcttttccttcgctctaatttgttaaattcaacagatgttgaattttatttaatactcttttcttcatcttgagagatgacaatttttttccccttggtctgttaatatggtgcattttactaattgatttttaaatagaaatcaatatcgtatttatgagaagaactcagattggttcttatatttaccgcctttatacattgctagatttgatttgctaatattttgtttagatatttacatccatgttcataagtgtgattagtctttaattttgctttctattatgtagtatgtatatgatattcatagcttaaaatgaattaggaagggtttcctcttttataatctctggaaggctttgtacaatacttgagctacctatttctggaatatcttgtatatactactattattttcattttacagatgagaaaacatgcctattgagtaaaaggtagaactaggatgtgaactcaggtgatctggatccagatccttttcttaaccatttctctgtactgtctgtcaatagcattgctgaaatttgagctggtgtaataggaaatcatgatattatttgttaaataaagacctcataattgtatgaggtctttttattgggtagaaagtgattattaaagatgggaattttttattcatgtaagtaagaaaaacccttgacacagaaaaacattcaaagatatattttggatccacttcttgtagccccatacttcataatcaagaaaatagggttccaatctcctgtcaataacattcatttttttaaatagtagagttctcaaaaggtagctattcccttaaagagatatcacaagtaggaagataattattatgaccatgatgactacgagtaaagaagattaagaaagttagatactggctgggtgctgtggcctacacctgtaatcttagcactttgggaggccgaggcgatcacctgaggtgaggagtttgagaccagcctagccaacatcgtgaaacctcgcctctgctaaaaatacaaaaataagcctgacatgatggtgcatgcctgtaatcccagctgcttggaaggctgagggaagagaagcatttgaacccaggaggcagaggttgcagagagccgagatcgtgccactgtactctagcctgggctacagagcaagactctgtctcaaaaaagtaaacttgactgatgttacagatggaaatatgtgcagatctttaattgcattgctaggtagagcctactgtactgagcgtcacagtacatcactttgcaatgactttgggctatcataaatataaagttgctagagtgtccttttttttgccccatatcagatttttcctatagaatccccgttgtaaaaaacagtgctcatttttgaggctctttctcttcccgctttagctcatgttgctttcgagctttagagagttacttctactctgcttgcgggaccctctctagacctcgcctttcttgtctttatttagccataagctttctgtcacctcctaccatctctctggcaggcaccttcattgtccttcatgcaggtctcacctcaatgctcattaatttccgtgtcttggaaccacctctatagacgctaaggacaaacaaagatgaattttcctgacaacttaaatgcccatgatttctccttccttattgcctgttttgtttttttgagtgtgttccaattttctttcctcatgggtaatgttgctcttcttatttgactataaactcagtgaatagagacattgccctattctgtgctgtgccctggcacagaactgattctctctatacaagtcttactgttaaatttgctgcagtatgtggtgttggcaaacagaaactttcattacacatctttgaatcccattgcagcctcattaatattcttccctgttgtagaagataggtcactcctggtctttttccagagattcagttactatgtgctgaaaagatggccttttgtggtagtctcagtgggtgttccctatagactgtgttttgaaaggaaaagaataaaaatgatagcatattttttcttagttagccttctttcacaaatcctaggaaaatagataattcactgctgattaaaaaacagaacaaaacaaaacaaaacaaacccccctgggctttccaaaatctggttatattgctttctatgtgtcctgaccctactattatctgtcatttacctttactaaatctcactattgattgtaaccatgtaatccttttgattgttctggtttttctggaatgctttgttggtgataattatctagttgtcttttgaaggttgattgtaagtggctggagaagatgagggaatactcttttttgtttgtttttgttttgttttgagatgaagtcttgctctgtcacccaggctggagtgcagtggcacaatctcggctcactgcaacctccgtctcccaggttcaagcaattctcctgtctcagccttccgagtagctgggattacaggcgtgcaccaccacgcccaggtaatattttgtctttttagtggagacagggtttcaccatgttggtcagcctggtctcaaactcctgacctcaggcaatctgcctgccttggcctcccaaagtgctgggattacaggcatgagccaccatgcccagctgcgggaatactctttattaaaatttacctacagcattgcattgggttgcttttggggttatagaatatttaagttaaaatattaacacattgtaaaataaaaaagtaacgggaaaaaaggagttagaaaaaggaagagagctggtgtccaagtcctagtttacttttttttttttttttgagatggagtttcactgtgccacccaagctgtagtgcagtggcatgatctcagctcactgcaacctctgcctcccaggttcaagcgcttctcctgcctcagcctactgagcagctggaattacaggtgtgtgctaccatggccggctaatttttgtgttttttactagagatgatgtttcaccatgttggccaggctggtctcgaactcctgacctcatgtgatccacccgcctcagcctcccaaagttctggcattacaggcgtgagccaccacgcccggcccctagtttacttttaagtggaaagatgagaaggggccatcagacaaggtgatgtgtctggcaacaagtgaagagatcatagatttcatttccacagataagtcaatacagttatttaggaaatgagaaatctctgactctggtctttgtgtaatattctatgatagcagaaacaaaaaattgaattgtgcctattgttaaaagtttactttgtttatgatttctactgtatgaaattatatgatctgggttatattaacacccagtgaaaccaaggggctgggttggtacactgaaagttattataatataattctcatgtgaggctaattgttactatatttgtttttaatttgactagaaatcccaatatttaatcaaaagtcttctcctctacctagagcttgttttatcgttttggtggcctcctcttgcaaaggactggctggtgaatggtttccctgaattatggacttaccctaaacatatcttatcatcattaccagttgcaaaatattagaatgtgttgtcactgtttcatttgattcctagaaggttagtcttagatatgttactttaacctgtatgctgtagtgctttgaatgcattttttgtttgcatttttgtttgcccaacctgtcaattatagctgcttaggtctggactgtcctggataaagctgttaaaatattcaccagtccagccatcttacaagctaattaagtcaactaaatgcttccttgttttgccagacttgttatgtcaatcctcaatttctgggttcattttgggtgccctaaatcttagggtgtgactttcttagcatcctgtaacatccattcccaagcaagcacaacttcacataatactttccagaagttcattgctgaagcctttccttcacccagcagagcaacttgattttctacaacttccctcatcagagccacaagagtatgggatatggagaccactaaaactacatccctttggccttaccagggaaatattgggaaggaaggaccttgtattactacctaatgaccccatagtattgtttgacagtctatacaaccagatgagcaggcaaggtagtaccctgctaaagagacaggctttctcatatctcataaatatttcacatcctggttctacatgctggttttattccatattagccatgaggtcttcagcaaattacttaatgtcattaaacctcaatttcttcatcctgaaaatgaggatgataataataagagtatatatctaataggcttattgtgaggattaaattaggtaatataggcaaagacctagcatacagtttgcttacaaacatcaacaaaagaaagagacaggaagagatgaagtgtgcaagagagagtgagagcaaccatcaatgtcagacagccaaaaaatgggcatatagatttttttataaatagacctcatatgtctcatttgcatgggcttttgggatgattaaagcctattgttctctaggattacttgaaatacacatttcctgcaggttacagcccaatggacacagaatgacttgtgtattagtccatccattctcacattgctatacagaattacctgagactgggtaatttgtaaagaaaagaggtttcattggctcatggttccacaggctatacaggacgcatcgatggggaggcctcaggaaacttacaatcatggcagaaggcgaaggggaagcaggcacatcctacatggctggagcaggaggaagagaaagcaaagggggaggtgccccacatacttttaaacaaccagatctcgtgaagactcactcactatcgtgagaacaccgcaggggaaatccacacccatgatccaatcacctcccatcagacccctcctccatcactggggattacaattcaacatgagatttggtggggacacggatccaaaccgtatcaacttgtatcattctgagtaattgcaactttcgaatgggtggtagggttggcaattgccaaaagccatggtttggagtcacttgcatcaggcctgggtttccccctggagcaggctgagcttggctgccttctaaggcctcttctgctctggacatttacaggcttctgagccaggagagaacactaagcaatgaaacacaggaggaaaaattaaaaacaccacctttaaattttggaaagtattttggagatacctgtgccctgctctctaaggagttcctgtagggatttctgcttatgaattccagtatattgtttctctttgggatgacaaatggagtttctgttgccacaccttgccacagacccactttttgaaaaacactaaaatccactttgcaagtgtataaatattgcaggcaggcagcttccacattctttggcaagggaacaaaatactatttaataatgcaggttccagcttttctcctgacaatgcaaagtgccaatgattattgaaaagggaatttgaaatctgccagaatccactcagttttccttgtgtggttacatttccatcctgtcaccctcgctagtgaagacaattgtttcagccattgagaaaaaaaaaaaaaaggtattttataagattgcaagaaagtgatttaaaccatgactatgtctgttaactgtttgctttgtttctctgactgtgtgcctctctagtcacccaatcttctttagctatcctgtgggctttttcctgttgtcaaaaagcatggtctacccaaagccattcttcaagcatctgatttcccagctgtctttctgctatatatttaaacttctagttctctttggggaagagggtggtagacttgtgtgaggatatagtctgaatgaagtctccgagtgattttttgttgatgttataggggtgggagttcggggagaggagggagagtctttggcctcacactcccctctgagtcctgaatggggttctctcagcatctcattttcccgctattcctgacacactcctccctgaccctattttagaggtccctgttatcaaatggaagtgcttcttatgtcttccttcattctgctaagctgactgttctctatagaaatctgtacccccagcttttctaccaatgcgaatcttcgtttttggaaaatttcttttaccttctctaggaaatcattctctacatcactctatttctttagcaatcagggactacatttggatgtataagtatatacatattaagtttctagatattctttttctttttttaaaattattttttattttattattattatactttaagttttagggtacatgtgcacaatgtgcaggttagttacatatgtatacatgtgccatgctggtgtgctgcacccattaacacgtcatttagcattaggtatatctcctaatgccatccctcccccctccccccacgccacaatagtccccagagtgtgatgttccccttcctgtgtccatgtgttctcattgttcagttcccacctatgagtgagaacatgcggtgtttggttttttgtccttgtgatagtttactgagaatgatgatttccaatttcatccatgttcctacaaaggacatgaacttatcattttttatggctgcatagtattccatggtgtgtatgtgccacattttcttaacccagtctatcattgttggacatttgggttgcttccaagtctttgctattgtgaatagtgccacaataaatatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgttattttcttgtaaatttgtttgagttcattgtagattctggatattagccctttgtcagatgagtaggttgtgaaaattttctcccattttgtaggttacctgttcactctgatggtagttttttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccactttcagctttctgcatatggctagccagttttcccagcaccatttattaaatagggaatcctttccccattgcttgtttttctcaggtttgtcaaagatcagatagttgtagatatgtggtgttatttctgagggccctgttctgttccattgatctatatctctgttttggtaccagtaccatgctgttttggttactgtaggcttgtagtatagtttgaagtcaggtagtgtgattcctccagctttgttcttttggcttaggattgacttggtgatgtgggctcttttttggttccatatgaactttaaagtagttttttccaattctgtgaagaaagtcattggtagcttgatggggatggcattgaatctataaattaccttgggcagtatggccattttcacgatattgattcttcctactcatgagcatggaatgttgttccatttctttgtgtcctcttttatttcattgagcagttgtttgtagttctccttgaagaggtccttcgcatcccttgtaagttggattcctaggtattttattctctttgaagcaattgtgactgggagttcactcatgatttggctctctgtttgtctgtcattggtgtataagaatgcttgtgatttttgtacattgattttgtatcctgagactttgctgaagttgcttatcagcttaaggagattttgggctgagacaatggggttttctagatatacaatcatgtcatctgcaaaaagggacaatttgaattcctcttttcctaattgaataccctttatttccttctcctgcctaattgccctggccagaacttccaacactatgtcaaataggagtggtgagagagggcatccctgtcttgtgccagttttcaaagggaatgcttccagtttttgcccattcagtatgatattggctgtgggtttgtcatagatagctcttattattttgagatatgccccatgaatacctaatttattgagagtttttagcatgaagcgttgttgaattttgtcaaaggccttttctgcatctattgagataatcatgtggtttttgtctttggttctgtttatatgctggattccacttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcgtggactctttttggttggtaagctattgattattgccacaatttcagctcctgttattggtctattcagagattcaacttcttcctggtttagtcttgggagggtgtatgtgtcgaggaatttgtccatttcttctaggtattctagttgatttgcgtagaggtgtttgtagtattctctgatggtagtttgtatttctgtgggatcagtggtgatatcccctttatcattttttattgcatctatttgattcttctctctttttttctttattagtcttgctagtggtctatcaattttgttgatcctttcaaaaaaccagctcctggattctttaattttttgaagggttttttgtgtcactatttccttcagttctactctgattttagttatttcttgccttctgctagcttttgaatgtgtttgctcttgcttttctagttcttttaattgtgatgttagggtgtcaattttggatctttcctgctttctcttgtgggcatttagtgctataaatgtccctctacacactgctttgaatgtgtcccagagattctggtatgttgtgtctttgttctcgttgctttcatagaacatctttatttctgccttcgtttccttatgtacccagtagtcattcaggagcaggttgttcagtttccatgtagttgagtggttttgagtgagtttcttaatcctgagttctagtttgattgcactgtggtctgagagacagttttttataatttctgttcttttacatttgctgaggagagctttacttccaactatgtggtcaattttggaataggtgtggggtggtgctgaaaaaaatgtatattctgttgatttgggttggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatgcatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctgtgtgtgtcactgcacatgagatgggtttcctgaatacagcacactgatgggtcttgagtctttatccagtttgccagtctgtgtcttttaattggagcatttagtccatttacatttaaagttaatgttgttatgtgtgaagttgatcctgtcattatgatgttagctggttattttgcttgttagttgatgcagtttcttcctagcctcgatggtctttacaatttggcatgattttgtagtggctggtaccggttgttcctttctatgtttagtgcttccttcaggagctcttttagggcaggcctgctggtgacaaaatctctcagcatttgcttgtctgtaaagtattttatttctccttcacttatgaagcttagtttggctggatatgaaattctgggttggaaattcttgtctttaagaatgttgaatatcggcccccactctcttctggcttgtagagtttctgcccagagatccgctgttagtctgatgggcttccctttgtgggtaacccaacctgcctctctggctgcccttaacattttttccttcatttcaacttcggtgaatctgacaattatgtgccttggagttgctcttctcgaggagtatctttgtggcgttctctgtatttcctgagtctgaatgttggcctgcctttttagattggggaagttctcctggataatatcctgcagagtgttttccaacttggttccattctccccgtcactttcagatacaccaatcagacgtagatttggtcttttcacatagtcccatatttcttggagtctttgttcatttctttttattcttttttctctaaacttcccttctcgcttcatttcattcacttcatcttccatcactgataccctttcttccagttgatcgcatcggctcccgaggcttctggattcttcacgtagttctcaagccttggctttcagctccatcagctcctttaagcacttctctgtattggttattctagttatacattcttctaaatttttttcaaagtttttaacttgtttgcctttggtttgaatttcctcctgtagctcagagtaatttgatcgtctgaagccttcttctctcaactcgtcaaagtcattctccgtccatctttgttctgttgctggtgaggaactgcattcctttggaggaggagaggcgctctgctttttagagtttccagtctttctgctctgttttttccccatctttgtggttttatgtacttttggtctttgatgatggtgatgtacagatgggtttttggtgtggatgtcctttctgtttgttagttttccttctaacagacaggacccttagctgcaggtctgttggagtttgctagaggtccactccagaccctgtttgcctgggtatcagcagcagtcgctgcagaacagcagattttcgtgaaccacaaatgctgctgtctgatctttcctctggaagttttgtctcagaggagtacccggcagtgtgaggtgtcagtctgcccctactggggggtgcctcccagctaggctgctcaggggtcaggggtcaggggtcagggacccatttgaggaggaagtctgcccattctcagatctccagctgcatgctggggagaaccactgctctcttcaaagctgtcagacagggacatttaagtctgcagaggttactgctgtctttttgtttgtctgtgccctgcacccagaggtggagcctacagaggcaggcaggcctccttgagctgtggtgggctccacccagttcgagcttcctggctgctttgtttacctaagcaagcctgggcaatggcgggtgcccctcccccagtctcgctcccaccttgcagtttgatctcagactgctgtgctagcaatcagcgagattccgtgggcgtaggaccctccaatccaggtgcgagatataatctcctggtgtgccgttttttaagcccgttggaaaagcacagtattagggtgggagtgacctgattttccaggtgccgtctgtcacccctttctctgactagcaaagggaactccctgaccccttgtgcttcccaagtgaggcaatgcctcaccctgctttggctcgcgcacggtgcactgcatccactgtcctgtgcccactgtctggcattccctagtgagatgaacccggtacctcagatggaaatgcagaaatcacccgtcttctgcgtcactcacgctgggagctgtagaccggagctgttcatattcggccaccttggctcgacccctctctttttcttaagaatatatgaattcctatgaagaatgaaggtttagtcttgatttcatttcccttcctatcaactggacaataaaaatttgatctttaataaatataattgaagacttactgatacactgaagcctattctatttcaaattaatgttttatgtcttgggcatgcttcagaagtaaccatttacataacaattcttctaaggcataatgttgcttaatcaatttagcatgatatagtgaaagttaagatttatttttacttttctgaaataaaatgcttaatttttatattcttccaagtaataactgtcatatgcttatatggggaagattcaaaattaatgttttattataacccagtaggggtgggtctaggggagggatagcattaggagaaatacctaaagtagatgatgggttggtgggtgcagcaaaccaccacggcaagtgtatacctatgtaaagctgcacattctgcacgtgtatcccagaacttaaagtataataaaaaattgataaataaataatgcaaataatctatatttacaataataagtgagggtatgctcttgacattttatttattttttaattgtacacttttgccgtatgtgcattttgctggtatgtctctgaacatgacctttgctaaattaactccttcctgactttacttttgttccagtgaggggtgtttggctgttcttctttttggtttaaaaagcctttatattacagagtggtcagtttgctgctagtcactgagaagaaatgtaatgtgtatcctgatgactggatgacttataagcttataatctttttgagctctagtacatacttaactgtacttggcttctgaccttaaacatcattttccaaacagtcttgatgtttggtaaaaccagtaaccatccattactctcaggccacatcagacctgcttacagatatcactgggtgaaacatgagtacacttgttcaccccaagttcctttcagaggccttgaaggacactgctaaaacacatccagtgagttcagggaccctgatcacaggaagaatgcctgcctgatgttggaggaaggggtaaagccaacgcctgaagctttctctgtgcttctctgtaacagtcaccagagctacaggccagcagcacttttcttttacatggcaccttcctctcatttgtggggaaaataaggactttattagttcttccatttctcttaccctctcaggattatagctttatcatccaaatgccaggaaagtaaaacaaaacaaagttagacaatctaaattaaactctctcaacattatagggatgaaggaccttcagagtactagaacttcttaaaaaaaatctcttgcattgctacatcagtttccaacacacatattatttcattcaaatgttaagaaggggaaaagaatgttacagtgtactgtaattattttaggttcatgatgaaaatgctttacaagggtgggcgcggtggctcacgcctgtaatcccagcactttgggaggctgaggcgggtggatcactaggtcaggagatcgagaccatcctggctaacatggttaaaacccgtctctactaaaaatacaaaaaattagccaggtgtggtggcgggcgcctgtagtcccagctactcgagaggctgaggcaggagaattgcgtgaacccgggaggcagagcttgcagtgagctgagatggcgccactgcactccagtctgggtgagagtgcaagactccatctcaaaaaaaaaaaaaaaaaaaaaaaaaaagaaaagaaaaagaaaatgctttacaaatatgaaaactcctccctggttttttttgaaagcttaatgtttgtctaacaaaaccgtaaataggattctataatattgatgttagaaatgaatttatatttttctagttttaagggaatagctgtatattactttagatggtggtactatataaaaatatgttttcccattacatccaaaggtgatgatattaatttattgctagagaaagaattgatattgagttatagagattttccagaaggtattttaagaccctttgctggtcctttgtgactggcgtcatgtatgttacacagcaggttgaaagtgacatgctgtgattctggaagagtgtgagtctattggccctgtaacccatgagcttgttttcactaacccagtgctcaaagcaaattaattcacccacgaagtttgctttaacacttatctaagcgttactatcaatgttctaggaagtaacaagtatcattgctgatatacagctctgagttgactcataaacatttctgatctcatgagatagttgcagtggtgttttgctgtgtttactagatgcaactaacaaacaccatgagatttacaaagagatttgaagatatctgtgtctccaaaattgattgcaaggtgtagcaggggccagtaaggtgagctttcttccactccctagaatgtcttcctcaatccagattttaaagtgtattgaaatgatagccggctgaatcaccaggtcgaaaggatcaaccaactatttattaagcacttcatgtattttctgtcccatagagatttcagtgaaagatatagtgtggataaaacaaagagaaaaaagtgtcctcatgcttatgacttaatcgcagaagtggaacttagacatgtgaaacaattaaacaatttcacaacaacagataagcaaatgggatgctttggagagacatctggtccctgtgctgtttatagccaattccagtggtgaataaaagaagtggaacgaactgcttttgaagggagtgcatcctgatcctctggcagcaaggtagaggttttctgccaggagggaacactagacggaggctgtttgttttttctccaaacagaaatctcttccatgctaataggagcttcaaaaggattgccacagcagatggaaagaaccaatatatattcatgcatttaattagcaggaattaattgaattgggggattaattctgtcattagagagaaacaaaacctatttttgtctcccatctatggttacacaatctaagatggatttggcacaggtggtgtttgaatataaagccaccgtagtatctaatggccttttgatgccactgatggattaatcccagggatgatgagaaggtagccatgtgagatgtgtgctctgcaccatgtttcagcagtggaggagaagctggtaggtggagtgtgaggggtataaacctagaattcagtgagtgtttgaaggaggaaaaaggggaggagattgggagagtctcttctcttacatctgatttttttttctttttctttttcttttttattgagacggaatctcactctgtcactcaggctggagtgcagtggcgtgatctcggctcactgcaacctccgcctcctgggttcaagcaattctcttgtcttagcctcccaagtagctgggactacaggcttccaccgtcatgcccagctaatttttgtatttttagcagagacaagtttgtaccacgttggccaggctgatctcaaactcctgacctcaggtgattcacctgcctcggcctcccaaagtgctgggattacaggcgtgggccacagtgctcggtcacatctgattattaatgagagattaaggacagacacacctaagacagaatttttaattcaatctaacaagcacccattgcctggtcttccccctgcttttctttttttttttcttctccaaaaatctgttcctccagaaaagcagttttcatcctttttaatttttaggccaagatactcatgacataaaccagatgacattgtatgcataacacattcccataagtgacataggtaaaaagactgttgattatacccctttcccaacactgacaagtcaacaccagccctccgactcaaagcacatcacaattcaagtatatgatgtgacagtttgtacttttcaaaaatagccatggcattttctcccacctacacactcatcttgcaatgtgactttgatgctctttccattgaaatgtgggatctacgctctctctccttgtatatgcgcaaacgtggacttcagcaggaatgataccttgggatttccaaggcgaggtgagttgatcactgggctctcttgggatggttgcttttggaacccagccaccatcttataagaaagcccaagaagcacacgggaagcccaggaatcccacatgagaggatccaaggctcctagccgataccagtacccagttactagccatgtgtctgatcatatttgaactggatctttcagctcttagtggagcagctccaactgctgccaggtataacaaagacaaactatctctgcagaacgctgccccaaatgcagatttttgagcaaaagaaataattgggttttaagtcatatactttaccatgcaataatagatagttgatacagagttgcatgtcattagaagaataatcttaaatctgttctaatatgttaaaaaccttcagtagtttaacttttattataacaaataatttgtcacatgtctttttactgattgtgaaaaagtcctctaggcctagataaaaatgcagaggtctttagaaatttatataattcattctttttctcacctcatcttggacttattcagtatgcctatgtagaataatattaattacagtcatttttcttgagctgcttcccatttatgcctcattagcataattcacagcggtcatccatacctgtgaattcgtgttagattacctttgctgtgtttgatgattatactaaatttcatttttttgcgagctaagccttcacagtttgttgctcatgtaccatggctggctgctcacaaaatagaaaaattggacagaatgtttctgataaggtaaatacagcaaaggctatgcagaaatatgtatctcagagagtgagctatggggcagctatggtataagttatctggtagccacgcaagaagtaacggattgaataaaggcaaactatgaagacttcagtcatgataagatcaagagaattatttgtgtcacatttgcgatggattttgtctctgttggcacacacaaaaagttgggccttaaaactgtaaatttactttaacttcattttgtatgtcatgcattcatgaaactttttccgggggttattttcatttttggctgtcctgctccaagttaaacagaggagaaacagcatcatatagtggaagaaactcagacctggggaaggggggaggcaagtaaatgaaacaagagtcctttgtctctcagctggattgctaagtaatctgtgtgatcctgcaaaggtcagttcagatctcaagccctactttcctcatctatgaaatgaaaggttagactaagaccaaatacacgctagaaagtagagtattattactcctcaagaaatagtttagggttgtgactcttgctttgcacatgaaaatatttaggagtaaaagttcacagaacttggcaaagctagatgcatttatgattcccagtgaatcaactgatgtttttccctacgtcttttcaagccattctttgtttagcagtttttatatttacttttatttttttcttctataattttggaaaaaaagagttagctgactgctactatgggcagacaacaatgtggtaataggatattatttttaaaactaaaaaaataactgaatatgaaagatcaaacttttaaaaaatagacataagtgttcagagttgtgattctattttgcatgtaacaatgtagttatttcagttgctttattgagaatcacaaacatatatatatggctttgccaagttctgtatactttttattccccaatattgtcttctgtacagcaataattacaaccttaagccatcccttcagaagtagtcatatgccaacttctaccttagtctaaaataattctttttctgtgtgatggggctaaaaacatcagttctccctgctgctctccacagatgtccaggtaccttaatggttaggttctctgtaccttgagcttatttgcaaggcagagcctcaaaagaactgctttttaaatttttccactgatagaactggagcttggtaaactaacttgcccaaggtcatagcagttagtgatactcacaggacttaaacccaggaggtctgaatgtagactcaattatggcatatcccttcctaataataagccagattttgttttgtacttcttgccaaaatgtaactccatgatgacatttgttttgtacattgctgccttcttactgcctcaaacggggcctggcatggtgggaacaggtggggatcttagtctgttcctgctgctaggacaaaatatcttagactggatcatgtttaagtaatagaaatttattgctcatggttctggattctgggaagaccaagatcaaggtgctagcaaattactctctgcttcaaagatggaaagctcttgctgcatcctcacataatgggaaagcaaaaagaaatgaaaactgtgtcctcacatggtggaaaagatagaaaggacaggcagctttctcaaggctcttttagaagggcattgatttccttcatgagggtggagccttcgtgacttaatcacttcctaaaaggccccacctcttaataccacactggggattaagtttcaacatgaattttggagggtttatacaaacatacaaatcacagcagctgtcttctccctttcctgattccacatgacagaagccatctcttccttccgcacatggatgtctgagcacatccagactcttgagagcccagacttaagagagagaggctgtgagaaggaagatggcagttctctcctggaagtcttgacttctcagtcccagttttctgtgttggtatgtgtactgaaaaacaatttatttgaagatacagcatagaaggaaaaataaaccatttcctatgaagtaatgattcaacttctaacctgtaaaaatgaaaaatttctcagttccctacgcccttgcattcctgtcttcataagtttgtgatttaattttccaagaaacttaatattcatatacttaaaaacttttatatccattaacaacttgactttccctgcttctttgaattttggagcattgtttccttagtatgaaggagttttgagaaaggcaagaagacaagctcagagcttaagaaactatgaagaataatattgtaatcataacaactcattatttgtttttaagctcaatccttcagaaggttattatctggagttgaataataatagattcaggctctttttatgtggaggaaatcttaaacaacagtgttcatagggaaggacattaatcaggagagagaagtgagccttgtttctaataatgtttgcataatagctacccttgggtgtattgcttgacttaaaataaatattcatgcttttcacatccagtacaattggaaactactcgtggttatgattctgtcatatgatcttctacctattcaaggggacttcaaactgggaagctgttggaaaccaacaaacataaataacaatgcttgggagcgatatggggtacaagctgaaagatgctataatgttggctatggggagaaaaggagcgaagagtaggaacttaactgtttccagagggggggaagcagactcacactgacatgcttaaggacatttatatgctctcctggtttgcttttagctcttcaatagcttctcatcaccaggagaataaaatttaagtgccttatcttggtgtcagactcactccttggagtggttcctgtgaaaccttggatcgcgttacctgagactactctccacctcagatgtggcaacacaaagctctttgcagattccctcagacaccatgacttacttttatctctttgttcacatccttccttcatcttgcgaggatttttcaaagcttctttgttaattaatctatgtatcattgaagagtcagcttaaacttcacctgcttcaggaagccttctatgaactccacacctagtcaagagttttacccagactgtcctatttttattaacttatatatttagtgatccttaaatagcctttgtcctggggagttttttcatcatcttgctttattgcttacatgtacctaattttattacataaatgctttcagttagttaattcatttttctttccttttctgtctcctttctcctttctttctctgtttctctctctctctttttattaacttttaaattctgagaaatgtttcaatacagtcttgagaacataggctattttgttgttgttttttttgtttgttggttggttttgagacagagtctcactctgtcgctcaggctggagtgcagtggcatgatctcggctcactgcaacctctgcctcccaagggttcaagcagttctctgcctcagcctcctgagtagctgggattacgggcgcccaccaccacacctggccaattttttatatttttttatttttagtagagacagggtttcaccatcttggccaggctggtcttgaactcctgacctcgtgatccacctgccttggcctcctgaagtgctgggattacagatgtgagccaccatgcctggctgagaacataggctatgttttgaacttctgtgtgtgttacaaggctttgcattaactgctccctcatgcaactttcctaaccttctttctctcctattagagacattctgcttcagtcaggagaacatcctatagtattaaagtccaaactgatttgttctcttggacctgtgattgctaatacagctgttactcagtatctgtgggggattagttccaggaccccttgcagataccaaaatctacagatgttcaagtccctgatctaaaatagctcagtatttgcatatagcctttgcacatcctcccgtacacttcaagtcgtctttagattacttataatacctaatctaatgcaaatgctatataaatagttgttatactgtatttttaaaatttattgtaatttttactgttgtatcattattattattttttgaatgttttcgatgtgaggttggttgaatctgcagatttggaacctgcagatacggagggctggctttactttccccagcctctccttccttgtccttcaacgcagggtttttgataaacaccacatccttggctcattatctgtgcttctaatccgatgggttctatattaacagagatatgtctgcccagcttcacatgccaattttacccttattggtaggctccttctgaaggtccatatgtctttttcatgtacttatgtgcagtcacaaaatactgaaaactgtgccttctgtttatataacatacctatttataaaacactttaaaaattttatcctaactaccgagaggtgagcagtgcagctgttaacctcatttgcaaatggagaattggttcaaaacgattgaataacttccaaaatttatgtgtccaataaattgtagcgattagaattagactccagttgagagcattgttcacattacaaacctgacaacagtgtttttttcactgtctgtaggccttgcagagcctagtagagttctgtgcatgatgaactcaatgggggcactggacacaggctcacacagggtctgtattatggtgctgatttgggcctctatacctccagagaattaagttactttaaactccactatggacatttataaaaggaagagtgagaccctgtgttttcatagggttttttttttttttttacacataacactttgttaattccctttctcttattttcatctctcttttcttctctttttctgttttcttttcagtcagttcaacaattaattggtgtgcacctacaatgtgcaaagcattatgctagggttcacaggggaatgcaaagaggatgctgcttatagcttgttatggcgaggcacttttcttctctccatttttctccattcttctcttcttcctaccttctttttcctctgatgttcaagtagccctcatcatttctataaatttccaaggcttcagcgttggtcaaagggaaggcactcagcccaggggcagtgagtaagtttaacattcttatggtcctttgcatctgctcacccaggactcatacatactcaatataaaagctttgggggttttgctcagtgacagctggggactctatgtaatttaatgcatgatacagcacttttggctaactctgtatgagagactactcaaataggaataaaatatcactttgcaaaatacatttaaattatttttcttctaaaactttgtgactttaaagccttaaaatctattttttgaaagccaaaaaataacagatgttggtgaggctgtggggaaaagggaatgcttatacactgttgttagaaatttaaattagtttagccactgtggaaagcagtttggagatttctcaaagaacttaaagcagaactaccattcgacccagcaatcccattactgggcatatacataaaggaaaagtaatcatcctaccaaaaacacatatgtactcactgttcatcttagtactatttacaatagtaaagacctggaatcaacataggtgcctatcagcagtggagcagataaagaaaatgtggtatatatacaccatggaatactacacagtcataaaaaagaatgaaatcatgtcctttgtaacaacatgggtgcagctgaagaccattatcctaagtgaattaatgcagaaacagaaaaccaaatattgcatcttcttacttgtaagtgggagctaaatcttgggtactcatggacacaaagatgggaacaatagacactgggaactctagaaggagacagggagggggacaaaggctgaaaaacctcttgttgagtactatgttcactgtctgggtgacaggatcaatagaagctcaaacctcagcgtcatgcaatatatccttgtaacaaacctgcacatgcatcccctgaatctaaaataaaaatgaattttttttttttttttttttttgagatggagtctcactctgtcgcctgggcaggagggcagtggcgcgatctccgctcactgcaactccacctctcgaattcaagcaattctcctgcctcagcctcccgagtagctgggattacaggtgtgccaccactctggctaatttctgtatttttggtagagacggggtctcaccatgttggccaagctggtcttgaactcctgacctcaaatgatccacccaccttggcttcccaaagtactgggattacaggcatgagccaccatgcctagcctctcattcctcttctacaccccacataaggtgcatgaatcattagacacgtatatttttttttccctaaggctacgtattcctaaaagtagtttaagttacctattacctctaggcttttttttccataagaatcatcaataaattaaatgccaaacacgtggttgttttctcaagcacacaattaaaatagacttgattcctctttgctgtctccagtcctcttaatattcatagcaataggtatttatctatcatcacaaaacacacaaaaagactggtgattgcttaaatcccaagagggcaaagtagaaggaactagaaagaaggaagcaagtgcaatcatgattaggcagttactccgcatctgtggctgggttaggaacattcataggacttcatgaaccctactaagttacaacctgctcttttacaaatgtggaaactgaggctcagaggggttaaatgatttgcccagtgtcctactgcttaaagtatcagagttgagatttgaacccaatttgcgtgactccagtttttaaaatatttactgtaccaaggctggagggggcacgcatgggccctagaagggtgcgtggaatgggtacctgggtggggaagggttaaagagggggcctcggtctgcttcaccaagatattttccttccctgattcctgccccaaatgtagactacttatccaaaatatggatccaactttgtgtaatattttaataagagggtcttctactaatgggacatctctcttttgtctttcacagcaattttgcaggcagtaatagctggtgatcttatgaaggtaagatatcttcctaccaaatctttggcgatgctttaagaactttaaatcaacatcattcctcatcaaaactctatgttcccatctatcatttatcatcccctgcttgcactggctgggtagaagaggcaggatgttcttttgagaactgagcagagatggtgttcaagagcaccggggtacttgtctcagttacttaaaatgaactgcatgtccccaggatgcaatgtgcacagtgtgcctgccctctagaagctgacatttgaagaatttaaagatttcctttcaggcaggtattgaaatgaatgtatctgtaagaattacctgggcaacactcagaaatgcatccttcaggccagagattaatctttccttgtcgtggttttatactttggggatcatagttagtcaaacaaggactctcatagttagtcaaacaagaaccctgatccccttggaatagtttaatttgtgtttgtgttttctggtgagttttgttcagaaggaaggaagcggtcaccactgccctgagggtgaatgtaaaatctgaagtcagactttctaagtttggatctcggctctaccattcactgtctgtgtgattttgtgtaattatttgattctctctgtgccttagttttttcatcagtaaaatggagtaatattacctctctctttggcttgtcatgaggaattaatgtaataatacatataaagctctcaagactgttcctatttcatggaaggggctctaaaatgttagctattttattaatattctgatagtgtagatctgtgttttttaatagctaaacatggtggaaatacaaatatttgttatataatataacatcatctatgaatattctaaagctatatttggttttcaggcatcaggctgatgactgcccatatgcccctgcaaaccccctgctggaactgatctgctctgtattaatgacagctgcctgaaggcagaggctacgcctgactcctcagcctgtggagtgaggtgccattgcagatcaaggaaccaatagccctaagagaaagctgaacagtcctaccctcagacataactttttttaggcgcatctgttggacaaactgaaggacacctgtgctgcatttttcaacaggttactagaggaaaacaaatggtgaaaatgtttgcaaacatcttgatcaactgccccctttaggcacataatcctgaaaacggtgcctgtgccactgcccagatcatagtgtcaatagaaattgttacccagaagagaagagtgctctccaagcagtatattgatgagttcagtgccgtttcttaccagtggattaagcccataccatcctgtactctgtgcaaggccttccattaggttttgtgggaaacaaaggcatgaataaaattgattcctgcccttggtggatttctacaccagaaaattttgcaaagcactgtacatttgaaacccttccattttattttctatatgcttttagttcaggcaactgatttcccaagatcctgagtttattatcacacttttttttgtacttttaaataaagaatcatttgcaatgtgggaaatcactatatccagctggttgtcttattataggttggtgcaaaagtaatttggtttttgtcatttcagtgacaaaacctgcaatcatttttgcaccaacctaatgcattctctgttataattctttcctaaatgactaaaacatgacttaataacaccttattttgtttttgtttttggagatggagtctcgctctgtcacccaggctggagtgcagtggcacgatctcggctcactgcaagctccgcctcccgggttcacgccattctcctgccttagcctccctagtagctgggactacaggtgcctgccaccacacccagctaattttttgtatttttacttgagacggggtttcaccgtgttagccaggatgatctcgatctcctgaccttgtgatccgcttgccttggcctcctgaagtactgggattacagatgtgagccaccgcacctggccaataacaccttatttactgagagatggaatatttactgagggcttaaggttttactttttctctcttacatattttcttattttccttctcaaatattcatgccctcttcctcttctccaatatcttttgtttctttcttctgagcagaaagtgcaatatatataaaatattaaatgggatacatgtgtatatgtttgtatgagagagagggagagaaagagagagagagagagagacaaagagagcgagagatagagactagcgaagagaacatctctggagccacccctgtgtgaaggctgtcacaaatagctcctggacaactgggctgcagaaagtgtccgtggactaactgaatgttcatggtgtctagaaacagcacaggaaggcaggatcaaggcagttgaccctgaacaggtcccatgctgctatcctttgtcgatctccccacaaagaaagggagtgtcattttaagacaacgcagttgaatggaacaggatatccttttagagttttgtggaaaattgctagctacttcttcctgccctcttgccccccagtttagggatgttccttacctccattgtccttacctccattcagctactgctttggatccatgtcctgggaggtcttccgtggctgtttccatcccctgcttcatgcttccctagtgcttctctgagacctttgtgatgttcctgtccattactgtgtgattctttacctatccgtctccaccatgggctgtgagggctttgagcacagtgactgaattgtattcacatttatcttcctggcatctagcacatgacaattctatggatgtatttgagtgaagacgtgaactctgaatttaggttctttttttaagaaagtatttttaattgacaaatgattatacatattaatagagtacatagtgatgttttgatacgtatacagtgatcagatcagggtaattagcatatccaccacctcacacatttatcatttctttatgttgggaatgttcaacatcctccttctagctatttaaaactatttaatatattattaactatagtcatcctacaatggtatggaacactaggacttattctttgcatttaggtcatttatgctctttcaccttatgggatgtttgattatctataatgtgtgccatctaacttcttgagagataatgtgttccttttgcttattacctgctgggttatttaattctcatttgtcctaaaattacctgttagaagcttcatgcaggcactcttgtcatgaaatactgtagtttggagatgagggactcattcacattttctgtaatgttcaatattttataaacttagaccatatcctcatgtagccaccttatcctcaggctacaaaattctgttttgttttttttttccagtcttctctcatatagaaactactacattttctgaatcattttgggtctcactctgtggattatctctagcctattaggtatgtgttggatgattaacagaaggtttgcaggctgggctgcatatctggatgaagaaggaagccagatgtgtgttcgtgtgtgtgcatgcatgcatgcgtgtgtatgtgtctatacttgtattcagtgatcttacatgggagaaaaagaagcagctttgatatttggtatataggttcataagactgaagaaaaactgaaggacacaggcaagaagcttagctacagtcaccaagctatttctgcttatagccataattactctttcactcaggagaatgctaagccaacatagagatgcttttgttctccactccacccctcactactccttcgagagagagaccatagagaccagtgctcagaaaataaatgaaaaaagtaattcagcatgattcagtttccctagcctgttcaatacccacagactctctccagagttagaagagacactggtcatctctgtgagtgataacacagtccaggaatgttacttcacctttttgacttttctctatgtcctctaaggctggaaacattgtggtctgctacatgactctcattttattaccggttagctgttatccttgttccgaattctgcctgagcttctttttgtatgtctctctttgcagctaatagaaagctataaaaatggaggcagtctgctaattcagggaccagaccactgttcactccttcactacgcagctaaaaccggcaacggggagattgtgaaatatatccttgaccacggtaagtaggcatagtgaacttaccaaggatcacttacctgtgaaatccattgcattttgcattttctaagttacccttcatccaggcagttttcagaatggcagaaatactctcgaacttttagcagactctgcccctgcttatttgaggcagtcgtggttgcagaccactgacacatacgggccatcctatccaagcaattagtagaaacagtgttcataccaagctctttacaggctatttttcagactaattagtttttttttttaaatagaggacaaaaataaatgcagcctggcatcgtgtgctttatttttttctagagctcttctgtaaattaatgggttgggattccctacctcacctgtatttgcggttcatcgttgtgaagattcatgaggataattgttttgcatctttccagtttctcatttttttttctgtttgatctcatttatcttttccacccaagttacgctttattctctttgaaaatgtctggtactattgtgttgtctgtggcagatcatactaaccttccagactgctttctaactggatttctaatagttggtgccagatcgtttgcaggaagtagcatgcgctatagcatctgcctctaaaaaccctttggaagcataaacatatttaatgaataccaaatctaaactgttacattgaatttatcatgttttgtagtatttctaggaataaagaacaggaataaaggggaaaaatactgcctagctagtctgttttaaatgagaaggaatgaaagagtctaattctgctggatcttggtatacagagagattggaaaagtttctttgagccctgacagtcagcctgtggctgactccttttgtacccaaattcagcctgtagatagtaagcatactcataaacattcacatcctttttgctccttttttttttttttttttgcaattcagcaagtatgtcttattccattcattgattcattcatttaacaaatatttgtgtagtgcctaacaggagctgcctgttatagatggtacacagacaaaaataaaatacagtcactgttttcaagcaattgcaggctaaagaaaaaaataagatcatgtgtataattaaatttaaaaccgatatatggagctgttttaagtcctatggtaaagccacagatagataacatagctaccatttatcaagcacatatttgccaattgtttatagtaaacacatcccgtcatttgacaaggtccttgcaaggtaggtactaaactatcaatcacgttagacaccccttgctttgtcttcaacaccttctcactgtgaagattctgcttgaacccttggtctgaaatacggtagaaagggtgggttagaaaaaggaaagaccatgaaaacaggagggctgcgatgacagcatttctttactccttgtaggctgggttggataatcccaaacctgtctgccctggaaagcctaggtagataggatgtatttttggtgctaagtctggggcttgtatcattccatctcctatttccctggctattcagtctcttgcagttaaaagcgttcctttctgggcaagagtgaagccacactaatatctcaggatttctactgcacaaagctcaggtgagggttagatgtatactgtcactttatttttgtttagctcaggtttaaaattctcctatttgctgtcttcttgatcacttccaatctactctctttagtttaccctttacccaagagattgaatgcttgcttggataccttaagccatttggtgcccacctaccctctctctggagttaggtgagacactggccatctatttgagtgacaacacaatccaggaatctctctctccacacccccccacccatcttttcacctttcctggagaagcagtatttcctcccctagtcctaggatcctctctgtatccaccgtctcacttggtctcatttaggaggctgcagtcagctcctttttttgatgaggctttgttgaagatggactctcacatgtttggggctttcagctgggagggctgtggaaggccaggacacctaagcctttctcaacacctcgtctttttttcccaagatccttcacagcatggtagtgctggggttcccaggggtgagagtggaagctcccagatgtcctgaagctaagctgggaagttctggatgatctctactgcattctattggctaaaacaagtcacagggccagcccagatttaaaaggttgggaaacagattccactgtttgatggcatgagctgtgaaaaattcatggagatatttaatctaccacactcccttatgtcccggtctctgcagtttaaagtgaacaatgtcctaaacttctgactcacctggaatcccttagagcttcgtttttctatttgactttggttctgggtcttaagaaccccagtttcacaaataaaaataccagatggccgggcatggtgggcccatagtcccagctacttgaggctgaggcagaaggattgcttgagcccaggaggtgtaagctgagtgagctagaattgcaccactgcactccagcctgggcagctgagccagactctgtctcttgaagaaaaaaaaatgataacaataatgaaggttttaacataagtatagcccatgcaatatttgaaatatgattatactaaaaatgaaaacagcagaactcctcatctgagttgccccagggacatgaatgatgagtcctgtgccccagggacatgaatgatgagtcctgggatgatatcaccttaacacagtagcttttcactttctctacttcctctcttcccctgcgtccaaaaatagggcctttaaaagcaccgttcatccaagctcacaggccttggagtttctaaccccaaatatagatcagtacacacctactttgcctggcatcaattcatctggcacattagtctctgagggccttgatcaaaacctaacattccaatacaaatcagtttctcatcaccccgcattgactcttgcaagactgagtcacacaataccactccgcccaaatggaaggacacaaaggaattcagtcttttttaggggggtgggggtgcttatttttccagtgctttggttagatgttataaattaatcagcttaatatttatgctcacgagaagaaacacaatgttcacagtaatcatcctaacttcacttccaggcaaacaatttctgaggtctcagaaggcatcctatacctttcctgcctcaccaggatctctaatagcacaggaagaaagactgtggagatgggagagcacaatccatctcttttgtttgtaaagaaaatgttattatgatgttcagtccaaggatcaccgcatttttgatggatggcaatttttaacactttactactatagctgaatatggagacttaaatgcaattgattcttactgaaattagtttttatcaacattgatagacattgtcaatttcatttttgatgtctatcttatcttttttatttattcagaaatacggatgtaaaatcatttgatatagcctaattcacctcattccacaagagctaaacacttcagctcaactgtcgttttgttttttaatatctttagttgctgattcagtttatattaacctttgcattttattgaaaactatcatagcaaaaccattcctctcttttagatgatagaaactcctttaaattatagtgttcttgaagtcagagacaagtacacagaaaacattaccctttttcaatactgtaatcaccttcttaaggtgatctctcttgattgaaatactctctcctaacttagtaatgatgataactctggaatatcctgacctgacaaagaaatcagcctttccaagaggcctcagtaagtctgggatttagggatgtataccagactatggcattgtatttttaaattagcatcagatttgcagtaggtaagtctgatcagtttgaattcatgtaaatgaaaaaaaaaataacaaataaaaattttacactatgccgaagatcaagaaagacattcctcctggttattgaatattgcaaatctcttaaagcctttgttgtttatttacttattttttacaatttggtttatgtctgtcccatggtttcatatgacataaatctgaaaaattgttcaaagacttgactgtaaggatgcctttagtaatagcaattctgaaggattcacaggctctttgccaggtgcacagctgatgttgtttgtggctcttgagttgacacttcctttgcttcctgcagccttactcctgagcccctctcccctctgctctgccctcttcttcattggctctggtcaggagtgtgggccgccaccatcaagaggacacctgaacaagagtcctgagattagttattctcccagacacaacaagcagcaactgatttctcttctatgggctcttttaaagcaggctgggggctgtgccacatgagatctgcggtatgttctgaaagcgccatgggaggcttgaatttttttcggcttgcatcttcttcctttggatgtcttctctcatctatacagcatgctgctttcctttatgaaaaactggaatttggacatttagagagttgaaaagagactcggggaggaagagttaataattccacagagactgggagagagactaaggatgcagggattccagctgagattcctctcagtgcttcccgcttttcagctcctttcaaccatattttctgcccgctccctcccccctcgtttgcccctccaaccctccaagggacttttgtgttgtttctttccttcgccaccctgcacactctgctcttttgtttttattctccccacgcctaccccattgcctcctactggttttcctgatagaaatctcactcatgcatttcctttttgatttcaatgggttattttgtcttccctctttttctgtcttcagtctttcttttctctttttttaacccccctttttctgcctctggtcccagagagaactgaccaccatcctgctgggacaggatgacagtactgttagcattcccagtgccagctctccccacatctgtgcagcttttgtcctgtggcaggggaggatttggaatggtctgctggcagcgtcagggagactaatgggaaatgagggcccagagagaggccatgggaagtggaaggaatagcaaaggggatttggaggcattggtgtgggaagcaaattaaaggatgcatgtgacaaaaggcacgtcatatataatacaaatataatattgatgacaaagtcacatcagcgggagctggggtatccaacagaagagcctatggaatgagtactgggcagcaacattgtaatttggaaggcctggctgcttaacacgatgttcactttctcattttgaaagatttgtgaagttttgcttcctttcgcattccctgggtgtctcctgaatactgatgtgtatgtccacttaacagaattttctttcccttagctttcagaccatttcccatatagcacagtcttttgaatccatatttcaattgtgaatctttctcttaaagtgatattggctgggatccaaaatggctttaaaatgtcgtttattcattcattcattaaaacattttaattccgtcccaggcacttttgaggaaaaaaaagtttctgtaacaatcactgctaacctctttgttctaaatgttctaaatgcattatcatatttaatttttacaaccctatacagtaagctctcatctccgtttgacaggtgttgaaaactgaagtatggtgaagttaggttccttgccaaaactcatccatacgtgagagatggtctgtgtcctccatattcctaataccagcaagggaaatgaaacatggataaataaccacaatgcagggtggcaccacgtgaatgtcgtaagcagagttcaaatgacaactgatctagggttctggaagagcagaggccgttttcatctgaaattttcatggagaaatctgcacccatatctcctcaatagggattttatagtattttttctggttcaggtcagccaaaggatgaagggtggacatttcagtaaaccctggaagagacagagacctgagatttccttttctattgaggaaacaacagtgaattctctgctgacaatttgatgatctccctcgaaattccttaggggagatggcatagtgtctgcaatcagaacgtatgtgtatataaaacaagccccaaactcaaatgttacccattcatatatgttgaaggaattcaattatctttatttttatttttttgagacagaatctcactctgtcacccaggctagagtgcagtcatggctcactgtaactttgatctcctgggctcaagcaatcttccctccttagcctccctagtagctgggactacaggcatgtaccaccacgcccagctaatttttttttttttgtagagttggggtcttgctatgttacccaggctgctcttgaattcctgggctcaaacagtcctcccacctggctgtcccaaagtgctgggattacagacgtgaaccaccgtgcctgactagtctttatttttttctctcttgtttttctccttttgtctcgtttcctttattagtgagactcaaattaacttttcaaaaatcacaggtgttattgtttctacactaaaagtcacagggtacagttaaactccacattgtacagttaaagcatagctccccattgggcagtgcaggttcaaataaggagaagaacagccttgtcttaggcttctcctggcatccactctctgtaactccttccttgctagcattatgcaaacagttatcctaaagcaggccaaaaatgattagaaaatgtacctgtgcttttaaaaatagctgcccattcccatctgtagtcagctggctgctacttttgcctcttcttggccagtgttcagaacattctgctattttgtgattatctatgttgatgggagaataaggaaagttgaagttaattaaattgattatttcagagccattccccaaaccttttaatgggcattttttttttagatattaattatgagcaaaagtttcttgccttgttattagtgcctctgcctctcacctctgtcagctgcagaggatgaaagggcgtggagggaaggagagtgatgggtagccgcgggcatgcctgactcacagactggataatcagctctggaataattctgggtagtgactctggtcagaaattgtgaagaacagctttcttccttgtccccaccttcatattgtcaaattattgctgtgctagctcaattaaaagccttgaggatcccctcacttgcatagaggcttagaccctggataactgtggactcaccgtggcatggctctgagaacaccgaatgacagagctgaatgaaggagaaaagtaaacaaggcccctgttgcctaaatagttgtgcaattagcagtaccaatgggaacagagctactaatgagtgtaggctgctcatgttcatggaatttcttccaaaaggagtggcttagaatgttcactgaaggcgacaggcactctttaagaggaccattgggtacttaagccccttgctgacgtgaagagtgccctgttggcagctaaataggcctcaggtgcttgtttctcaggacatagaatttgagtcaacaagtgtcttcacatgtaagtgggagtaaagtgaccctttcataccacattccttcactgatgatcccatatcttgatgtagtgtgacctgctgtatcaggacagagaataggacacttcatgctatctaaagttgaagcagtacctgtggtgtgccaggcactgttttaagcacactatgtgtattgactcttttctttctttcttttttttttttttgagaagtcttgctctgtcacccaggctgtcacccaggcagtgagcacaatcttggctcactgcaacctctgcctcctggattcaagcgattttcctgcctcagcctcctgagtagatgggattacaggcacacaccaccacgctgggctaattattgtatttttagtagagacggggttccaccatgttggtcaggctggtctcgaattcctgacctcaaatgatccacccgccttggcctcccaaagtgctgggataacaggcgtgagccaccatgcccagccctcttgaactctcacaacaaccctgtgagataaatattattattaatttgactttacatgggtgataaacaaggagctgagagattaattagacttggccaagacctagtctatatagagctgggatttttaaccaagaagggacagctccagaaacctcgcccctggtcactgtcctgtgctgctctgcacttttgtatgtgtgtgggaggataaggatcattattcatgttttcatagaatcacaggaccaaggaacaaagaggtatgagttaaatctttgttgtttccttaatatagggtaggtgctagaaggatacaaaaaataactgaggtgttcttatattcaacaaatatagaataatttatttatggaaggcatgcattcaaaaagcaaatacatagtatgaggatagaaccaaataagtgctttgggagctgagagaaagaatacattccttctgtcaaaggtcatcttttgagaggaccttgtcacagactagcctttgaagaacatgtcagatttagataggtggctgttctggatagggagagctgggaaagcctgagaaatatgtggttgagtgtgcaattaccactttagcttttgtgaaaaaaaaaaaaatggaaccctgggaacaaattgaggaaatgtagttccagatgaaagactgtgagctccagtgtttaaatacttgcaagtaagcagtagatatgatgtattggaaacctagaaatctagatgatataagaccttcttatctttcttggtaactacttctgcatgctaataatgttccaggcagatactggttaggaagtctatttgtcaaataggacaagcagaaaagacaaataggagagactttgcaagagaagattcacctggtcccagtgaatagcaggtgtgaaagagaagaggtcaagatgatttggatgaccaggagaattatgaaatcccataacatctctgttatgttgtccttggccaatgactttcatggtaagagtgataacctcttccaccccttcttactatgcacaataagttaatttttaataataatgatatccaccaataaagagagcaaattcccaggatcgtctttctaaagacaaaaatactcagtaccttgaactgtgtttggcacttacaagcatatttattcatccattcaatcaaatgtttaagcatctacttatctccaggctctacactagacaccaaggaatgacacaatgctagacaaagcatgggccaaaactttaaggggttttctggagtctagttatagggagagataaatcagtaggttattttaaaacggtttgttacgtgtcatgatcagtatcatgatcatatatccccccttgcctggggtggtcccaacttggatgataaatcccattacccattcaactataggaaatagggtcagtacataaagtgagggattgtataggcaggtgtttaataagctgcttgaagtgggatcatgaagggctttatggggaaaaaaagtctcattggatacccataggctgaagagggcaagagatggcagggagagaagcagtggtacagagctagaaaggaagacattccaagcagtgtttgtagattgaatggattaattcatgaatacacaaaacattgtgaaagggaaaattcacagaatatttccattcctaaggatgcatctatagtcatttgatgtatatgcatagtatttctttctggtctgagaagggaaattttataaaaactggaattgtaccctagatgatacgtatagtatcttacagccttaatattttgcttcataagacgccatcccaagcaactcgtttgagaatgagaaattgccctgattcctaaagcccacctaatcttcccctttctcccttgttagccacttaattatttttcagttattctattccagttttatttcataaacttgatcgaaagctgcttgacagcagagaccataccattcttttttatctaccattctgtacatattggttcatggagattgggagtttggtgatgaggaggtagaggaatccttttatttttctttctgtcttattattcctatccccaaatttagctttccaaggcattttaattctgtgactatagattttctgttaatgtttagtttttgagcttatttttgacggtcatcttgctttcttcttatttaggaccttccgagttattggatatggcagacagtgaaacgtgagtgttgccttttattacatagtctaggttattttcttcagaacatatctgggagaagaatgtaatctatagagcatatcataggtaattttaacttaattaattcaaagtccactttcaactttgttcataaatgtgcagggctaatagcctaaataaaaaattacggaatagaaattgatgacaattgtcataatgcttgcctccatagtcagcgctaatcatcatttagagcttgcttcaaacaatgtacttctgcactggtgcatcttggaatgttgagaagtctaaataattacacttaccttttaatatacccatcacatttattctttctcaactggagtttctgaaaaaatggggccctactgccctaaggcattattcacatgtagtgacataacttctctctgttagtctagaacaggacaagttatgaaccaccactgaagaactgagaacatagtcactctattttctgtcttctgtggttcagagaagggatcctgattgaaaaagtcatcagctctgggatggtgcctaaactgatgataatgtttgttttcaaccttatttctaaagtagcgaaatagctactgctccccaaacaggaacaaagataggctgtacaactaatcctgaaagccatatttgaaaaggtataaagatgagttggtgtggagaggaatgaggtggtgagtagctaagcatgtgggaaggaggagaagtagaaatgaatagaatggaggacgaagagaagcagtagagctgtggaagaagctgtctatcactccatagagctggtccacatgccagcacatcctattggcaagattataagtggtgccatcacttaccccattttgccttctctaaaggctgctattgatttttcctgaaacactttggcgttaagcatcttggtgcctttgggctcaggataggaataccctcctccctatagagcctgtcagtgatggggaaatggccagtttcccttgctccttcccacactgagtggctggcctcaagcctgctgcctcctggggagagccctggctctcaaactctcccagggtctcactgtgcctctcagatatcctctatggctgccccctccttccacctgccactcacacagaatctaaagtggatagagcagagtgggtgttggcctggttctttgaacttgggttctcaggagatactccactgcaggccgagtggccatcaaccaagggctgcgtgctgtgcctgaagggccagaggcgctccacactgctccctgttctttcacccagtgcctttctcgctctgctcaaatgtatgcacagagagaatggcttcagtattcagatacatctagacaattagtctgtttaatactgcattgactatcacctaaatcaaatagtagtagcttttaaaaaaattactaaacttaatcaacactatttggaaagggggctagagtcagatattatgatcagttgatggctagctcaaggaatttttagaaatccccttccctacctccccagaatgtaccctacagccaaagtctcagcagcctacagggaaggaggctgaggagcaccctacatcagctcccctcacccattccctgctgcctccaacccctttatgggtggtttcccatttcatctttgatttaggggtgagactgcactgcacaaggctgcctgccagcggaaccgggctgtgtgccagcttctggtggatgcaggagcatctctgagaaagacggactccaaggtaactcgatgagtgagtgcaaacatcctcccgctgggcgagatcgcaggcgctgttgcctttgcttgtgaccatagcacggacatcctttctgtgcttatggaagtgcctggggctttggaaaaaggaggaaaaaatagagtgcttcatttagagaaactgtgatttaaatgtataagcacaaagggagggcgtgtgcttgcctatggggctttataaacctctgaacacgttgaccttgggactttggggttgtcctgctgagcgctagcagccaagtcatgggagttgaggtccgaagcccaaggagaggggtcaggaccattttcaaagactttggcctgactactgagaagcccctttggggttttccttcagtacttactccaacgtgttttaaattctatgatttatatggccccttatatgggtgccaaagggattctttcccagctcccaggatggtaggatctggctttgagatggtcatagtcttaaatctggtgtgtttatgtagttcttcatttttaaaaaattctttccatttgttttctaatattattctctaaaagttaacctcaggtactagatagcatgggaattactgtcatttataggtataggagctaaaagcctagagaaagttacacatacccttggaccagtagctgaggcttaaattaaattgagctcttttgacgtccagcccagtgttgtatcagcaggttggtggttctcatttggtgccagaacaccccagccacataacaaaatcggtttgtttatggagtctgttttgttgaggtacagtgatacctgtggcacttggcttgaaatgtggttggtttctccacagcaaaagttatgtaaatctgaacttaaagtgtccactttcttaggactatcttaataagagggcagtgaggccagatattgtactgtgacatgtatgccaaccttgatagcatcagctggcggaggtgaggccttaggggaaactctgtttaggagaactgagaacaagctgcaccacgagttgtttaagtttatagagagcacccaagagaaagggttgaaagatagagggaaggaggagttgtagcttagtagagttgaaccagggctcagcctataagaaagaagagagagaaagaggagttagtttacatagaagatcaacaccatagagcaggggtgtccaatcttttggcttccctgggccacattggacaaagaagaattgtcttgggccacacatgaaatacactaacactaacaatagctgatgaactgaaaaaataaaaatcacacacacacacaaatcttacgatgttttaagaaagtttacgaatttccattgagcctcattcgcatccatcctgggtcgcatatggcttgcgggctgtgggttggacaagcttgccatagaggattctgataagctctgagagttttagaacactctcggtagactccaggaaagaatgaaccacttacctatagacacttacagagaagaatcttgatatatagttgaggccttcattaagcaggtaccgagtagctcaggtttggggccaatggttgtaaccatgacacatacatagattacttagaagcctaattaatggcttaagctccattagatttatttaagtgataagaatctgcctatgtgcaatttttttccctggggcctcctcaaactgcagtccactttatgaaataactttgccttcctagtggactttctttcctttctgagccagttgtattacatagaactctccactttcctggcaacccatgagcacccttgctctctgaagtccctggctgcctaggtatatcaaacacacttgagctgtgtcctggtttctagtggtctgttacctgtctggctagctaattgggtacactatttcaaatggcagataattaggttggtgtaaaagtaattgtggtttttgccattaaaagtaataatttctcaatgtgatgttcttcccagatgttatttgcactcagatgttttgatgtttagcctgattgagaaacacacaacttatattcaggattaatggagccaggttatggggtagggttggtcttgccagggccactcagaccacagcagcacaactgcctctttaccacacaaaggctggtcctacactcaactcagatcattttaaaaacagagagaagccatgaaaaagagggacaaaccaaacaggaatcaggagacctggctcttgagcaggtctgcttttttatctttctaagtttctgaatcagataaaagactcaatgttcatggaaacttctttctgttttgtgttgtgtatgtgtctgctttttttaaaaaaaaatggaaatagcttgtttttataattataaacccctcacatagaaaactagtaatgtaggaagatatgctccaaaaagcaaaaaattgctggaaacctcacaacctagacctagatatcattaaacttgtaatgatcccccttcacatgtagatatgcctgtttttctctcttgttgtttttaactagatgaagtcatacatacatgatatcgtataacttttcactcaacgttatattctagaggtcttaccacatgaaataatatagctatacttcattactttttaaggatttttaaattttgccattctgtaacttgatgctagtttaaagttgaatgtgatcattacaactgaatcttctcctggaattttttggagagaagcagcatcctgagaatttctcctattagagttcagttcctcagaaatcacctcaaaggcccacctcagcaacctctctgaatatttggaacctggaaattccaacctcattattatggaagtaaagacacaattatctactaaggctgcaaacaagttgaataaaaattattcaaggaacttcaaactagtggttaacggctaaatcccaagtgaataagtaacattttagaaagattctagagccattgttacttcccttttgtcctctccccagtaggctatgtagagcaggttggattgaggtcgccagtatctgttgggatagccgagatgaaagctgagaagtctctgataatatttataacacttgtgtgcatttgtacatggagctatttatttggtacaatgatcatgcctctacccttcctttggaacttaacataactttttaaatagttaaaactttatcattcaacaaaaattagaaattttgagcgatgccaagtaatatatacaggcattcaaaagaatggacactctttctccctttactgctgacttcttattcagtggcctcatttaaaaaatagcaatatatatatacaaatatatgtgtatatgtgtgtatataagtgtacaaaaggcattatagtagtctgtaagaaattatatgatcatttaacatgttgatgtaaaaaattaatgacaaatttatgatatattactaagaaaggttgtaaaacagtatgtaaatgaattgtggttttgtttttataaaaatacgtatagaggcatataaaagacaaaatctagttatcaatggaaggttagtagtggttatcttagtttggtggaatgattagggatattccttttcttctttgtgcttttcaagctttccaagatttctttaatcaatatctaccacttttgtattgagaaactagcttagtttttagagagatgaaatagcccaagtctgaaaccaataaagaaaacctttcaatttttttatgactatcccttccttttagtttctgtatgttgatttcccaagtttagaataatagaaagagtcctaaactagaaatctaaatgcctgcctccctattttttaaattcagtaatttctacctccccatcttccagaaaggctctgggtttcaaaactcgctttaccccactgtttccttctgtatactgttaacctctgtgaacttctgtttccctagtataaaccccacccgtcaaaagtgataaactctttccctttcatttaccaatcgcacatgttcaatttaatgctcatataagacaatagatttgaaagtgtcttgtaaactctaaaacaccaaatgtgaaaggatccttactagcaggtatccttgcgtagttctgtttctgtgatttttgttttgttttgttttttgtttttgtatttcacgactagcgcttgtgtctatctctctctctctttttttttttctcactattttcgtatagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgcttggaggtacctcagagaggtaacccaggggtcagcccaggctgctgggctgtagccaatagccatgcaggactggttcagcttgggctgtctgtacagctccgtactgcctatgtgtagccatctttgccttttgctgcaatagaagatgagcaaaggattaaacagaggcccacagctagtttgcagaaccactcaattttaagtgctgtttaaattgcagagcaaataatcctgtgtgggaactgtggttacaggaaatggagcactctaacaatgtttacttctaaactttgttgaatgataatagaaagcaccctaattgacttggaaaaaaaaaacagcaaaagcaaaagtagcaacatatgtcaacatatgtcactgaaataggaaacagtcattggaatgttgcacagaggctaataactatagactgttggatacagtggtgagaggagccccattttaggtctttcttttaggtttttggttttcattactccaagtaatccttgacccaagaacaaaggcttgttgtatgagttccactgccagatttatgggatgcctggatcattcagaaggatgcttcaactattatttgtcaggtccaaaggtcgtacttaataaccccattttctatgtatggggtagtctaatatattattttatctactttatttttcccttttcagaaagtccttagtgcaaaccaccattggaatctagccagaaatgtctgtcagatagttagaattgtaacatctaaacctgccacggatcgaatggtacttacaggtacctctcttagggactctgtgatccctaaaatatcagaagaaaatgtctgtctttctgtccaaatatctacttgacttgggggtaagtcaaaaataaaagtaggtgtccaaggattttacttttggcgaaatctgacgtctcctgagcttattttcattttgtccttggacatagcatagtgcttccctaatgtttctacatatgaccatgaatgatagtgtctctacatttaatttaaaagtctaatggtgacattttgcttatctgagtcacatttcggtaacatatcatcattttgaaagtgcggctatgacgtgctatattaaacaggaacagcctttcagtggatggggattttattaccacagtctttccatagtcatttcaaaatcaaattgttggtgggaggatggattgggttgtgagtaatctacttccatatatcagcctcagaaatggaactatcctttggatattacaggagacactgcagcagattgtttccagaagctggaaaaatatgctccaggagaatttaatcactgggcttttgctgggggatttttagttggcgggactgtcaaggaaatgtgatgacagaaatataatccttaacacaaactggaatctggctttgaatggcatcttccattccctggattgagtcaaatgtttggccaagcagtcagttatctagctgttactgttgggatgaagaactctgttttcatcaactaccatctcacatttctctaaatacttccaagtagcccagagaaaatttagggtacaggtggctatgggccaatttctaaatagctccaattgaagacataaatctgtgttatgaaaaatgatgagttggtactgtaagattcctgatgcatttggaaattttttcaaaccaaaaaaaaaaaaggcattagagtcctgtgttattcatggagaccaatatttgatatatcgctttgaaaaaagcaagtaccactaggacttgggatttccaaaataaagtgagcagaataaccacatgtttaatggcttcaacattaaaccacctcctgtagcatgttttaaaaattggtcctgggctttggaaagagctaaggccttatggtctaggagtttccatctcagcttaagtatattgtatccctactattaggacatcaggaaagcaagtgatctagtcctggtctgaagtgccatgtaactttaacagacataaaaatatgtacctatagaaatatcatttctacaaagcctactgagacagcactgaagaggcagctagcttggctgactcctctgtgtttgtttctttgtgtcatggcactgactgctttgagattccatttttagatgtggttgatagaggaatggaaaatgaagagttattaaaagacaacattctgtaacctgaaaggtagtcatttttgcaagcttatattttaatattgtgcatttaacaaaatagaacacagttaaactgtgctttatcgtattcaaggacttcataaagaataagagagaagattagtaagccaagaatggaataaataccatgactaggaattttgctttcagagcttatgtttcctctgtagatgtgataaccaaaaaccagtgcaagttttgaaacataatttagctggcaaatgcacagtgatggaaattagtaatgactgatggagagccgtacatacctgttgctccttatcctttcagaatggctgctttggcagatctgcctgtgctgggagctactcaacatcacttcattttcatctggacctagtgagagtccctttgcctaacgaatttctgaaatttatttatttactagaccccttataatattcatggctttaaaaaatgacacagcatctttattttattacatgtcaattttattaataatatttaggggtttttttaaattataaaaatggcacatgctttttataaaatgttttaataccacagatgagtatcacatccacagtcaaggcatccctttgttctggtgttgtgtcccacttcccaaaaataaatacggttaacactgatgaacactgttgcttgtatgtgatgtcagaaataccccatccgttcatgcacaagtatgtatgtatatacgcatatacatttacacacatatatagacatttatttatatacacatgcaagtatgtatactatattcatgtatattgcataggtttagaaaagagcaaacattttaaaagcatgctgatcatttgtatatgtctagtgaacaccagtaggcaaagacaggttaaacagagaagttccatttatttttttgtttccaccattgctaggcttagatctgttatggcattactacaattgcacttagcattttctattacctgtgtcataaaattcatgaccaagagttcctgtaattgtttatgttgccttccatgaagcatgaaacctaccatagccccaagacttatctatgctatgtttgtatttcaagtaaaggagagttctttcctctgtgatgcttacaccactttacaaggctgtttgtaacactaacactcagtaggttgcctagtgatatttaattagggcaggctacttccgggaaggtgtaacttcagtgtagtatgggggtctgagcagcttgtcttccttccagaaggagtagctaatgaaatcactgagaacagcatattttattcaattatgctatttaaaaatgggactttgttaaaatggctcatcataaccatcaaataaaactactaattgttctatttaaatgaattatattcattttaggaaaagaagtagaaaaacatctaataaattagctttctgattaatctttaacacttatttaatataaaatggcttctgcctgcatcttaattgaaccacctttgaatctctcaactcctttcactctgaatctcatactcagctgattagaagtcctacaggtccttctctgccaggtctgtcagatcgacttggaccctacccttttctgtgtccccagtcatccattatctcttgtctctctaagttttgggccatagcggcagtcctgtccctgaactttctgcctactactgtcaataattttgtcacgcagttgcaaaaatcttccccagatattatgctcaaaatacatcaaaatgaaattaccctctgggacaagtataccttttactcaaaggacacatggatgtccactgaccttgatcatcttatagaattatggcaagcatgattctgaaaatctatcaggtttagcaaatatctgtcttagtcccatgagggtacacaatcacggctgctgcttcctcattcaacaatgtaagccacatgcctctttgacggcacctggaggactaggttatagattttacactgctgagggccatctttggttttacactgtctcctcacagcttaatgagaaacctgaaaataagaaccaagaaaagagtcatgcccttggacaacctcctctcccaggacactgagatttactgaccaggtcccagaaagaaagcagaaaaataattcttaggctcttgtagcatggattttaaaatagaaacgtgaaaattgaatggtatcttcataatgcatagactccagagtctatttacatatgtattcagttatgcatgtaatcatatgtccatgaatcaatcataagtgcatgtatttaatcattatttgaaaaatatttgtcactctgaggcaggcatcatactaaggatataacaatgaatgtaatagacaaaactcttgatttcatgaagctggcatctagaagaaaagacaaattccaatgtgataagtgcagtgcaggagaaccccagggtgtccagcatgggctggaaattcaaccaaggctttattgtaccagccactcattagccagcaatgttttggttcaatgaaaacataagtaggaagagaataatattttgcatttccattttactggagtcatagtagatttctaaaaatgtatctgaaactaagattttaaaacaagacttagaaacactattaaaatgaaagctaagactgatttattctagctctcaggatagaactaggaaaaataagcagagttttcagtgggttttgactaaatataaagaagatgaagtacaaataatatgtaatagtggagtggatatcacagttataaactttcagcctctgttagcatttaaacagaggatacctgaccactctgaggggtgttgtgattaggaatatgtgatttgagggggctaaaattagatgctgtgatttttcaaaagatattttttaatggctttgttgaatggcaggattttattttaaaaactcatgaaaatcttgatttttgatttgttaaactttgctttataactgagaattttaaaaatatctaggggaatggccgttagttatcatttaaaaaattttaaactaagcatgaatttaagagctagtcaaaagaaaacatactaaaaggtgtaatttaattaaaaatacttctggaagcttataaattttgatcagtattcttagtcattgtcaagtaaaattctattagaaatctgtcttactgtccatccaatataaaaaagtgctgtggtttgatattctaagagttaagtgtaatctagtataaccacagaagaaaattctgcctgtaaggtatttgggagccaagtaaatgtacatgaaaggcaatcatggaaaactctttggcttctgccaccagcgtggcaaccacaagggaggtcctacccatggaaataagaaaatagtgatccaagttttcacccaacttttgaaatttcaatattttgagccaaatgccttctgaaatgggaggctttgatagtgggaaatactgaaattatcttttccctcagacctttagtgaaacacacatatagttttcactctatgacagtataaacaactcaaatctatactgtttgttaagaacagtttcaagaattaaaaagtgctttagcgttatgatgtattgacatgtttgagcttcagttggggttcaaaacaaccccaacgaggtgaataatgcatataatacattttagatgaatgcactgaatctcagagcagtgaattcagcctgtgcagattcatatagcaaatgatagtgctgcagccagaactgggtctttagaaattacatattaacatgttttctaagtaagtcattttccatcattgccttcaaggatgttttatatcaattgttcagatttccataatatagaagttgcctccatgaaaaaaaaatgtttacctaagtttccacggaaagaatgagttagaaataagggagaatgtgaaatcaaaaagtcagagtttttgctgtcggagagaggcttgtcagcttgtacatagttcaagcaaagaaaagtctaatgtttgcataccagggtggatttcaagagaagaaattaacagtgagcgttaatggcttctttaacttatttgtgattctcagcatttaaaaaatgttagtcctatttttcttcctttgaagtcactattaggatgatataatttctgaatgctgcaacaaaaaatgttaaaaatggccctgacatccaagactctattgctctaagtttatgggtgggtatgcaagctaagtgttatgataatacatagtcatatacatagaggtttaatacacctatgggaaattccggcatatttgaagtagagaaaaacaaacaggcttgaaatgtccttcagttcagaatctcatactttacaagggacatttatgggcagattggtgaatatgtagaaggaggatgtttgatctggaaagaagacaaaattggattaggaataagaatatgtagaggagttaggttaagtaggactgttagtttcaaattctgcagggaagatgatttgtagaataaaataaggaaagaaaagagcagtaacacatgaaaaggagttagctttattacttataaggatttatttttcctaaacattgcatccagaaaaacagtttgggctttctgaaaaacagtgaagttgttatcactgtttcttctagtagttaagtgaagattgaacaactaactcagagatcaaaggcatatctttaattgtgagagatcttggactagaaaaactctgtgagattttcttggtttaaatgtctataattttagactggaacagaactcaatttgagcctatttttttcccccaggttcctgccaactagatagcaatgaaggcattttttaaaaaagcttccatcattgcaaatatatcccaaatcacttagcagcggggatttcatgaccctaaaaagttgccttgcttacacaaacacacctatgctttagtagaaacatatcttttttaggagatttgggaattggctagcatttttgccaattgttagccaatttaggagatttggaaattggctagcaattttgccaattgttagccaattcccaaatctcctaaaaaagatatgtttctactaaagcaaaaaggtcacagattcaggagtcaaagtgaaaacaaaggatttagtgttctttcccctacttactacccatttgttgtttgggatgtagagtcaggactggagaagagggtgggaaattctatatcctctgccaatacagaggcatggaggcactttctataactttgtgtcatgaaacaagacttaaccccatatcagtagactaatgtttctgtcatatttctgtctaggtggattacagttttaattgcccatcatcccttaattctgtaatacagcttgagttcctagatttcaggttgactgggtgagggaggaagtcacttgaggtaattttaagaaatgaatccatatccagagtcttgcagaaaagacctgcttctactccaccttctttcttgttctacttcttgcctctggtttgggggcataaaagaggggcagagttgtgaggaaaggaaaaaagattctcaaaagtagtacaataagaagaccctagtagtaacacaaattctcatggtaatctcaaacaactgatagtgttagcagatattgaaaatcaaactcaggaaacatacagaaagattaaatttgttcaaagtggcttcaaggggtattagttgtgaaaatttcagtttatgcagcatagaagaattagattgtgtgtggaacttgggggaagtagggtcagctaatagaagaactttttaatggagctttccaaaggacgaggtggtttttggaaggagtttgtccaacctcttataatacattatgcctgtccacaaacttgttctggtccctgataaagtttgaaaaaaataaggaatatttagggttttttcccacaaatctcaatatattcacttaaaaattcagagactgtgaccttgttattttgggtttaaatatacattttcctcttaaaaatgatagatatatgtttacaaattgtctttactcttcacttataaaacacacacatacagataggatagtcctgtcagtttaccctattttttgtttcaaatttataggtaatttcaaatttataggtgttggtgagatttatcacttttaagataccatctagccttgatatttgttgtaccttctatatgcaaccaaatggctcctgatctcctgatcttctggagatcaaagaatttttattcgccactctccccacccatcattggttggattgagactctaattacatacaagcataatttccaatgcaagtagaactttgatgctctccctgacttaccgattataagttgggaaagtttggattcttgccatcctggggaaggagatttagaactctcatagacaaaatattctaacacaacagaatattttgcaaaacacatctttgaaaagtcaggggccaaaatagtctcagcaaaggttagcttggctgttttttaaaattaccaatagttaagtgggcaaccatgaatctgaatattatacagaccaccactgactgaaactgaggaaaaccattcttgtgaaaaactaaggaatagaggacaatctcagttctaaaagaatgaatatatttgatttaatttgatttctgagtgggaaaacgttcccaggcatccagggtacccttggctgtgggtattccactcgcaaaggctacatctgtatgaagagttgcagtcacattataaagggctttttcatgatttctgattctgccctatcacatcccagagccatgcttttgcaaagctgccagctggcaggtggaatccataaacaagtagcagctgtggcagtagaaagattaaagttttatttccaggtaaaggaggattcagataatacgaagtggagggagggtgggtgggggggggggggtgggatgggaaagggaagaatgaagttttttgtaacaaagtcataaagtatttttccctaattttcttgcatttcctatttatataaagtatcttgatcactgtgttgcactacagagattttcaatggagttaatttgggagactgaactaatctctgaaaaagaaattgactagttacagttactttttggacactttttctgtattgtgaattgtgtggaaatgtacagaataaaaatgaagaaatgta

SEQ ID NO: 618 - DNA, 57837 bp, Homo sapiens
attctcctgcctcagcctcccgagtagatgagatcacaggcacgtgccgccatgccgggttgacttttgtatttttagtagagacggggtttcaccatgttgcctaggctggtcttgaactcctgacctcaggcgattcacccgcctcggcctcccaaagtgttaggattacaggcgtgagccaccgcgcccggcttgaattgtacacttcaaaaggtggaattttatggtgttgaattatatctttatttttttaacggggggaaaatgacgccgctggagaggagttagcggaactgaaacaatgaaatggtgcgcgagtgtcgcctgtccccgtcgcatccatcccaacgaagtttgggccctggaacggtgcacccagaaggcctgcggggagagacgctggggcatgatctggaagaaagacgtctcaggattcgaagggaatgcagctaaggtggcggcggaggttcgcctaggactggggaggcgtccctaggctcagaagttggcccggccggagcggagatttaaaggttggagcgcagaggctcttaaagaggccgagtcgaattcccactcggcgtccaccttaaagccagctccccggcaccacggatctgacccgggtaagtgctgggccgcgggagaggctgcggcgccgaccccagcccctggcgctctagcgcgccctgccgggcccaggggactcggcgcgggtgggctggacttcgtaggcgcgcgtcctgggggccggggtgcacgcgggggcgacagggtcgaggcacccggcccgggctccccactggcgcgcccgcagcggcgctctatttttagcaggcgctgtggcaatataaggaatgcgcggcgcgctaggcgctcggggcgcacgctggcggcgcggtcgctttaaggaggcgccggggcggggacggaccggagtggccggctggcggggagccgtcagtccggcggccgcggggcccggcgggcgcgacgctgcctcctcaccggcgcaggctaggagggggcggcctgagtgccgtagccgagccggggctggagcgcgcggtgagtggtcgggcggccttggaggggagggggcccggccgcgccgcctctcgccccggccgtcgctttgttccggggcgggaggtgtggccgccctccgggctcggccgcgctctccgcttgcggggtgcgccctgggaccggctgtgcgtggcgttttgcccccatcgcgggctcccgcgtaacggtgtgcgttcgtgaaatcggccacgaccaagaccccagtggggagggcctgcgcgccgctcagagagaccctttcatggtaattacagttccttggctgcctgggcgagaacccggtggatagatgggcggcaggacggggcggcgggggatgggtgggtgggtgggggactctttacccccccgccttaagatggcgttaacgaggggagggatccgccagggagttgacaaattcatctgaataataaaacgcagcctgcttcataaacaacccttcactgcccccggaggtttggggagctggagctgtggtcacaactagggcctgggctcatgcattgaactgatctggctgaggcatcagacacggtgccagtcctgccctgcggggaagacaagagcacaaagtgacaagccagtgtggtaagtgctgagattcggtaagcccaggggttgtgggagcccctaggggtccctactgcagagtgggaggtgagagaaggccgcctagaggagttaatgtctggctggccgcagcgtatacactggacacccagttagactctggctagagctgaggtctgttctggcctggggcaaagtggagtctggagaggtggacagagtccatcaaggccactggggccttgatcatagagctctgccattgcccctactccccaatggcccctgatggtgtggaacctccctggccttgctcctctaggactcactctgtcctggacctgaccagagagggtggctgacaaggctcggaatcgtggcctccagaggtttgtctggcagcagaagtaagatggagatatgactttaagagctctgaaactccactgtaataacagcaaccaacagggcttccaaagaccaggcacttgaagtggatttgctcatcatttgacaagacacctcttgacaagacacctccagaaggattttgtttattgtaaaggatggaggaactggggtgaaaaagagccaacagcttgcccaagatcatatctgaagtccatgcttttggccacgtggctgtcctgggcttcggaaggctctggtgcagcctgtgttagagttttgtaatatattgttttataattattcactatagacattcactggtgggttgaagtgtgaggcagtgagctgtgggtattaataactgactcgtgtcagaagcttagcagtgaacaaagcactttctcggatacggttcttagagcttctcctgcttcttttcccggggaagaaacttgagctgctaacattttgtaaacctcctaatttcctgtaaatcacatgtccctgctgagtggggctgaaaatgtttcgggcaatggttttcacccttaggtctgttcacactgcccagcagccagttagcttctctctgtagtttatggtgtagtttgtcctttttctgccggggtgggaggcatggggctttcatgctctggggtttttgaggtctgccagcctctggggagggaggtgttgggcaagcctcgtgctctggtggaaactgaccccctagatgtgacctcggcatttcctaaagctgggggcgggactggggtaggcggtagtcaaggccctttggtgaagcaagcgattgtctccagcgttgtcagcttcgctcctccataagacagttgctaatttccacctctgttttcacctacataagacactttatgacaggtttaacttttatgttattattagctctagccactggtatttcatactcagttcgtctgagctacttataaagtgacaagtccagccagggcaacatggtgaaactccgtctctacaaaaattagctgggcctggtggcatgcacctgtagtcttagctacttgggaggctgaggtgggaggattgcttaagcccagaaggcagaggttggagtgagccatgatcacgccactgcactccagcttgggtgacagagcaagaccctgtctcaaaaaaaaaaaaaaaaaaaaaagtgacaagtcagttacccttggggttggtttggttcctaagctctagtgatcacctggaaccaggaatgactattggcctctgataaattaggctcctgggatgactggtcctaacctcagtcagaatcacatgttgaccagcctcctggatctagtgagttctcagggaaatgtggcttccataatatatttcacatcagatttaaccattgtaatctgttctgccaatgaaatgcccccaaacagagtgtgtctccctgaaagcaattgaaaaacatacctgctcatgagcattgtgtagtttgtacaagcatactcatgtgaactgaatgggaatgcattcttgtgcaatgctggaatgttcttaagtgtccagaggatgtgcattgagttccagaggctctgtacctgccaggccctgggcaggcatagaaggtacagtcacctttatctggagacaggtaaaaaaggagctggaggagttccctgagacctgggacacctggcaggtacccattgtctagggactcagcagagaattcaagctttaagaggaattttcttgctggactctgagtccctgtcagccctcctaagtcttagatcatgcctctgagccctgtagtactgaatcaatggggatgctttggctgcaagtaacaaaacccaaataacagtaagtaagattaagcagagctcagatctcccaaagatgctctctgctcttggaaggtctctgtacacaggaatgggatatcagtgccacttccagcaagttcctgcatgggacaggtagccataaaggctgagtgtctggagttcagagtaataggttttgtcttcttgagtcacagcctctttaatatgttgatgagaagcccagggaacgttgatgtacaaagttggacatataattcaggggattcatggatctctgaaaaccagccctggatcccagtttagccatctctgatctaaaggcacgtgacttctctaatgttcatggcagacctattctgtaagcccattgtgcagccaagtcagcatgccattccagtgcagtgtgagagggcagagatgggggccaagagtacaaatagagtgggacagttgtcattgcccagcctgtgagttgaagtctgtgcagtcagccagtgggtctgacaaagagggcagtgctggcactgcctcatgcttccgcagaggtgatgaggttcaggctgaggtggagaccacgctgcactcgccatgcattcaatggtgccccatctcttgttctctaggaagcattcccgctacctgtgtgatgcagttggttccacctattcccagagactccaccctggccctccttgccctggcccccagcactgagcccctagggccatttagctggccagcatgatctaagacagctttctgcaggcattcctcttgtaggagtcatgaagcagcaatgtgtattttgcttctttttgttgttgttatattaaaaaatatttttatattctagtccaatccttattatttgatttttttggttatatgttatatataaaaatgtattttttgtattttgcttcttaatgtccctatcattgtctttaatattcttggtagcttcactaggtggggactgctgcatgacaatgtgggtcatcaccggttgctgaagtgaccttctgagtctcagaggggtatagtcctcgcatcaggctaccttgacggataaaacaatatgatttacatatgggttgtagtgctagtaagattttggagagcaccaataatgaattcggctgtgcagcttgtagtggccaagcaaaggagggtgggtggagagttgggagctctggttctggcctctgtgaccatctgtagggccttgtctggatcctgtgctgcctgggcccaggctgcatctgtgacttctctgcccagccctcagtgtcgtcatggggattagataaaatatacacgtgaaaatacgcttgggaggccagaaagggctggaagaatgaagaccactaccagtattcaagcaaccttcggaggacagaatcctagacccagaaggagccccctgagtgtattaagtcgagtcacaccccgtagagcacatttctcatagtggtgaggaagatgattttaggtgggacacagcatctttcattttaatagttatatgctggtttatttgaatgtattataaaaatacaggcatcagaacaaactgggagttttttaatggatattttgcccagattaaggctaaagaagtattttaagtaaaaaaaaagaaaatttttaaaagtatggtggttttcagattaagctagttatagtacaatagtagacaaatatggcccaaatgggaaagtgagcccttgaggaaaggctgggaaactttccacaaggggagtccttccttccctgacagcccattaggggtgtgtctttgacttcacctggacccttctagagacacagtgtctctaccctttgagtcagtccactgcatttgcggattctctcattgttgggaagttctttcccttcttcccttaacctgtcccacatgaacctttgacagtcctgcttttctccaccatgagcagctttactttcttcaactgctcttcaaatgtcatagtttaaaaacagcccctctgtatgtccgtcctttcttccatccatccttgcagccacccacctacccgtccattcattgatccatctctccatccatctttccttcagcaaagacttgtgggctggaccctgtactgtatactttatattcgctatctctaagcctcacaaaaattgtgttagatgtagttaaccttttatagatgtggaaaccgaggctcaaggaagttaagtaggtcacctgcagtcataacctgagagaagcagagtcagaaaggaatctggccatggtctgtctcttcctgaagtgcatgctccttccgttagaccgtgctgttcccagcactgggtgaccaaaaatgtcatgatcccttctctcctggtgcttaggggacctatcccatggaggtgtggctctacataatcagtgcagtgggcaaaggcctcatgaggagcagggatggagcagcctgtgcacaaagatgtggtgaggcagcagaggtgcagaagacgctggctggcaaagagaggcagcgagtccctcgctggcaggagtcttccctgactgtcattaatcttacagtcacaaatgaacccctaaatcatttgtgcacttttttttttaattttgaaaaagaaaagtgtaaagggtagtataacaaataccatgtacctattacccaagatgaacagatgtgaccattttgtctgcacttgatccttttcacagtagggctggacttaaaaccagaccactcatcctttgccctggccagtttggcccatcctcagcctgcaatgggcttttgggagccttgctcctgagttttcatgtattggctctctcttggggcttcatgtcctcagttaatgccagtgggcctccctagaagttgttgactaaagaggcttttgctgcttctgaccacattgtggagaagccactctggggagagtgtgtgtttttggctatgatctttttcagagaagttcatctaccctcacaaacacctgccttgaccattgtgggtttagccaagctgtagagcatggtttagtcatagctgcctaaactgaactgtaatattaatgataggtttgtatgtttggaagacagagaaaacatattctctttttataattatatgacaatgataacaaaatgctttttgttgttgttagcagtgaagtctcactctgttgcttaggttggagtgtggtggagcaatcatagcttatcacagcctcgaactcctgggctcaagccatcctcctgcctcagcctcctcagtagctgagactataggcatgtgccaccatgcccatctaatttaaaaaaattttttttgtagagatggggtctccctttgttgttcaggctcatcttgaactcctggtgtcaagcgatcctcccacctcgacctcccaaagtgctgggattataggcatgagcccccacacctggacacaaaatacattatatactctaaagtataggattactttaagagaaggaaactaaaagtatgatggcttactttgtaatccataacttcacagttttcccttcctgcagctttcacagaaaaaaccaggtgcctggtactgggtccttctctctgccaagcaggagtaaggcggcagagccaaccctgcatctgcagttagaagctctccatgacgacaggacgcagcttctcacccaactgtttgcagccttctcctttccacctactgattgactcctgagctgaagcctggtgttatcctgtttgcatgtagtttgccatgagttagaacagtgagtaaagctctgctttttaaagctgtgcagaaagattcaaaaacttctggaaaggctttcttatccagggcagattcttgtcagtccttattggggaccgagatttcatctggtttcataatagatagtggggacctgcgggagaccccaagtcctcttcattaagtgctgagaatgtcttgaaacattttccttccctgagttgcccttaaagaataacaccaccaggctggatgcagtggctcacgcctgtaattccaacactttgggagattgaggcaggaggatcacttgtggtcaggagttcaagaccaacctggccaacatggtgaaactccgtctctactaaaaatataaaacttagctgggcgtggtggtgtgtgcctgtagtctgagctactccagaggccaaggcaggagaattgcttgaacccgggaggcagaggttgcagagagctgagatcgcgccactgtgcttcagcctggcgacagagagactctgtctcaaagaataaaaataaaaaatagcaccaccagatccttttccctcattctgatggagatgctgcaaaagccagcgaaggctgggtgctgagagacctcagaaggccctgctttactggggcttatcttgcaatggaagccgtaccagtgaaggcagttgaacatattatacaaccagtgcctatgagattatgtggaaatccacatatgtgttatacttacaggcatacctttttaaagacaagtttgggtttaaaaagaaactacttggcatactgtatattaggctggccctagtataccaagtacacagattaaatgtaaaagtatttgtgggcatgtggatctgtggggagattgctggagtgtagtggattcaggagactcccccacccctttaggagctgaccatttatggggggtgttggcggcagattcttgcctctcaaaagcattatgtattcatttcaaaagcaaaattaattttggttcagtttagctttttttcctgatcctttagaatttcaacgtgccttcttgaaaattctccctttttagataacccacaaattcatttctttatattttcactccactggaaatggaggctcaaggaggagacaggcaaagccgtctttcttggccaacactgctctcaccagtctatcatggtcttctttcaatgtctgctttattataaccagagatgatagaaggagggtgggatcactgtcccgaagacttgggggcgtatatttttaaaaacttctatgagctatgcctccttagccttccctctccacccacattcctcaggttgaggttcctggggcagagctggaaggcctagtctgtctcatgctcctgctgaggaagtccagcccaggagaggccaggtgccctggcactcccaagcaattaaggccagctggcatcatagccttcccatccacccctactcactgaccccgtccccccgtcccacccaccgcagtggacagctgcctgaatccactaatctggggctgggtgggtgtttcctgcatgtttgagattttaggaggaaatcaaaataaagaaacaaagcctttgttttatttctggactcccaactgggtatggctggagggatggaaagcagggaacaggaggagcaggtcacttggcacttcaacaaaataaccattctaatagagcatttaacaggaactttttctatttagggttggggtgggtaaataggaaagacggcagggctgggagagcccctttgtgtggaaggagaaggtggggccgcccttgccccaagcggggcctctggcagtgcctggtgttcaggcagggaggggtctgaggccacccagccgggctgcagaattggcagcctggggactcagggactttcagtcctcccttcctgaaggaaccctctgctccagttctgtcccactacttgtctgtgtgaatctccacctctatagcctcctcttccatatctgtaatgggagtatcccagccacactctggcctttcttctctagtccagttatactgggtcaggctctcacctgacatgtggaaatgaagaggtacatcccccagtatttcttaattcttccaaaggattttctccttgtagaaattctctgagggtttcatttattttctttaaaaattgcccaagtattgatgacagccctccccatctgcagtatttctgaagatttcagggtatgggccatgcccactggccgcctggcctccactccactttgccccatgtgcatacagtaaggttggcttcttcatctgctaagccactattattgcatgtaacaggcatccaccaagggcttttaagaaagggagttgtctgcagcccagatcagggcagaagttaaaaatgaatgtcagacaccctccccttgcttgctcacacccttggagaatgtctctgtggctgtctcctcaaacctagtttactgctattttccagggaccaattttcctggatactttcccccagaccttctgaaaactccaaattttcattacttttgattgcagaacaaggataacaatctgtcttagactaggctgtgggctgcccttgtcagatgtaaaggggtctgggcatggtggctcacgcctgtaatcccagcactttgggaggctgaggtgggtggatcacttgaggtcaggagttcgagaccagcctggccaacatggtgaaaccccatctctactaaaaaaatacaaaaattagtgaggcctggtggcatgttcctgtagtaacagctacttggaaggctgaggcaggagagtcgcttgaatccaggaggcagagtctgcactgagccaagattgtgccattgcactccagcctgggcgacagaacaagactctctcaaaaaaaaaaacaaagatataaaggggccattaaataactcatctaaaaaagaattaggcactctagaccttacctttacctacagtaagaaccagcagaagtgctgggattattaagctatcattattactagccaggtcaaatcagtcctctcctaatgaccagggcaaagccaggtgttattttttccctttcctgttagaacattttgtaacataaggattagagatgatgtagattgacaatatttattgagtaccttctctgtgccagatatgtgctgggcattggagatacagtggagaatagaacagagggtgggccctgcccacatggaggtgacggtctagtggggaagatgcattacatgtttacgtcttgtaaacaactaactagcagttaagtgccagcatacaggatgctgtcaaggcagacagctgggtgctttgggagaccctgatagtaatctcatatagtctggggtgcagtgggggtcagagaagtatatttaaggtgcttagcatgtggtcagggcttaataaacggtcattataatgaccatccctggccacagggcccagcctggttccgcctccagctggtggctgctaccacccaccaacaatagttttacacagagaggtttttcattaggccaaggttatacagctagcagaggggctttgattcatgactttttataaaagtgctgtatgtagaaagcagaggggtgggaagcttccctcgaccccccagccaatactgacctttggacaggccttgcctcgcaggaatggagcagcaagctggttactgaggagaaaaaatgcagcagtcatttagggcttggggagggagatgtgaaaagtagccttctgctgagtgggcttaaaaccctgggattggaagggtccctgagaagccgtcacacccacctccagcctggttcaccactccaaagctaggtggccagtccttcttcctccgcatctgcttcacagacctttgcagaggaaaatctcacactcattgccatgcctgcctcgttttcaggaagtttcccttttatttggcttcagtccgtctctctgcagtctggttactctttaaaaatgaaggttgaattgcctctccccacctcaaggaagaacctagaccctatgtctttcttatttttggtcaagcataaacattttcacattcttcattaatggtgtctaacatcttaaatataaataatgaaaacacagcaaagcagcagccttttttgaatgtgcctttttggcctccacctctctgggctctgacatactcctggggtgggctgtgtgcctgtccctgaagaatgccaggctggcccatgtcctgcaggccaagtaacccctgctgctgctctcttcagtgagatcatttcctttgatctcacacctccttgcaccaaagccaggccaagccaaggcagtgcgaagagttgtctgccttagaacggccgtgccactcagatgtgtgtgtgctcaagaaggatgggtacagagtgttgatttatttgggttacacaatgtgtaaaactttttcattggtggccagtatttaaaataataaaatagccagaaatctgagtttttgcatagactcagattgctggctattctttaaaaatttagactatctggcaagctcattgcagatattatgttgcagcagtcagctggtgcggggtgtcagtaatctcctgtttgcacaggccccactgctccctgttgcctgtacctatccccttctatcacttattgacacagcctctgccggcacgtgcacgtgactttgggatgtccgttttgttcttgattccctcttgctgctactgcagggcaaagcagttgagatggggggatcagtcagaaagcatccgtctctcaggcaggggcctgtgagatgcagagggatgcctggccctgggatccgggccttccgttccctctctgttgccaccctgctcttctcctgggcttaccagattgaactggcggaacaccgtgattccatgagatgagcagttctgggctgggacagctaaggagttaagggacaaccttagctgtactctgggggctgggtgtggcatccccagctcagaaggcagggccagtcagggggccatgccctgggtgctggtggggtctcagtgctttgggaatttggacagcaaggaaggacccctcatcgccactcctcctgctgggctggtgcccacgggtgtccagtgggactcctcacatggtatgtccttcgtgaggcctgccactgcagtcctctaggtcctgtgtggcccatggcatagtgcccacatcacctctgtcctactgtctacccaagccagactcccagccagctgccagtatcactcctgcatttggaaatgcagacagcagacacgttggagcgtctctgagcagaaagctgtgccagggctctgggatgcccagagaaaaagaagacaaggcctggccctttgtccactgtcccactagcagaggaatgtgactgtgaagtaacacccagctcctagatttgagggcagatgaagaggggcatgccgagctttcaggtcagagatatggccttggacaaaccacagagcctctctgaccttcacggttcctgaaggggctaaacaatgcctcttggtgaagcgtcttgagtcatcacatggaataatggctgcggagcacttgcgctgccacctgccacctggttggcattccatagatggaagcaaggtggctcagtggaaggagaccttgggggatagaagagggccttagaggaaggaatcgtttctgggggataggacctgacacttgggtaccatccctgtccttgaggacaccagaccaggaatcagcagagcagaggccatgcgaggggaagggggcacttgggcagctcaagaaaggcctagaatgttgtggtcagcggggagagcttcatggatggcattccaggagactctgtgcttgggttagttggggagtgataatgctggagtggtgggtgggacaatgctagtggtggttgctcaggccgggggcagacatgggccacagtggtggacagccttgctaggccttggcctgggatgtgggtaaagggctgtttgcactgccaagggagaaaaaggaagagaatttggggcagagaggtgggcaaaggggcccacccttgggcaggtgagggaggtgctggctgaatccagtttgtgcagggttgagcctgagcagcggagcagaacagtgaggaggtgcggggctctgtgagcagagggcaaagcggagtcagagcagggctgggaggacagcagcctgccaggctctggggaggccaagggcgctcagtctggggaaccccagagtgtgcagaggctggccttccctggttgagtgaccaccagcatgacgttcccaattgcacgcagattcctatggaaggctgcaggagtcctcctctttcactgcgggtgagactgccccagtgctaggaaaatattaatagacccccagggactgagaacaaggattgaaaaataaaaccacttcctactctctttcctcagctgccactccaagaagttgtgagcttgatgcagctctgccttcacagagcccacgccctgcccctcatccctggactgagttctttcccaccctcccggttgttggttgctgggcagggggcactgtgaggggctggggtaggaccccagaggccaggtggccaagtagcaggcattcctgtgagccagggatgccagcagggaatattgctctgaaggttctgtggcctcttagacactgaggcccttaccaactcctcggttctgagagccgcttagacccaccaggctcagtggacaagcttgggggtgagtggggcagtgttttcattttgcaacttgccaggcctgggtgctgaatcccagcttctcttttcactagcctgtgcccttggtagaatgcctctctccccttggtaaaatggggataataaccctcccccacaactttctgcctcaggcctttgtggctgaacctgggttacctgttcctccgtgaccctattcccatcccctttcccatccccttcccctcctctgagattctggagcacttcgagtttgtcctatgtaattcatccactctgtcctgggctttttctgctggttaacctcagtgtggtcatcaaaaagagttgcaggggccctgtttggttaggcagccatctagcaagcctacattgtactcccgtatggacttggggctagggcagggtccgggggcctccagcacatgtgaggcccatcacacccaacgctctcccctgcctagccctgcagccttgggcacttgttttttcatcatgcagtgcttattaagcagccactgtgtggcaggcaccgtgcgtggtatagggatacaaagatgaagatcccttgtttccagggagccaacagtaatcccttcccctgccactcttacccccgacacccatcgcccctgccatgcacacatacacactccacattccagtcacatcatgttgctcgcagtaccgagtgtctccttggcttttcatgcctccatgcattacacttttgtcgcttctattctttacctgggacatgcttgtccttactgttttttgttttttgtgtttttttttgagacggagtcttgctctgttgcccaggcttgagtgcagtggcatgatctcggcccacagcaacctccgcctccccagttcaagtgattcttccgcctccccagttcaagtgattctcctccctcagcctcttgagtagctgggattacaggtgcctgccaccatgcctggctaatttttgtatttttattagagacaaggtttcatcatcttggccaggctggtctcgaacacctgacctcgtgattcacccacctcggccttccaaagtgctgggattacaggcatgagccaccatgcctgaccgtccttactgtttacgtggctaatatctacttggcctttaagaccccgttctgtgtcacttctaccaggaagccttccgcagcacccccaggctgggtgagatgcctcccactcctgtgctcctgcattacttacccagtgtaccataatcctctgcctgcctcccccacaaaatacacactgtgagccccacaggctggggctgggctcaggctcatttattttggtatctctagttcccaggaccaagcacacaggaggtgctctgggagcattgactggatgtgtgtgatcccatggagcctgagcatgtgtgtgtcttgagaggagcatgtgtgtgtcttgagaggagggtcagtccaacactgactcctcacccagtttactcctcctcatttttctctgggctcaggtaaaacagggacctttctcatgtcatgtgacctgttagaggatttacccccccccccccccaaaccacagggtacccagagggtggctatgttttgtgatggagagctcttctggatttagaaaccagagggagaaactttgtttcatgctgaacttgctggcagtttgatatcttccacattctctttggtgaacaagcaactcctgaatactggagaaatgcaaaagaaggcatctgaggagccgtcttgaggagcttacctttcatccacgttcattcagcaagcctttgagggcttgctttcctgggacattgctgtagtgattcggtggccagctgagacatgcctgctgccctccaaggcatagtcggggagctgagcccccacacacatatcggcctgctagccttccgagaagggagaggtaggaggctgagctgtgttgaactgtcacctgtggaacctgccagtttgcagggcgctcaaggaactcaggaaaggctttggagaagcaggaggagggacttgggatggacttcaaagaaggatgttgatgatggtaacaacttgatttttgttgaacagtcactatgtgccaggtactgggccaagcaaataaatgcagcttttcacagccaccatgaggcagattctgccactgtccctacttttacagaaaagaaaaccaaagtacagaaagtaacttgcctagggttgcaggctgtctgcatagctcaagctctttggcaaggatttccagttgaggggccagtcctgagctgggcagggaacagctcgagtgtaggaccacagggaaatgggctgaggctggggcacggacccatataggggatagggtcccaaacagaggtgctagaaaataagggtttcacagcagcttggtgcccccagcttcctcactggtcctcagggcggagggctacctgctggtaccagatctatgccctggtcagcaagctgtcccagcctggatctggggtgctggggtgggaagtgtttatttttggtaactagcatttgccctggttgcccctcaagctctgacctgcccagctgtttcacccacatgggcagcagtctgaccttgggggtgtcttctactctgacaccatctcccagctcactgctgacctctttccagcactcctggatcagctgcctctgccctggcctgactgtacacacatactcaccagcccctagccagcagaggatgcctagcactacaggctggcagtggctctggaaccacactgtgttgtttcagatcccgacactgcctctttctagtttggtgaccttcaaaaagttattttactactctgtgtctcagtttcttcaactgtaaaatggggataatcggaatctaccttctagggttgttgtgagaattaaaatattccaacagcatctgacacattgtttaccttaaatgttcctattgcttttaacgtgatcactattgaattataattgtcatggcaggtggtttctgcatacctactctgagactcagtgctgggtcgcagatggctccgccctgagtcctgtttgggaggtgcccgaatactgatgggaaagacccagttattgacagttgccatatgaggaagcatgtggtacttaggggtcacgagtaagcccaacaacagtgtccctccctgacttacttcaaccttggcctttgcttggatctctggacttctgtctgatcatttctgctctgctgacagcagtccaggtgtgatcctggcagaggagttgagattagaagaaaagcacggattggtagattaacagaagacttgggtaatagagatctccagacatcaccaggcaggctacccctaaaggtcctgagccgttcctatggaaaaggatggccactaagtgggatattttggagggaaccagaaaggtagtagttagatctggggcagcaaacagattttctctctggagcagtcactgtgttctgctgccaagagtactgtgttgacaaggaaggggaccatgatccatcagtgttgtctgccgtggctctgggaatgggggggagcagcacccatgccacctacttgcccttgagacttgatgtttatggcatgaaaccacatacatggttgggtgggtggttagggcttaataacggagtgagctgaaaagcactggtggctttctagagtagttgagaggcccaatgacagtgccacacttggcttagcaaagatatgaaacaaggggctggagcaaagtctcggggagcggagagtgaagccttaagggatgccaagtggcctagacccctctggggtcacatgccattaacacacagcttgcaggtcagcgctctggtgaagctgcccatttctgggaattgtgcagaagggaagggcagctcctggaatgcagagccatttcctccacatgggttgggtcactctccccagcgtgtcctcatccccctgggttgggcacacccagacatcatagagatgagattagcttcccaggtctaattcagctcaacgtgaatgaaagtccattcactttcctaagagctccattaattatgaatgtgtcctcccttctagcctgatttacctaaaatacttgcaattcaattggtggggttaaggggactctttaaaataattagtatagaaatacagaagcaaaaagcagtaaataccaaaccttcaataaagttggcagcatctttgggagagcctctggattggccctgggccagcctctgagaatctgtggtcctaaggtcagggccaagggaagcagcaacaatgatgaagaatgccctgtaggatagtgaatcgtgaagacgctaccctaagaaaagccatgtgatgcagcaaaatgatttggcaaaagaattggaggcagtgtggcatgacagttctaacatgaccctcggcatctaaccagtccacagcagttgtccactaagggtgggcgttgttgctgctatgcagctccttctgggcaccatttttcctggccagtacataggacactgctttggaagtgatgctgggtggagtggggtgcatggagaggctaggggacctatggaccccttggcaacatctgtagctgaagccattcgtttaacatgtgctgctcacttagaacaatgggtgcagtggttttaggctattgttttgggaaacaagctctgtagaagccctagaacctggaagcctgaggagaagtggcaaatttcgtgaggggtaagacccactgagccctgccgttttgccattttgtgggggctgttggggcctgctgctgtcctatgcagtgtggatgcccttccctagggctgtggatggggcaaggaaatggtttaaatcaccgaagtctaccaggttgaagggaaagcaggggcccaactactttgtcgatgcaaatatgcccttgctgaggggccctccaagtttttctcactgaggccttacaccttcctggggccttgttctcctgttttatagatggggaaactgggcaccaggaagttaagaaacttgccccaggtcacacagggagtctgtattggaggccacagtggaactccggctgcctggctgtggagttgaggctgtccctgacctcccaagctgtcccactgagaaccgttgggcttttacaaaagactattcctgggaggtcttagacacacccatgctaactttgaagactgctgggtgaaaaggttatactggggtgatcagtccacccagccacccacttcctaggggtatgagccagcccctttcagaaggatgggtgtgaccccctgcttcttagcacaagggaggcccgtgtgggtagaaggccgcactgggaaagtgacgagggcagtgtgagtagagactgagcttcccatgtgttgggctctgcctggccccgtgagaggcaaaggaatgagaggatgtggctcttgtcctcgtggagcttacaatctgtttgacaaggtaaatctggcattcagggaaacaacttcaaaccatgcaagaaggttctacctatggggaaagaaagggagcaagaggcagacaacagccaaaagagcttatttttccatttacagatgcctgaggtttttgtacacatgttattaaaattattgaggaagtgatattgccttttaggcagaagtttccagtatgaacaacgggtttgggttgccatgcagcctgtggcctgggcggggccctgggagcagtggttgccatgggaaccagttcagccgcccccacggccaagtggctgctgttcccaaagttggtttctgcgtggatggggctgcctggaacctcagagccatttcccatggaaacaatgctctaaatgatgggtgatgttcccacacaggcctattttgtctggctgttaacagagcagagatggtggtgaggcttctcatgctgagaggaggctgggaatgagagagagtgtgtgtgtgtgtgagtgtgtatgtgtgagtgtgtatatgtgtgtgtgtgctccctcttcttgggagtaaagtaaacaaggtgagaaagtgagcatttgggcatcttctcagagctcagcatatctcacacattttatttcatgcttagagcaatcctacaaagtatgagtctccaactaacccactttactaataagatactgaggccatagaaggtaatttgcccaaggtcactcaactggtcagtaggaggagtattcagcacagaaaatagtggggaaactttaaggagaaccccaagtctaccttataccaccttcccacctcaaagggtcacatccatcatcctcaaaagtgaagacctaacatcctagaatgatctccgaggtgctttttagttgagaaggctggaaaggagaggggtgttgtgaatgtcagcagtttgctccttacccaccaaccaaccaacttttcattctgcggtgacttttcgtcgtagcctgtgagtggttttaaaaaaatctttctctgtaccgcatgagaccagcttattttgtaggagtgtggttcatatctcttggcgtcttgacctccccatctgcaaagacatcatttgatcagggttttggggggggccggagaaacatgcctatcaagatgagatagcacctttaggaattggggggttctctggactcattctccagccttggaaaccccttctttgtttctagctcacacttgattccaagggtcctgtctgtgccattagtctcatctcttagtaggagagagacagtcccaagccctggctgagagagttgtcccttagctctctccatgaggaagccagctctgtggtgtgtaggttgtctgaccattgttcagaaatgcgtgttgaacctctagttcattcagtaagtgtctgccctgtgccaatgctgtgccaggctctgggagtacagagaagaacaagatgctgttcctgcccttttgtgcacagtaaacacttagaaaattctaggcatcattgtggcgtctgtggcaggaacttcagggctcaaagcgcaggtggaggcagtgcctggtgctgacccatgaggaggtttgtgctctcctgggggtcttaggtgtgcacagaggctgcagtgtgaccacaggacacattgggggaccacaaacctggttgggggtgacagtagagtataaggggctgcggcacgggtgtggctggagaggtcagcagtggcagccagcgacaggcattgaatgtcctgtgagggggcctggactttcctcctcagcattgtggggcactgaaagggttttcacaaggggcccagtctgatgtttgtgtgaaatgagtagtctagccctgttccattgtgtcctaattagaaggaaaccccaagtgggaagggaaccccggcttggctccctgtggtctctgagggttcaacctctgagagcagggtgctgtcaaaaggagggggcccccactggccatttcctgccagctgccttggcaagcagagggcattttttaaggagtccccaagtgatttggctgtgggtggtctgagtgccgactcaaaggttcattcatgtactccagcatatttactagtgtatttcttatcttgttttcttttgagaagaaaataaagacaaacggttttccttttcaataccttcccacccacttagtattttttagttatgtcgctgccagcagagaatgggagctttaagaacagccaaacaccgaccgggaacggtggctcatgcctgtaatcccagcactttgggaggccaaggcaggcaggtcacaaggtcaggagagcaaaatcatcctggccaacatggtgaaacctgtctctattgaaaatacaaaaaaattagccaggcatggtggtgggcgcctgtaatcccagctactcgggaggctaaggcaggagaatctcttgaacttgggaggcggaggctgcagtgagctgagaccacgctactgcactcccgtctgggtgacagtagcacccaaaaacaaaacaaaaagccaaacaccagcaaacacctttcacccatagcccagcgtcattgcccaggacagagcagcagttgcagaggggcagtgaggagtgaaccccacgctctgcagctctgagaggcaaaggagagaggccactgggccacccctccctccccatttctgtcaccctgcaactcccctccgccctctctccttggcctgccttcaccgtcatggatttggccatggaagagctcagttaagtgaagcctcagcccgtcccgtgttgtagggagatgctggaaccagattccggggccacagctggaacctggtcctatactgccccaaaggagctgaaatccccactcgaatgagaggaaatcaaacattttcaggtggcttgaacattttattttcctgggagcattttaatagtgttaaacttttccagtacacaaatataatgcatgcttgttgtagaaaattgaaacattaagaaaatgaaaatgccctgaaatctgccttagagacaaccatctgctaaagttcttaatgcctggatccacacctggcattaggatcaggtgtacttactagctgttttgcagcctgtctttttttcatacataacaacacactttttctaggttagtgaatatcttccttttaaatgactgcatagtactccattatatggataaactttaacttttccccccaacattaagttatttctattttcccccattcttaacatctttcttcacttctctgattatctccttagaataaattctcacatggggtagagctgcaggagagggtatgaatatatttacgcaagtgtattttcagtatagcctaggcagatttgcactttctctgcagtgtagcaaagcttgtacttctccgacactttggggaagtcctaaatgtcaacatcaggcttcagtaactacaaagggttctgcaatgactctcgactgtagccccatgcaaatcagtgtggccacataacccacatttgtgtccagccccctttctgtcaaaatctagaactgaagactattttagagctgaaactaattataaaagtaatctaatccagccctttaaactcatagataaggaaactatggctcagagagatcagtggccttcccaagtagcggcggagcacacagggcacccagttctttgtcctccctgccacactgccaccctcctctctgtgagaccatcggtttcccagtcacacgtacaccatgcttttcccatcccaatttgcacagggattctttcttttcttctacacagccgtaggattaagctttccctccctcgatttttgtgctacccaggaatgccctaccaggaggtggtattgcttcttcctggcagggtccacagttagttagcagtttaggttcctggctacaacctccaaattgttctttaggggatccccctagctgcacctgtgtttaacatttggtgctgtcagcctccttctggaaactcttggcttccatcatgaccacagatcctggtttccctccttttcttctgagtgcctccaggaggctccctcctgcctctcctccttgtcactttgtgacactgtttacaaaggtcactcttcacttctgttaaggcccaattattctttagaatcctggtcccacttccagctgcctcctggtcaccttagctcagggtttctcaacctcagcactattgacattttaggatggataattcttcactgggggggactgccctgcgcattgtacaatccctggtctgtgctgaacagatgccagtggtacccactccattttgacaacaaaaaaaaatatctctagacattgcaaatatccctggggagcaaaattcccctgactgagaaccactgccttagctggcctcagcagcatcaaaacaaaacttcgacctgctcctaccccctcctccccaaataaaatgattcccgcatgactttgtgtataatacagggcaagaagcagagagaaaggagccacaatcatagaattctgaaacttggaaggggcctcagagtcccagagctcaggtgtgctaagctatcatggccccctttctaagcttagacacagcttcaaatccttctcagcatagcagcccagttaataagaggggatgtgaaagatgaacctccatgccagccctgctcagaccactgccctcgtgttaacctgtacaagtagagtttagtggccaaaaagcttatttgacatggcttttggctatacttgctaaacaagaccagtggtactgtgtcctcaacaccaggcctggcacataattggtgttgaataaatgatggttgaataaatcactttaacagtggactgtctctggctagtgagaccaggggtaatgcttttattttcttttgcatttcttcattttcaaacctctttataattgagagtattactttataaaggaggaaaacatatgaatattttcccctaagttaaaaaagccctctgtctcattccacatgtcttgctgccgcaggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacggtgagacctgggtggcagccctgcattgggtgggatagtagatggggaggatcagggaaatttgacaggtttcagtggggcaagatggtttccttaatgttgctgttatgggatggttgatataaagccgtgtgtcgttttcagggtgaattctcaacagggaaggcctgcgtagagggcttgcaagatttcgtggaaaccaaaatgtgcattcagcaaagaggggaggctagaatcatgccaactcagtgatgtcatgtgtgttttttcttgctgatcagaatctctgattaacagttatggatgtctttagctaataaaaaagggaaaagcaagttgtttcttaatgagcatagtttacttggtacttgtcctttgaggggaatctcttgcatctgacattgtgtttctagctgagtgtgaattagtctggattactagttctaagtgtggcagccaggccagcagtagccgcagcatcaggaaactaattagaaatgcacatcctcaggcccatactgatttggaaattctgagggtgggcccaacaccctgtgttttaacacaccctcgaggagatgcttgaaatcagggagtattaaatcttcaacttcgttatttttcaaagttgttttgactggtctaggtcctaaggtatttctatgtgagttttagcatcagttaaattctaaaattctagattttgattgggattgtgttgaaactgtagatctgtttgaggagagttgatattttaacaatgttgaggcttccaacccatgaacacagtatctctttccatttatttatttatttatttatttatttgtttatttgggtcttctttctcttgtcagttttatttgtaggtttttttgtttgtttgtttgtttttggggggacggagtctcgctctgtcaccaggttggtggagtgcagtggtgcagtctcagctcaccgcaacctccgcctctcgggttcaagcaaatctcttgcctcagcctcccaagtagctgggattacaggcacgcaccaccacacctagctaaattttttttgtatttttagtagagacggggtttcaccatgttggccaggatggtctcgatctccggacctcgtgatccgcctgcctcagcctcagcctctcaaactgctgggattacaggcatgaaccaccacgcctggcttatttgtagttttcagtgcataggtcttttacatgttttgtcagttttatacctgtatctgtattgatgctaccgtaaattattatttttggttttttatttcaattttcagttgtttgttgctagtatatataaaaacaataggtttctgtatattaatcttgtaacctacaactttgctaaactcagttactagttctagtatcttttttgtagattctgctggatttttctgaatagaccatagtgactgcaagtaaagacagttttacttcttcttttccaatctggatggctcttatttctttttcttgccttatctcattgattaaaatctctggcatcctgttgaaaagaagtaacaagaacagacatccttgtcttgttcttgatcttaaggggtaagtgtttggtctttagcattaagtatgatgttagttgcaggccttttatggatggcctttatcaggtcatggaagttcctttctatttctagtttgctgagagtttttatcaggcatggatgttggattttgtccagtgctttttctgtgtctactgagataaccaaatggttttccttttttagtttgttaatgtggtaaattacattgattgttttgttttgtttttgtgacagagtcttgcactgtcacccaggctggagcacagtggcatgatcttagctcactgcaaccacaaaatactgggctcaagagatcttcttgcctcagcttccccagtagctaggactgtaggcacacaccactgtgcccggctaatattttatttttttgtgaagattggggggaatctcccattgtcgcccaggctggtcttgaactcttggcttcaagcaatccttccatttcagcctcccaaagtgctgggattacaggtgtgagccaccatccctggtccttgatttttttaatattaaaccaaaattgcatccctggaataaaccccacttggtcatgatgtattatcctttaatattgttggctttgatttgctaaacttttgtttacaattcttatgtctgtgttcttgtgaaatattggtctatagttttcttgtaatgtctgtgtctaattttggtatcagagtaatgttggcctcatagaacgagttttattcaattttctggaagagtttgagttaaattggtatttcttccctaactgtttagtagaattcacaaacaaggccatctggccctggagttttctttgtgggaagatgtttttgtttttgttttgagacagggtctcgctctgttacccaggctggagtgcagtggcatgatcaaggctcaccacagcctagaccttctgggctgaagcagtcctcccacatattttgtctgtctgttggttgtttcagctgagaacgtaaatctggtccctgtcactccatcttggccagaagcagaaccaaatcatgacttcaaaaaaatacaactttgtggctgggcgctgtggcttacaaggcctgtaaatcccaacactttgggaggctgaggtgggcagattgcttgagctcaggagtttgagacttgcctgggcaacgtggtgaaaccccatctcaactaaaaatataaaaattagcctcgggtggctgaggtgggagaatcacttgagctcaggaggcaaagattgcagtgagccgagactgcgccacctcactccagcctgggcaacagagtgagactccctctcaaaaaaacaaaacaaaacaaaaaaactttgtaaatatgttttaaaagcactgaattatatacttttaaagtattaatattatggcatgtagattgtatctcaattttaaaaagcaccgtcctccaagggtttgtctgcagccctgggactttgaacaatttgaacaggtaccaagcaccttcccatcttgggactttgcattttgtcttctctctgcctagaacattgttcctgcagaaacactgatttcatttaggtctcagctcaaatgtcactttatctaagaggtcttccctgaccaaaccattgacactagtatccaccccaccccagtcatttctatgcccaactctgttcttctttattctgccttttatggttggacatattttatctttgtttgtgtttttgtctctgctgactaaaatataaatgtctgagagcagggactttatttactgactgcattattcctagcatctagaatactgcttggctcatagtagctccccagtaaacatttgtggaatgaccaaatgaaagaataaaccttgaacaatatatgtgtagtgaaaggtttgatgtgctagctatattatttttttctaactcacattacaataataagtatatataactattaaaattaaaacttacatctgtgcactttctaaaatcatttcatgcatcacctattggaatatatggcacactttgggatatactgagttaaataaatgtaaacaagtttcttcactgcaggacttacaagaacttttaacatgcaaacacatattagaggtgtagtgataggatacattgtccttagagcttcccacaggggtcattttttgcacgtgattctgaactatgttccatagagaacattctgaaacacattgcataatgcatgtaagaaagtaacaccatgcctggtacatcgttggaactcaatcagtatttctctctacagccatataaacttctctgactttttcctgagtacctttggatgttaaattggtttctgaggaaaaatgttttcctcaagattgaatgttttcctcaacatttatagcaggagcagcagggagaggggaaacatggccgcagcattatattagaagtgtgcatttgcaaagcctgtgttctgaatgcctgggctctccatggcattactttagaagaatgagtttgttaagcttctaattctgccaccagagtcaggcccgatttagggcattgcccacccaggccttcctcgggaatagacaccagattcccagattagatgcttctccactccattagatctgctattaagaaaaggaagacttggccgggtgcggtggctcacgcctgtaatcccaccactttgtgaggccgaggtgggtggatcacgaggtcaggagtttgagaccagcctgaccaacatagtgaaaccccgcttctactaaaaatacaaaaaaaattagccaggcctggtggcgcctgtcatctcagctactcgggagcctgaggcaggagaattgcctgaacccaggaggcggaggttgcagtgagtaactctgaacctttctggggctgaacttttctggagtggtctgcacccctcagatggccaggacttccctgggcatctggatcccaggggtcctgctcccctgaggccatgccatcttcggggaggtgctaagcctggaggtgccctcagttgccctgtaccccactgaactccaggggatctcaactctgcagtttctcttcttccaaactcagaaagaataaaaacgtggcagcacgatgatgaggagaaggaagagaatgataattttgatgacggggtattgaatgggcagaaactgtgtggaaggcccgtgctaagcacattgcatttgctgtctttgaatccttacaaatgctatcgtggtagttgctgttgttatttctgttttatagttgaagaaaatacagcaaaagtttcacacaaccagcaacagtttgagctacctgttgactcctacccactgtcagtctggttgtgtaggaaaatcctcccccacagcacagtggatccttgtgcctctgggaaggggagctgaagtcccaggaagaagtgggtgtggctgaactatcatacctcttctgcccttcttactcctcacccagggtccttcagagaaccaggtgctccggttgtgatctcagtctcacgtcagagatttgcaagctgcttaaggaagccttctctgtgacttccacactgattattctcacaggctgcctgctttcttgcaaacctgtttcttgttttcttccaggaagtcacattgcctgtgtcctcccagaacctaagagacaagagctggctggcctcaggggccagcagccaggctctcctgtggctgtgggacccccaggctttggagcaagcctgctctgagttctttcctgcaagggttcgggatcctcatctcactttatattgtcaagggcccaaccctcggagcctctcttcctccccgtctggtccctgcttctccactgtggggtttgcttcggctgtcccatctccatgctctcagccctctcctcctgtctctgactttggaacaccacctcaccttggctttcagctgtgtgactgccctcaccccaattctctcttgtcatgaatcaggaagccccaaaccttcggcagagccatagagttttgtgtttgtttgttttattgtgataaagtgtacataacataaaagttaccatcttaaccatctctaagtgcatagtgcattcactttgttctacaaccatccctgccattcatctccagaaccttttcaccttcctcaactgaaactctgtacctattaaacactgactccccattctcccctctcctcagtccctggcaaccactattctgcttgctcccttttcttttattgatatcatattcatacatattttgagggcatggtaatgatcaaatccaggtaattagcatatccatcacctcaaacattctttctttgtattgggaacattacaattcttctcttctagctattttgaaatttgcaatgaattattgttaactataatttccctactgtgctatcaaatactagaacttattccttctctttgtatttctgtacccattaaccaacttctcttcatccccccacccacacacccttcccagcctttgatgtcaatcattccactctctacctccatgaaatccactgttttagctcccacatatcagtgagagcatgcaatatttgtctttctgtgcctggcttgtttcacttaacataatgacctccagttccatccatgttgctgcaaatgacagaatgtcttttttttttttttttttttttttgagacggagtctcacacttgttgggcagactagagttcagtggcacgatcactgcaacctccccctcccgggttcaagcaattctcctgcctaagcctcccaagtagctgaaattacaggcacctgccaacacgctcggctaatttttgtatttttagtagagatggggtttcaccatcttggctaggttggtctcgaactcctgacctcaggtgatctgcccacctcggcctcccaaagtgctggcattacaggcatgagccactgcgcccagcctcattctttgttatggatgaataatattctattgtgtatatatgctacattttctttatcattcattcattgaaaggcacttaggttgcttccttactcttggctattgtgactagcgctatgataaacatgggagtgcaggtatcacttcaatatactgatttcctttcctttgagtgtatactcagcagtaggattgctggaccatatggtagctctatttttagttttttgagggatctccataccattttccatagtggctatactagtttatattcccaccagcagtatccaaacattctcttttctccacatcttccctagcatttgttattttttgtctttttgataatagccattgtaactggggtgagatgttatctcattgtagttttgatttgcatttcattgtagttttgatttgcatttctctgatgattagcgatgttgataattttttcatatacctgctatccatttgtttgtctctgagaaatgcctattcaggtcttttgccctttaaatcagaattttattttattttgctaatgagttgtttgagtttcttatatattcaggttattaatcccttgccccttaaacactaagtccccattttcccctctcctcagtccttggcaaccaccattctactttcttttttttttctgaaatgaggtctcactctgtcacccaggccggaatgcagtggtgcgatctcggttcactgcaacctccgctttctgagttcaagtgattatcctgcctcaccctcctgaggagctgggattacaggcgtgcaccaccacgcctggctaatttttgtatttttagtagggatggggtttccgtgttggccaggctgatctcgaactcctggcctcaggtgatccacccacctcggcctcctaaagtgctgggattataggcgtgagccaccgcgcccggcttctactttctgtctctatgtatttaactaatctagatacctcatttgagtgctatgataagtggaataatatttgtccttttatgtggctggcttattttaattagtacaatctattcaaggttcatccatgttgctgcatgttctgaatttctttcctttttttttcttttttttttgagacggtgtctcgctctgtcgccaggctggagtgcagtggtgtgatctcggctcactgcagcctccgcctcccgggttcaagtgattctcctgcctcagtcttccgagtagctgggactataggcacgtgccaccacacccagctaatttttgtatttttagtagagactggtagcattttcaccatgctggccagcatggtctcaatctcttgacctcgtgatccacccgcctcggcctcccaaagtgttgggtttacaggcatgagccgccacgcccggccttctctccgttttaaagctgaatgatattccactgtatggatgtaccatgttttcattatctgttcatctgtggatggacacttgggtggtttccacctttttgctgttatgaataacgctgctatgagcatggtatataaatatctgagtccctgctttccttctttcgtcttagagttcttgtgtgcctattttttctgttggttagggatggaaggctgctaagcccctcactttacaattgtggaaactgaggtacagatggagaggtcactagtctagggtgagacctagctagctggagagccaggttttgggcttcttgactctgccgagcgtgtcctccaccctgtcccactacctcctgctttggcccaggccttgggcctttaaggtgggatgctgaccaaatcctctcctcacttacaacagggcagatgtctctgggcctccccaccctctggctcccagccccgccctctgcccagccagcctctggaactttgcatctttcttccatcggtggagaacagcagtgggccctgagtctccagacactgcttcctaccttggggttcttgggcccagctccgcaacctctctgtctccgactccccagcaagtgcccagtgttttcaaagagcaaaagcctggctcttctcctgcaccatcagaagctgggacatttccaccctggcttctgcccaaacctcagacacaagtgctgttgtcttctcagaggggcctgaacctggcttttcccccacacacttgaatccacattctttctggggacgaggaggagaggaggacatttgaagggcagggagaggaaaaggaacgtttactgagtttttttttcctgaaccaggggctttaccagggggctttatgctcagcaggccttaggccagcttcagagtgggcactctccataggccccaactaagaatggggtgcaggcagagctggcctgtcacccaccaaggggaagctgcccttcccctgccagcagtgatgtgggaggaatttccctctttcccttcatagggaagcatggctgctggcctgagattatgcaatccagccctgcaggcctgggcctgaccctttgtccctgctgcatcagccatgctgctgaaatgcctcactgatctccatggtgcccagggcagtgctctctggtagaaagcccttcctcacattgctgacacatctcttcccaaatcctctcttgctgtctgtcctcagagcggtggtagcagttactaccaaccagacttttcttgaaggcctcatgctaagggcttttacaaggatgccttatttcatccttgtgacaattctgtgaaattgagattagtcaagtgagagtaaatcactttccaggtgagcgcagctgctctgcagccagtgtacctcagtactgctgtactagttggtaaaatagtgaagtactctctaccactggaaaattgctgctgctgctgccctgcacccgaggggcccttcccagacccactagccaggctgggagctgaaggacccctctccagccactgacctagagtcagctcagtgaggcttggactcagtgatgaaggtgtgagtggaatatgcaactccctacacccaactcttagcacagcctgggctcgttccagatttgtcagcatcccaaaatccaagtgtttttccactttccttgctgacaatcaggtcatatatgccagttaatgtggggttttgcctgagtttcagaacttcatgttggtccctgttagaagtcatgtgaccagtttgggccaagcacaccagcctgaccaatagatctgagacctcccctgtctgccattgtgttgggtgatgccaccttccctgggcctcagtgttgcctctatcagcctgtgctccccacaccctggctccggtgactggggctcctcctccctttgggctgcctctggacaaagaccttgcaccctcatcagtgggatctgtatccaaatgagatacacctcatagttgttgcaaaggataaatgaaaaaaatacaaattgtgagttccttgaggaaaaggactgtgcccaccattgtatctctgatgtcagcccagacttggcatctattaggtgtttaattattgtttattgagtgaggggggaaacaagtcaccttgcaagggcttggcacatagcagacctcagtagatgctattgttgcagtgattgctttaatgtgatatatattattgttgtttttattgttatttttagacacagggtctcaccgtgccacccaggctagagtgcagtggcatgatcatagcttactgcagccttgaactcctgggtttaagtgatccgcccaccttggcctcctaaagcactaggattacagatgtgagccactgtgtctggtttatattatttatgaggtggcttgatggtttcaagaataggtcccatcacctgtatggatgaggggccactgacacatgtccctgtgtctagggaggttcaggagtgaggcttgagcccctgacttagggatatacctctccgcccagagttgtgtgaattgaaccctgagtcctatgtacctggatatgttcactaattccttctgcaaataattgctaatgtacccatctctcttttgggctctgaggacatagcaattggcaaatcaaagcccctgctctcatgaagcttatattttagtggggtgaggggacagagcataaacaaatatgtatggtgtcaggtggtgataagtgctgtgatgaaggtcagacaaggtaagggagtcacagtggggaagtggttacggtcttgtgttggctggtcaaggagggctttcctgataagggaatgttggagcagatacctaaaagagaaagctgcacctgtatctggaagagaatctcagtcagtgggagtatcaggtgcaagggccccgaggcaggggtgtgcctggcctgtgtggggaatagctaggaagccagcgtgtggaacaagtgagagcacagctagtaggagagaggtcaggcaggtagctggaagggattgatctcacagggttttgtaggtaaatgagaagccattggaggattttgagcagaggaaggacatgatctaacatgtttaaaacgtggatacttctcagttccttatcctgctgcgctcctggcctggcgagtgagaagagctcactctggctctggtgtgaacggaacacagaggaaccatggcagaatcggaaagaccagttaagaagctcctgatgatgggcttgggcattggtggaggaggtggtgagaagggtagattctggttgtgttttgaaggaggaaacgacaggatttgtcgatggagtatttgaggttattagagagggaagagtctttggcctgaagaaccagtagcatagagttacatttatcaagattaggaagaacagtgaaaaacaagttttgaggggaaatcaagagtctaattttggacgtgttaaatccaggatgcctttcacacatacaagtagaagtcagggtggcagctggatatctaagcctgtaggaggggagacctgtgggctggatagaaatctgggtggtgacctgtaaagctgcaggatgagagatcaccaagaatgtgactgcggttagagaaggacccaccaatgtttagaggctggggagaagaggagacagggcaggaccagtcactgtagtaggataaagaccaagggagagtggcatcctgcagccaagtgaagaaggtgcttcacaaaggcagggaccatcagctaagctgcatgagagaccggccaggagcccagcaggatgaggaactgagaagcacccattggatttagtgacatggaggtcattggtgacttgacaagatcagttttgatggagtggttggagatgaaagtctaattagagtgggttcaagaaagtggtggagaggaggagcaggcagcgaggataggcaagaagcgtttctgaaaggaggaagagagaaatgaacagtagtgggagggagaggtgaggccaaggggcggggttttgatttgtaattttttttttttttttttttttttttttaaagacagggtcttgctttgtcacccaggctggagttcagtggcatgatcatgactcactgcagccttgacctcccgcagtcctcccacctcagtctcctcagtagctgggaccacaggcctggcaaatttttgtattttttgtagagacggggttctcactttgttgcccagactggtctcaaactccagggctcaagtgatcctcccagctcagcctcccaaagtattgggattacaggaatgaaccactgtacccagctttatttgtaaatttttttgtttcattttattgtatttttgagttttaaaatatatatatttatttatttatttatttattattttttgagacagagtctcactctgtcacccaggctggagtgcagtggcacaaccttggctcactgcaacctctgcttcccaggttcaagcgattctcctgcctcagcctcctgagtagctgggactgcaggcgcccgccaccacacacagctaatttttgtatttttggtagagatggggtttcatcatgttgccaggctggtctcgaactcctgacctcaggtaatccacctgccttggcctcccaaagtgctggggttacaggtgtgagccactgttccaggccaatgtatttttgttttaagatgagagaaattacagcacatttacctgctggtggaaataaaccaatagagaataggatgatgaaggaacaacagttttagcagtgtcctcgaacaggtggcagggacctggagccagtgcttagctggagaggatggtcttaggagcagagctgggtcatccaccctagcgagagggcaggtggaacatgtgttttacagggagggaggtgggttgatttttttcctcatataactttttttattgagataaaattcacatgcagaattcacacgcacagttcagtggtttttagtgtattcacagagttgtacaaccacgtattgctgattaacaaatcagtaattactgtaatcactgccaactcattcctgaacgtattcatccccaaccctgctcaaaaccccccttacccatgagcactcactctccattctcccccctcctcagtccctgaaaccattaatccacttcctgcctttatggatttgcctactccagacatttcatggaagcagaatgggacggcacatggtctcttgtgcctggcttctttcacttagcacagtgttttacaggttcgtgctgctgcagtgtgtatcagaattccattcttttttatgatattctagtgtacggatatactacattttgttttttgtttttgagatggagtttcactcttgttgccctgactggagtgcagtggcgtgaccttggctcactgcaacctctgcctcctggattcaaacaattcccctgcctcagcctcccgagtatctgggattacaggtgtgcgccaccacacccagctaatttttgtatttttagtagcgagggggtttcaccagttggccaggctggtctcaaactcctgacttcaggtgatctgcccgcctcggcctcccaaagtgctgggattacaggcgtgagccaccgcgttcggccatatactacattttgtttattctttcaccagtcaatggacatttgggttgtttctacttttggccattgtgagtaatattgctgtgaatgttcatgtgcaaattttcatgtgaaaacttgctttcagttctcttgggtatatacctagaagtagaattgctgggtcatttggtaactccatgtttaacattttgaggaattatcaaactgtaccagcagtgtgtgaggggtcccatgcctctcagatgggttgatgtggggtgcaagcatgtggaatttatctcctggtagatccctgtttcaattcctgagctgagagtgcaagcttggcaaaagaggtcaggtgggtggtggtcaccaagggagtgggagaatgatggagaaggatggtgggcactctgaaggccctggaagttgatgctcaggcctttaaagggggagaagccagtgcactcatgagttttctcttccctgccacccatggctgcccaggcgcaggtgcggagtaggtggagagtttggtgtaagcaagtggggtgaatgcaggaagcagcctccaggcttctgtcctccatctctgtcctcacccctccttttagacctgctcttgttcacaggctgtggggatgccactgccgactcctgctcaaagacaggctggtgtgaggagcagagcaaggcttggaatcagacgggcatgggttcaaatcctgcctctactgctcattagccatatgaacctaagcagatcactagccttgccctgcctctgtctcttcacctgtcaaatgctggcctcccagaggggttgcaaggtggaagtgggattataggccagcgctcccagttgtctccctgtttctctgcgctgccaggcccccgtctgttggtgtgatattcctgggctctagttacacagctgagatccctgctgtcctttctcctttcttctcttccttccctaagagcagcattgagggttctaggttcctctaagaatcccacagaaccatagaccatatccccagaatgtgcaccgacatatgcagtttgtataccagttctggggatcacgggccttgtgaaaacttatcccaagaccccctcactccattccccacagctgcagggtgtagcctccagcatgagcgacccccaaagctgatggccggcacttctcccctgatgttttccttaagccagggtgttgaggaggttggggccactggcaaagggactcttccctgtcaccagggagccagttggtgcccactacaggactttagcccccttccccttggggagtcccaggtgtcctggctgtctgcaccctgccagcattttggagaagttcaagaaatcagccctttttctaggaacagtgcacggtgaatgcatcagcccttttgcccagcacccaaccccactccatagacacccattacccagaaaggggagcgcaaattaaaatagtaaacacccctcatcactatgtgtgttcaactaagtgacattatttttttgaatctattcttaagcttccttaccttattcttctgtaaaatgggcataatcattcctgcctcccatgacgggtttgtgaattagagatacataaaacattctaggcatggggctgggcacagtggctcacgcctgtaatccttgcactttgggaggccaaggcgggcggatcacttgaggccaggagttcgagaccagcctggctaatatggcaaaaccccatctttactaaaaatacaaaaattagccaggagtggggatgcgcacctgtaattccagctacttgggaggctgaggcatgagaatcacttgaacccagcaggcagaggttgcagtgagctgagattgcactactgtagtccagcctgggtgacggagtgagactctgtctcaaaaacataaaaagaaagaaaagaaaagaaaaaagaaaactttaggtatggcccttagaggcatattatctctagaaattgttttctctattgcttgatattccgtgacccttatttcaccctgtaggggtgtcataaaagtttttgtttttgtttttttgagacagagtttcactctcgttgcccaggctggagtgcagtggcgcagtctcggctcactgcaacctctgcctcccaggttcaagcgattctcctgcctcagcctcccgaggtgctgggattacaggtacccaccaccatgcccagctcatttttgtatttttagtagagactgggttttaccgtgttgtctaggctagtctcaaactcctgacctcgtgatccgccctcctcggcctcccaaagtgctgggattacagatgtgagccaccgtgccccaccatgtgtcataacagtttgaaagtcagtttttagtgatctcccctaaagctgggggctgttttaacccagtgatggcattttctgtagagtgcagatgatgcatctagtcattctgcaagtattttttgagccttccttgagtgctgaagcttttgtgggcccagggaaatgaaagccaggctcccacattctgggactctaccccatggtgaggagctgagccaggccccccagacttggaggaacagatgacacacgcaacaggaagggctcaaagatggaggtcagaggctgggcgctcttgtgaggaggaagggagatggactgcatcccagctggaaggcggctgggacagccagtggagaggaggggaaagggcattctagatggaagtcacggcttgggcaaagacttggaatggagatacggcccagccggttctaggatagccagacagtggtggttctggttgaagaaaaatgactggacaggctgggacccttgggccttagggaaataggaacacccttcttcctggtgcatggcctttagtgggtccctttaactcctggacctcaatgtccccatctatactaggaggatggtaatatcttacttccaaggctgtgaagaggactgagagagtgggtgtgtataaagcctttggcatagtgctggctgccagcaggaacacggtgggtgggaccacttttagccaaagatcttgaccgtaccctgggctatgggccactgtcggagcccctggagctcatgctgtgacttttctccctctggaagcctgggtggaagagggggagaaggtggctcacgcctgtaatcccaggcgtgggcagttttcctagtatttctcaggagggaacaagaaggggagaagggaggaggagaagcagagaaaagggggagaggtgagggggaggaggagaagcagagaaaagggggagaggtgagggggaggaggagaagatcttgactattacatcagagccccaggctggtgctcctccatgctggctgccctcctgcctgggactacatgccttgccagcatgtggggcttgccttggcatctgaaatcgataagctcccagcagttccagggtctccagttaaatcctcctttgcaaagctgctgggtcccttgatcccttgtcctcaagtgggaggattggagcatcgcagacagatgtgcacaacactgaccctgtctctccatttatctttctccttcctcctcccccagtctggctgcctctctgtctctgtctatctgtctgtctctctctcacaaacgcacacgcacacgcacattggcagcatacctcttctcccacagtgactaatactttctgtctctggagtcctcctaccttcatgacatcaggcatggggaatgcaggcaggatcataatttcttaatagtgtagctgcccattatcttcagcctcccccaggaagccctggagtcagaactgctgacaaggggcctgtggccgggcatttgcaggtgtatgtgtgtggaggggtgggctagacaaggggtgggctagtcccacttgggaccaggcccagctcagccacacacccctcctccctgctagccctcccagaccaatggatgggttcataccattcctggggtagattttgtcccttccgtttcatctgccattattagtgtatttaggttttatatgttttctggagccaattttgatcatttatatttcttgaaccatccatttcattgagaattgaaaatttattattatcaaactgtgtatggttttctccataattaaatatatagctgtatccatagtcagaggccttttctcattccaaatgcttgtctttttttctctgataagaattgctgaaagctgggtttttttaaattggtcctttgaaagaatctgcttttgatttttagatatcagctactttcccctcctcctactctggcaatttctacttttattgatacctttttctttctctcttattttagtttattttcccttttctagcctcttgatttaagtgtttagttaattttcagttttagtttctgaaatgcatttaaagctataattttcctgtaagtaccactttggccttaaatgagaggttttatttctgttgattgtccttcaattctcaactgtgatttctgctttttaattagagagttatagaggagcatggcttttaacattttcaggtggctagattctcttatactcttgtttctgttcatttctgatcctgttacagtacaggttgagcatctgcagtccaaaaatctgaaatctgaaaggattcaaaatctgaaactttttgagcgcttatgtgacgccacagtgaatagtccacatataagtacttaatatgaactttgttttatgcacaaaattctcggaaatattgtataaaattattttcagtctatgtgtataaatataaatgaatcttgtatttagacttgggtcccatccccaagagatctcgttatgtatatgcaaatattccagaatcttttaaaaataaaaattccaaaacacctctggccccaagcatttcagataaaggacaaaacttagcctataggatttctgccttctggaatttgttgaaatttttatttatggcctctaatatatggccaaatttcatgtatgtttaaaaatgcttgttcatggccaggcgcggtggcttacgcctgtaatcccagcactttgggaggccgaggcaggtggatcacgaggtcaggagattgagaccatcctggccaacatggtgaaactctgtctctactaaaaatacaaaaattagctgggcatggtagcgcatgcctgtaatcctagctactcgggaggctgaggcaggagaatcgctggaacccggcaggcggaggttgcagtgagccaagattgcaccactgcactccagcctggagacagagtaagactccatctcaaaaaaacaaaaaaataaaaaaatgcttgttcactattggaatgtaaagtttgttctgtctctcagaataagcttaaattttgtttttagagacaggttctcattctgccccagaggctggagtgcagtggcaagattgtagctcattggaacctcaaactcttgggctcaagctgatcctccgctttatcctcccaaagtactgggattacagggatgagccaccttgcccagccaagtatttaaattttgttatttaatgacaggacattgcttttggagataatttgttctatatttaagagaggcctcttcaagtctctcataatgattatggaatttgtcaattcctgttgtttttaaaaatccttttttttgtccacatacgtgtttaagcaacatgcctagatgcttatgattgatgactgcggcacttcttgatgcttgtacctttccgattataaatactctgtctttgtccgtttcatgatctggccttgaattctgttttgtagatgcatttcttttcttttggttaccatgtggctggcatgttctttttatccttccatttttcatcctctctgtcattttgctttatatgtgtctttgaaagaaggcaggcaaatggattttgtatttagtatctgcttttaatagatggatttaatccatttgcatttattgtgatgagtcatagatttatttcagccatcttatttcatgcctactttttattatatttgcttatttttgttaagtttatttttgccttttgttggattggtttcatttactttgtcctgtttttcctctgttgcttaggaagtttgaggtgttgcttaggaagtttgaggttttacttccgttcttctattggttatgctatatatgtatgtgtgtgtatactcgtatttttctatcagcatctagatgtaatcaggatcattagcctcttgacaaatgaggcgagaactttagtacttattttttcctggctcctaccctcacacattggatcatcttagattttagttctacattatcatctattctcttcaaattatgcaacaacatttagttaaacttacctgttcttttaaaaatttgtagagatggggtctcactgtgttgcccaggctggtctcaaactcccggcctaaaactatcctcctacctcagcctctcaaactgctgggattataggcttgaacttactgcactggccttaaacttaactcttatgttttgctgttttcttcgcttaccactgtttgtagtatcactcttctttctctttgatggttttattttttactttgtaagaattcttccagaaagcctgggtgatataatttctaagaccttcaatgtctgagatgactgtttttcctttccatagggtccattttgattttcaactccctattaattttttttaatttgaatgatcatattttaaaatatcctagatctctagtttccatttagatagtatataccttcaaaatctgtaaatatatgaattacgatattgccttaatgtcttctgcttttttcttttttttttgagacagagcttcgctcttgttgcctaggctggagtgcaatggcgtgatcttggctcactgcaacctctgcctcctgggttcaagtgactctcctgcctcagcctcccgagtagctgggattacaggcacctgccaccatgcccagctaattttttgtatttttaatagagatggggtttcacgatgttggccaggctggtcttcaactcctgacctcaggtgatccacctgccttggccttccaaagtgctgggattacaggcatgagccaccgcacccgggtgtcttctgcttttcgattcaggcctttccacccacacttcaaccaaatgcatgctgtttccgtctgttttattaattgcagttctgagtcgaatttttttttttttctaagaaaaaaaaaagctgcagtccctccagttgaaggtgcagtcttcctgctccctcctgggaaatactggggaaactgcccggtccttggctgtaggtcctgccttctgacctcttcatttcacatccagatgaaatagttctaggatatcagagctgtaaggacctgctggtcccggagccccgcccctcatttcctacatgagactgaggcccagggaaggagcagaagtagccatgagctgcttttatgccctgggcacctcttgggtcctcttgtccatcactggcccctctgaagtgccaaatggctctgggggatgtgcagcaatgaagggctgtggggacaggtgactttcttgggtactgtgtaaaggtgcctgtctaagaagatgtggattcccaggcatcgctggatagcttgtcctgtggctttccttgccatctacacactggcaactcccacatctgtatctcttgccccctcttctcttctctatgtctgacttaagtcccccaatacctactggaagtcaaacatggtgtctaatagactctgaagcctgtgtcaaaaactgagtcccccaaaccctgtttctcacccagacttccccacctcagcatctgggatcactattcccctagacgctcaggccagaaacaggcgtcatcctcaatgcctctttttctcacctctctatccccacactttcctccagaaagctctgctcctgttgactctgtcttagaaagtggccttggtctggtcacttcccccagcacccactccccgccctcggctccaccagcatgtgttgcctggattcttgtgctagcctcctcactggttccctgcttccagtcttgctctgttttccccagcagccagaatgaacttttcaagatgtcctctagagcatgcctttctttttctttcttttttattttttatttttttttcagacggagttttgctcttatcacccaggctggagtgcagtggcgctatctcagctcactgcaacctctgcctcctgggttcaagtgattctcctgcctcagcctcatgagtagctgggattgcaggcgctcgacaccatgcctggctaatttttgtatttttagtagagacggggtttcatttggccaggctggtctcgaactcctgacctcaggtgatccacttgcctcggcctcccaaagcactgggattacatgcatgagccaccgcgcctggccagactatgccattcttttgcccaaactctccagtggccccagtcttgcttagaaccaagtgaaacttacacagtgtggcaggccccaccatctgcccccacctcctctccatccttcacacgcccttcactccccttcttgcccttgcacacctccacctttgagccttcgaatttgttgtgttccctctgcctggagtgctcttccgctaggccacgtggctccctccggcccctcatttagtcactgttcaaatgtcaccttctgatattggtcctccttccctacccaaaatgacaccaacttctgccagtgaccctccagccgactatatcattcttcacactgtgtatctatctccactaaaataacagccattcatttgttgatctgtcttgcttctagatggtgagtcccataaaagcaaggatttggtctcattcgccttctgtccatagggcctagaacacttcctgccacctagcaggcactcagacattccttaaatgaatgacaagattggacagacttcacatttattttttgattcaagtactgttcggggctactttttggccaggccatgagtagacaggtgactggcacagacctgccgttacccctgggagctaacagtcctgctggggacaactacatggctggccagaagtgttcccggaagggttggcatggggctggggttggtcctggggctccagctacagccaagtcagagtccgctcaccaaggccagtggagaaggggagggaagggggagttggaggaaagtgtcctggactgcgagggtagccagagcgggagagaagaccccagtgaggatggcaagctcacagcagaccctcccacagggcttttgtgccaggcactgcactgagggcattacatgtattaactgaaaactaccttgaccatccccattttaggaaatggtggcacagagagggtagcttgcctggggtcacacccaggcatgagaagccagactccgcccagtgggctggctccaaaatctgtaaccacccgctcccctgcctcacaggagaggggaaggtggatctggtcaggcagcagggggactgggaagacgcaggggaggctaagccatgagcaggtgcttggaggatgctgcaggttcagacttcatgcccccagagggcagaaaggggtcaggcctgcactgctaaaaggaaccccccaccctgcctaccgagcttgtggctgtgagcagtgggatgagactttccctcagcaggaaggaggctggaggaaggtggcagtgaggggcgagagcacctgggcaggagtagttggggggatggatgggttaggaggaagagcttccagccccagcctaggaggaagtgccctggctgtgaggggccgctcctcccccagggtctccttggtatctgtccccttgggggctgagaagcccttcctgcccagatggcctcttcagggcttccccccaggcatgtccacaaataagctcttctcccctagggggtgcaaggtagaggcacggttttcattgatagaggaggaaaggggaagctcagagagtcaggcagcctcccaaagagtcacagtttgtaggccctgcagcagggatccaagcccaggtctggccagagggattgtgtagcagagttcatcactggcttcatgaggcgcgtctgtagatcagagaatttaggcctagtaagcacatggggtgaaactggaggagaagggtttggtgggtccacagtgagtcagagcctcaccctgaagcggctttaaggttggggagcttcagctgggacccttcgagcagccctagagagagagcttatgcagcctctcacgggacagctcggactgggccacggtagggacagcagcagcagcagtgttggagtcttgcaggctgtgggggctacagggtaggtgaggacagcccctgagtggcctcatcccaccccagttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacaggtgagcatcaaagacaggtgagagtaccgggaagaggcctgcgcctgcctcctagggcgctctctctctctctctttctctttctctctctctcacccctaattaaaggcgtggatttttttaagccttatgtggagtaattaaatcatttgaaatctggtttatactcatttggccttgttgattctcaaagaggctatgtaatgaaaataaaagcacaaactaataggaaaagaacaagctttgagcaaattccattaaagacagaaaaaaatctagctaacatgtgttccaaaggcaaagtgttaataagtttaccaggtaaagggacacacatacatacacataaagctcccacagattaatgtgggttttactccgaatacatgaattgcaaaagagaaaacaaaaatggctcaaatgtgggaaaatgttcaactttcttgctaatcaaagaaatatagggaaaatagtaaagtaccatttttcacctgtcaaattataattttttaaaatggaaatacccaatgctgccaaatactcaatgctgcggtgagattgtcgtttcattcagttttggacaaaatttggcccatgtcaataagaatctttacggtggccatgcctcttgatgccctctgctgggagccatcctaattgtgcagctggttgtgtggttggtacatctgagtgacccaagagatgggaaccaggtctggggagccagcccctggccagcagcccctcaagtcctcaccactggccttgcaatggacctgaggcttaaagccaagatagccagcagcccccgggccctttcccccaagccctgacctctctctggaaaggaagagggaagggactgcagtccaggctgactggggaggtgctgtgggctggctgtgctatgcctgagatgtgaatgtgccaccttaaccaggtgtgaggggtggtggaaacctcacagagctgctgttcctttatttcccagggagtcattcccgatgatcctcgtggccaacaaggtcgatttgatgcacttgaggaagatcaccagggagcaaggaaaagaaatggcgaccaaacacaatgtaggtgtgtgcgtgtgtgtagagggggtcaggagatgtgtaaaagctgtagcctggtcacccctgcagtcctggtctttggaaatgaaactactgtttattgaagggctccccttagtttaagtcttgttgctactgaaatcctgcaattccaggaatccaggtaatgcacatcagtgtttcgtcaatggtagagacaggtcccctagaaagaaagtagaaggtgtctgggacctggggggatcatacaactcagggacttctgagtgatggggtgggaccacaggtggcagtggtctgaggccctggaacctgggccattactgagccggtaggagtacaggatgtgaaggggctccaggtaggtcccagcttgagctgcggtgccttcctgcctcccctctgggtgtgtgcagggatgcacgttgtcctgacttacaggggccccataggactctactggccgcttatcaggggcatctgccatggccggatttggtgtccaacctggaagaggctccaaagcagacctcagcaccccttaccagggccaggagaaagtggaaagtgtgcccagttcaaaccctgattctctgccagccggtgttgaccttgagcaagtgcgtcattctgagctcagtctcctgagctgcagaatggagatacttgcttacctcagagggttaatgtgaggactaaaagaggtcagggatagtgagacctggaaagccaaacagcccataatgaagagcagtttccatttagtgttatcagaggctcaaatatttgtccaatgaatatttcaaaggcttaagctctgccttttgtgctctgcgctttgtgtgtctgttggctacaacagaagtgtgcacatccaacctcacgcgatgatgatggatgggaagatactgactggtttgtgttctgggcaatgatttacaatctactcctctaaaacaacaacttactctgtcgccctccatgcatttcaagtgttgattatttttctttccttcactgtgcttttctttttccagcatattataatgaaaggcattaattttgtaatcagaaaaacttatgaaaaataacaaagttattcagtctaatcacactcagcttacttccatctgtctcatcaagggaggcctgtgtgttccccaccctgctccccgcctttggggaatgaacacttcctgccttggtggggtccctgctgtaggagaaggtgagcgctcaggagtgagtgtgtcctgacctcatagagcctttgttctcctccctttgccagcccgaggcttggtgcagatctggccctggaaacctgctctgtggggccaccacagtcgtatctcccgctgtctgcaccctttcgaccgggtgatgatttctcaccattgaacgtgcagacaaaaaccttgtgtaaacatggctgagctcccaggctcatagatacagatcaaacaagagctgggatgaggtgggggccagctccgacggggccagggtcacctgggcccagaatcctggtcatggcccagcctctcctcagccttttctaccacgtccactctggaggggcccagaaagagggacagaagtcatcccaaggtggagcaacagacctcagaaagaaaaatggatagaatcagaatgtatttttgataaatgaaacagtctttcatcttcaagtatataaaaagatcactttattctatttttagggagctattaaatatctctgtgcctagagaacaagagggaattggaaaagccattagtaacactttccaacctgaaagagtgaaaagccctaaatgatgcttgaggctattgggggctggggcttctgtggggggttttgaaagcacctgggttcctcagaacctctgggcatttttaagggtgtaacagggctttgaggatctctgtgccactttgatcaagttgagctttgccttccagattccgtacatagaaaccagtgccaaggacccacctctcaatgtcgacaaagccttccatgacctcgttagagtaattaggtgagcactgccctctccctagaagcgggcctccacagcatgggttggctcctggaggcagctgggagcttgaggaagcagctcctgttctgaggccatgaggctgtggaattctgggcctatttttggatttcttgtccctccttccatttctttcttttgctttttccacctacctctgccctccccgcagctgctaacgggtttgtgggtgatgtctgctgcacatgttaagtggaaatgccttcctgtctgatgcagtggctcaggctccctggaaggcagctccctccagcctggcttcagtgttctcctcacaccaaagctttccacactgtacaaactaggtctctctcctcttccctgccctgatatcagagcaccctttgatatttcccctgaacaaccaatattctgattccaaggttcaaatttcagaggcattgcacatgtatctcctttcccaaccccaccagctgtcaatctccaagtattgtcagcaatcctaatgaaagtttcttgtatattcctttgcatggtcagggtcaagacgttaatcacctcatgcactcatgactaaaacagcctcctggctgcatccgctgtcaccaagctatcccatttcccaaatctttaacatgcacagcagcctaaccagcgggtctcagacattgtgcgttgagtttgtggcctatatgctggcacctccaagggctgctggtgagctgtgagatcagccccggggctctaacccccactatacacacatgcccccacatgctcaaaaagctcatcttctcattattccccagcgtaatgaggaaatattacattcttcactttatgtttttgctggcagttttgcactctcaaaatgattttctcatccaggcgtagtggctcattcctgtaatcccagcactcagaggcaaaggtggaggtggaggcaagaggattgcttgaggctaggagttcaagaccagcctgggcaacatagtgaaatgccatctttacaaaagaaagaaagaaactatttgctcttgggcattttgcctccaattaggatgtgctgccatcaggtagcctatggtgatgccttggttgtgaacctatagtgccaaggtcaggttttagacataggaaaagttaacagaaaacatgaaatggcttttacgctcagttgacccatcattttatttaaactatgaaacacaggaatagaggccagcactctataagacaaaacgtgatgtagcttatgatttatgtaaatgtagctacaacataatgtcagtcattcccatcagtagggcgatttaggttatcccctcccccatctcccccattgcattgcctcaagagaagctatcctgccaggccctcctccagcggccaggacagccactgggagagggatggcatccccatccccctcacccactaaccccgccagaacaggcctcctctgactcagatctggggctagggaggagaggggcagaggagaagcaaagcccattctgactttgtctttctgtccttcattgtttcaaaaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacg

SEQ ID NO: 619 - DNA, 33638 bp, Homo sapiens
ggcctgcggcgcgcgggaagcggcgcgcgctgcgcgggaggtgacggtgcctctgactgtccgggtccctccaggtacggcttccctggcccgggcagctccgcggctcttttggtcgcgtcggtccgggccagaggccctcgccgagggcgggcccctgggccccgggatagctccggagcggcgcgcgttggggcggcggggccccgtccacccccggccccgcgcggcctcctcccggcggcctcagtcccagcttcccgggcccagcgcccggtccctgggaaaggcggggttctcctctcgccccgccgccccggtcccctaccccgtttggccccctcttccgggaggctcctcccggggcgggcccctccccgggctctcagggcgcgcccctagcccctactaagcggggacaggccgtgcagacggccggggcccctaggtagcctttacctgggtgtttcgttttgcttttctggatgtagcggcgtatcataaacttgtggatgtcaggacccagcgaagcattttaggtggagctagcaaggtgttattgtcagatggcaacgttaacatcctttcccaatgcagtgtgcattttaaatggctcctggcccctattcagcgctcaataaccctttgctgctgttaacactgttgtttaatccatcaccagcattttgcagctttctcctgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcagggtaaactggggcagagatagacatccgggaacactgcttgaagcaatagttttcattcttttacttaaaaccagtgtcggctgggcgcggtggcttacgcctgtaatcccagtgctttgggaggctgaggtgagaggatcgcttgagtccaggagttcgacaccagcctgggcaacagccagacatgaaaaagtagcgggacgtggcagtgtgcagctgtaggcccagctacttgggaagttgaagtgagaggatcgcttgagcctaggagtttgaagcaagcaacgatcactccactgcactccagcctgggtgacagagccagacccttctcttaagtaaatgaatgaatgaattaacgtatgtcaacaaactaaactactttgtcatctagcccagaatgctaaatttccagggcctgcggtgaacaatgaaagcaaaagagagctgctttcttttttttttttttgagacggagtcttgctctgttgcccaggtgggagtgcagtggtgcaatctcgacttactgcaacctctgtctcccaggttcaagctattctcctgcctcagcctcccaaataactgggactacagccgctcatcaccacacctggctaatttttgtatttttagtagagatggggttttaccatgttggccaggctggtctcaaactcctgacctcaggtgatccacccaccttggcctcccaaagtgctgggattacaggcctgagccaccatgcccggctctgctttcttatttgattcattttccctagattattgtaactggacgttcattgttttgggatcctgatcctggttcctactgggtaacaagttgctctagaaagaaggcggagggggacagtagacatttatgttttagatagggagttctttgattttatgtttcaaaagaaaaactaagttttctttctgaaaataagcatagttttgttttttttttttttttgagacagggtcttactctgtcgcccaggctggagtgcagtggcctgatcttggctcagtgcagccccgacccggggctcaagtgatcctccctcttaagcctcccgcataactggaactacaggcatgtgccatcacacttggctaattttttaaattttctgtagagactaggtctcactgtgtttccaggctggtcttgaactcctggcctcaagtgatttacccaccttggcctcctaaactgctgggattacagttgtgagccaccacacccagcccatagtattgttttaatacagacagtataatatgtgcccattctatgtttttcaaatgaatgtgttggtattgacagatctggaaggtagaaaagggaccagatggaaaagccatcgtggaatttttgtccaatcttgctcgtcataccaaagccgtcaatgttgtgcgtttttctccaactggggaaattttagcatcgggaggagatggtgagtattgctgtccttcagagattcttcgggaaccagatagatacctgtgtgtcttgtgtcagatagtgagatttgagctggatatgctttttttttttttttgagatagagtttcactcttgttccccaggctggagtgcagtggtgcaaactcgactcactgcaacctccgcctcctgggttcaagcgattctcctgcctcagcctcctgagtagctgggattacaggcgcctgccaccacgcccggctagtttttttgtgtgtttttagtagagacagggtttcatcatgttggtcaggctgatctcgaactcctgacctcaggtgatccacctgcctcggcctcccaaagtgttgggattacaggcgtgagccactgcgcccggcctggatatgctttttagttcaggtgtggctgaccctctcaatctgtcatttaggtagttcagtaaaatactgttctagggaatgtggtagagtcagggagggaggacagcaagatgaaaccaggaacacctgtttgaaaacagctgctttcccgcaagctcccaccaggctgttctaagacgagatggaaaggcacttaccattctgtcacatcccaagcaaggcgactgttctggttttgttggattgttagtttaacatctgtggtgatcagagtcagttctgtgtctctgtgtaattaattaaatggctttaggactgtgttagtaattaattggctttgggagttttttttttttttttttttgagacagtctcactgttatctaggctggagtgcagtggcacaatcttggctcactgcaacctctgcctcccaggttcaagcgattctcctgcctcagcctcacaagtagctgggattacaggcgcctgccaccacccccggctaatttttgtatttttagtagagatggggtttcgccttgtcagccaggctggtctcaaactcctgagctcaggcaatctgcctgcctcggcctcccaaagtgctaggattacaggcgtgagccaccgcgcccgggctatttgggcatgaattctaaactgggatatgaaagaattcagcaatggcaaagttcctcatggaggtgtgccatgctcagaagtgcagtgtgccctcccactggcccctcttcagtgggccctgagtagctgctcgtgtttgatctccctgtaagaaaggcagtagctgaaaagcacctaagctgccaacactgtggaaacccccgcaatgctccctttcttcacagtgacatacttgttgtaatacccatagtagcctctgaaacgctccagcagtgccggtcggggtaagatcccgcgtcggtacccagcttggcagctcctctggtttgacatctgtgtgttttctcccattccctgctgtgactgatgctgctttggagtcctggtgtctgcagtgccgggctgctggagggtgctggggagggagcataccgggagtgtcattaatgaatggccttgtgatttgtgcttgcttgtttggtgggaatagattgattcttgttttctgcctgtgcttaaatgggataaaactatatggaaaaagtaaaccaggctgggcgcggtcgctcacacatgttgtaatcccagcactttgggagaccgaggcaggtggatcatttggggtcaggagtttgagatcagcctggccaatatagtgagacctcatctctactaaaaatacaaaaattagctgggcatggtggtgcgctcctataatcctagctactcaggaggctgaggtggagaatcgctgtaacctgggaggtggaagttgcactgagccaagattgggccattgcactccagcctgggcaacagagtgagagtctgtctcaaaaaaaaaaaaaaaaagtaaacctttttaccatactttaaaacaatctagaaactattacaaaataaaacagaaatctaaagtttttttttgcaggaggaggaaaagagacctggttgagttcagtgccatgatacccagagtgcatgaagggatgtgtgtgtgtgtgtgtgtgtgtgtgtgtgtgtgtgtgtgtgcgcgcgcacgctgatttgtagagggaaaagtggggagcaggagcgccacctgggggtggctacctgctgtctgccctgaggttgcacatggcagcccccattttccaaagtcccttggtcttggaggcccagaaacctgctgttgtcagcacgtggagagtgttcatccatcagggccaatggcatgttaaccaagctcccagactaatgtgtgcgaataggattccggttaacttagcatgggaatgcaggctgggtgcggtggctcacgcctgtaatcccagcactttgggaggctgaggtgggcagatcacctgaggtcaggggttcgagaccagcctgaccaacatggagaaacctcgtctctactaaaaatacaaaattagctgggtgtggtggtgcatacctgtagtcccagctattcgggaggctgaggcaggagaatcgcctgaacccgggaggcgaaggttgtggtgagccaagattgcaccattgcactccagcctgggcaataagagtgaaacaccatctcaaaaaaaaaaaaaaaaaagaaagaaaaacaaagaatgggaatgcgtatgtcctcacaacctcattcattcactgtcctgctgtgcacattcctaaaagggaagctaagggatggtcagaaggttacgtggtaatcgtagagtcagaatgtggggagttattggacttagacaatgggtgacctcaggctaaagtacctgatatctataatggtattaatagctgacacttacatggggcttactatctgccagccattgtgttgtaagtgtgttatatacattggccaatttaatcctcacaacagcctgtgaggtagatatattgttatcctcatttttgagacagggtcttgctctgtcactgaggctagagtgcagtggcaagatcaggactcactgcagcctccacctcccgggctcaagtgatcctcccacctcagcctcctgcgtagtgggaccagaggtgtgtgccaccacacctggctaatttttttgatttttagtagagacaaggtcttgctctcttgcccaggctggtcttgagctcctgggctaaaacaacccttccatctcagcctcccaaagtgctggcattacaggcgtgagccaccccaccctgcctattatccccatttacaggtgaggaaactgagacatcaagatgctaagtgacttgctgaaggtttctgagctaggaacatttgccaacccttgcactgagggttctttgctgttttgtttttctattcagctatttataggttatgccttcagatttattaatgtagccagtcattttgcagtggcatttgctggcctagggacccttctgtttaaggtgattttgtatagctctgatctgttatgaatttgattttggagttttagctcagaaggcaatttgcctactttccctgttgaaatgcttggaagtaaatcatcctggccatagtgtccactgaacaacataaatgttgttttaataccctaaaaatcctgacatgcagctaatttttttgtatttttagtagagacagttagccaggatggtcctgggaggcagaggttgcagtgagccaagattgcgccactgcactccagcctgggcgacagggtgagactccgtctcaaaaaaaaaaaaaaaaatgaaaataaaaatcctaatatgaaggagtgtgggtgaagcgtggatcactgttactgaatcaccctgcagatgctgtcatcctattgtggaaggtgaatgataacaaggagccggagcagatcgcttttcaggatgaggacgaggcccagctgaacaaggagaactggacggttgtgaagactctgcggtaacttgggagggaccatggcagtgatctctgtttacgatgagtgcattaaatggaatataccttttgactttttttttcttttcttttgagatagggtctcattgtcgcccaggctggagtgctgtactgtgatcacagtaccctgcagccttgacttcccgggctcaagtgatcctctcacctcccaaatagctgggactacaggtgcatgctaccatgccctgctgatttttaaattttttttttttttttttttttttttttttagtatttattgatcattcttgggtgtttctcggagagggggatttggcagggtcataggacaatagtggagggaaggtcagcagataaacaagtgaacaagggtctctggttttcctaggcagaggacccagtggccttccgcagtgtttgtgtccctgggtacttgagattagggagtggtgatgactctgaaggagcatgctgccttcaagcatctgtttaacaaagcacatcttgtaccgtccttaatccatttaaccctgagttgacacagcacatgtttcagagagcagggggttgggggtaaggttatagattagcagcatcccaaggcagaagaatttttcttagtacagaacaaaatggagtctcctatgtctacctctttctacacagacacagcaacaatctgatttctctatcttttccccacatttcccctttttctattcgacaaaaccgccatcgtcatcatggcccgttctcagtgagctgttgggtacacctcccagacggggtggcggccgggtagaggggctcctcacttcccagacagggcggccgggcagaggcgccccccacctcccggacggggcagctggccgggcgggggctgccccccacctcctggacggggcagctgccgggcagagatgctcctctcttcccagacggggcggctgctgggcggaggggctcctctcttcccagacggggcggctgccgggcggaggggctcctcacttctcagacggggcggccgggcagagacgctcctcacctcccagacagggcggcggggcagaggcgctccccacatctcagacgatgggcggccgggcagagacgctactcacttcctagacggggtggcggccgggcagaggctgcaatctcagcactttgggaggccaaggcaggcggctgggaggtggaggttgtagcgagcggagaccacgccagtgccctccagcctgggcaacattgagcactgagtgagtgagactctgtctgcaatcccggcacctcgggaggctgaggctggcagatcactcgcgattaggagctggagaccagcccggccaacacagcgaaaccccatctccaccaaaaaaatacgaaaaccagacaggcgtggcggcgtgcgcctgcaatcccaggcactcggcaggctgaggcaggagaatcaggcagggaggttgcagtgagccgagatggcggcagtaccgtccagcctcggcttggcatcagagggagactgtggagagagcgggagagggagagggagacggtggagggagagggagagggagaggatttttaaatttctgtggagacagggtctcactatgttgcccaggctggtctaatttagaagttttatttatatgaaacagtcctaagacaatagttttaaaggatgaaagcataattaaaatggattttcttagtttcggctatacatttttcttagtaaaaagtattcaattttaaagatacagctatcctttttttttttttttttttttttagatggagttttgctcttgttgcccaggctggagtgcaatggcatgatctcggctcaccgcaacctctgcctcctgggttcaagcgattctcctacctcagcctcccgagtagctgggattacaggcctgcaccactatgcccagctaatttttttgtatttttagtagagacggggtttctccatgttggtcaggctagtctcaaactcccaacctcaggtgatccgcccacctcggcctcccaaagtgctgggattacaggcgtgagccactgcgaccggtcagatatagctatccttgaaagtagttttttatagctatagctaatatagtgccagtggaaattttggaatctcattttaatgcttagttctggagattgtccttatatttttgataacttgtccgtttttgagttaataattgctttttgttttgttttgtttagagtcagagtctcactctgttgcgcaggctggagtgcagtggcatgatcttggctcactgcaatctctgcctgctgggttcaggggattctcctgcctcagcccccaagtagcagggactacaggtgtgcgccaccacacctggctattttttttttggctaatttttttttttttttgagatggagtctcactctgtcgccaggctggagtgtagtggcgcgatcttggctcactgcaatctctgcctcccaggttcaagtgattcccctccctcaccctcctgagtagctgggtctgcaggtgtgcaccaccacgcctggctaattttttgtattttagtagagacgtggtttcaccatgttggccaggatggtctcgatctcccgaccttgtgatctgcctgcctcggcctcccaaagtgctgggattacaggcgtgagccacagcacctggctgatttttgtattttgagtagagatgggattttactgtgttagccaggctggccttgaactcctgaccacaggcagtctgtctaccttggcctcccaaagtgctgggattacaggggtaagctgctatacctggggagtaattgcttttttcctctttgtttttggattctaggggccacttagaagatgtgtatgatatttgctgggcaactgatgggaatttaatggcttctgcctctgtggataacacagccatcatatgggatgtcagcaaaggtaaatgatatatttttgttattagcaggaagaaatattctaagcatctataaaagcctaaaagtctaacttgctttaactttttttttttttttttttgagacaggatctcactctgccgcccaggctggagtgcagtggtgcgatcttggttcactgcaacctctgcctcctagattcaagcgatcctcctgcctcagtctcccaagtagctgggactacaggcatgcaccaccacacccagttaatttttgtatttttagtagagacgggtttcatcatgttggccaggctggtctcaaactcctaacctcaggtgatctgcccgcctcagcctcccaaagtgctgggattacaggcatgaaccactgcccctggccctaacttaccttaactttattttttatttttatttttttggagacggagtttcgctcttgtccaggttggagtgcaatgtcacaatcttagctcactgaaatctccacctcccgggttcaagcgattctcctgcctcagcatcctgagtagctggactacaggtgtctgccaccacacctggctaatttttgtatcattaacagagacggggtttcaccgttggccagtctggtctctatctcttgacctcaggtgatccacccgcctcggcctcccaaagtgctgggattacaggcatgagccaccacacccggcctacttgctttaactttaaaagcaacacaaaaaattgttttagtgaactaaagtaggtggttggctcaacaggataggggttagtcccatatgctatggattgtcagagggtaagaggcttagcactggtgctgcaagttactgatgctgaagccaggcaaatcccacatggtggggccagcagataagatgacaggcccgggccctgcctttatggaggttaggatctcgggaagattaacaagtcacttataatttatagggcattgcatgctagttgatggggtaggtgggatcaggtttccattttagaagatcaaggaaagccagggacattctgttctctagttggggagacagtggacatgtgaaaagttatagtggtgtgaaaatagctgtgaaatgccaaaagcaagtatggctaactcctaatcatttttatcccctgccatcctttactcaaactttgttttctcccaaacctcttcctgccaattctacaactcaagtacctgggtagggcagttgttgttggctgccaccgcagcactgtgtcagcccagttctcatccagtctataaaaatttttgctctttttagtaccatgctgtccagccaagccatcctccatcctccgttctgtcttgttttgtgtggtttttttttttattttagatggagtctccctcagttccccaggatggagtgcagtggtgcgatctcagctcactgcaacctctgcctcccgggttcaacaattctcctgcctcagccctcaaggtagctgggattacaggcgcccgccaccactcccagctaatttttgtatttttagaagagatggggtttgcccatgttggccaggctggtcccaaactcctgacttgaagcgatctgcctgcgtcggcctcccaaagtgctgggattacaggcatgagccattgcgactggccaggattttaggttttatcataagtgtgatgggttgttactgaacctcaccaaaaacctcaaaaaaaaaaaaaaaaaaaaaaaaagaatgacttgtcaggcacagtggctcaggcctgtaatcccagcactttgggaggattgctcaagcctaggaattcaagaccagcatgggcaacatggcaaaaccctctctctaccaaaaaaatacaaaaattagctgggtgtggtagtacatgcctatagtcccagctactagggctgctaagtctcttgagcctgggaagttgaggctgcagtgagctctgacggcgccactgcactccagcctgggcaacagaaccacaccctgtctcaaaaaaaaaagaaaaaaaaaaaggaatggccaaggcttcataactctcttgtctttttatgcaggcgatctctgtgtgctaaatattttccccgaagtcccttttccatccctgttcgcattgtctgctctgggccctcctcatctctctcctggtctactcggtcacctcctaactagtgaccctctttgtcatcttctaaacctgtttcacctttaaaatgcagacagcttctcagcttgaattcacagccttttccttacacacaaggtctctgtaatacttctcctttcctccttatcttctgttcttggccctcctctgtacccattagcagttctcagctacctctccctgctccatattcacttcgctaagctgttttaacccagggattccctgacaataccttcttccacccttcatcccctcttcatcctgcctgacctggggaactgaacttagatcttctcagaccctccgccctgtgctgtcagctcccctcccccggtccacatgtgtgatccttgcttgttgatgggtctgtctgatctgtgggctccctgagggtggggactgcatgaagtcatctttgtgaccccagagcctgacacagggttttagtacagagtctctcacttactgcctgctgagtgatgcgtggtaaagggaataatatttaagtcatagtttatactatttgggctcaaacaggttttggtaatgctgttttggtgcgtgtgtgtgtgttttttttgtaggacaaaagatatcaatttttaatgaacataaaagttatgtccaaggagtaacctgggaccctttgggtcaatatgttgctactctgagctgtgacaggtaaattcagctttggcatttacttggaatttctttgtatttacttggaattttctgaagagaggtatttatcgtaacttagccaagatttatcatagtctaactttgattcttttgttcttgttttcatactcattcttacaacataatcagaaattggaaattaattaggacaagtgccttacacgaagtttgtacttagtaaatctttttttttttttttttttttagacacagtctcactctgtcacccaggcaggtgttgtggcgcaatctcacaatctcagctcactgcaacctctgcctcctggtttcaagcgattctcctgtctcagcttccctattagctgggattacaggcacatgccaccatgcccggttaatttttgtgtttttagtagagacagggtttcaccacgttggtcaagctgttctcaaactcctaacctcaaatgatctgcctgccttggccaatgtgctgggattacaggcatgagccaccatgccccgccctgaacttagtaaatctttattattattactatttttttttttttttgagagaggggcttactctgtcacccaggctggagtgcagtggtgcaatcacagctcactgcagctttgacctcctgggctcgagcaatcctcatgcttcagccccccaagtaattgggactacgggtgtgcaccaccacacccggctaatttttatatttttttgtaaagatgggattttgccatgttgcccaggctggtcgcgaactgttgagctcaagccatctgtctgccttggccacccaaagtgctaagattacaggtgtgctacggtgatttttatttttattttttttaaattgttttttgagacagaatctcactctgtcactctggctggaatgcagtggtgcgatctcggcatactgtaacctccacctcctaggttcaagcgattctcctgcctcatcctcctgagtagctgggattgcaagtgtgtaccaccatgcctggctaatttttgtatttttagtagagacagagtttcaccgtattgacgatgctggtctcaaactcctgacctcaggtgacctgcctgcgttggcctcccaaagtgctgggattacaggcgtgagccacctcgcccagcccagttattttaatgactccatttaaatggatataaaaataaactatttttgtgctttctgaaaagaagtcttgttgtcgtgtttactggcataattgcatttaattgtattgttggaacaaagagttagaaaaaatgaggagtgcctcctatattacttaatagtccttttgaatatttatctgactacttttaaataaaacaaattgaatataagatggccttggaataaaagtggtagggaggagttagtgtttatttttcatagaatcttctgttgtattctaaatgccatttattttctgacaagtgtgttttattcagacagtcatcagtaaaacaatctgattagctagtgggagtaatgtgacttaccaattttttttttttttttttgagacagaatctcgctctgttgcccaggctggagtgcagtgccacaatctcagcactgcaacctctgcctcccgggttcaagtgattcttctgcctcagcctcccgagtagcagggattacaggcgcccaccaccacgcccggctaattttttgtatttttggtagagatggggtttcaccatgttggccaggctggtctcgaactcctgacctcaagtgattcacccgcctctgcctcccaaagtgtcgggattacaggcgtgagctaccgcgcccggcctgtaatatcctttaggttgttaatacttgcttccttcttaattacccagttgtgaatatcattggtaaaagcttttgcaggctgaaaactgttgcggtggtaataggctgttggtaataagttgtttctgtgtgaagcataattcatttactagaagtggtaaatcagacatgttctttcttcagggtgctgcgagtatacagtatacagaagaagcgtgtggctttcaatgtttcgaagatgctgtctggaataggggctgaaggagaggtataaaatattttgccattctttttcagcagcgctttaactgagacttaggaagtcatgagctcctcccatacccttgcagccaaatcactggccacaaagagccgattccagaactacaataaggcttccttttggacagtcaaggctcagttactgtggtgggctagtctgtatggaaatggggacatctggagaccagggtagagccactgatggaggacaggacagtggttttcaaccctggttgcacggtggaatcacctgggaagaattacaaatatgggtgctggccgggcgccgtggctcatgactggaatcccagcactttgggagactgaggtgggcggatcacttgaggtcaggagtttgagaccagcctggccaacatggccaaaccccatctcaatgaattgcaaaaattagccagctgtggtggtgcatgcctgtaatcccagctactcgggaggctgaggcatgagaatcacctgaacctgggaggcggaggtcttagccgtgagcggagatcatgccactgcactctagcctgggcgacagagcgagactcgatttcaaaaataaaatgaaataaggctgggcatgatggctcatgcctgtaatcctagcactttgggaggctgaggcaggtggatcacctgaggtcaggagtttgggactggcctggccaacatggtgaaaccctgtctctacaaaaaatataaaattagccgggtgcatgcatgtgatcccagctattcaggaggctgaggcaggagaattgcttgaacctgggaggtggaggttgcagtgagctgaaatcacaccattgcactccagcctgggtgacaagagcgaaactcagtctcaaaataaataaataaataaaaataaaataaaaataaaaatatggatgccttggccccaacctgagtggcgtgattcacttggctggaggtaagcagggcctccatgattctcaggtatagcaagggctggtcactactgatctgggaagatccctacacgaggcaacagaagacaggcaggtcgagcgttggatctgtctggcagcaggcagtttactatcttggcaggtaggtagagagttttgctagcagacagcagagacccagccaaaacactggtatttaggaataggaaggattttgactttcaaataattggcaaatgaaaataggaccctttttgtaaaggaatcaaggctaccgaggcaggcagcgaggtgcggggagcaagctggttactggcttcacacggggacatggtgcaaatgcatccaaggaaccagggtaaggcagtgtgggctgggcgctgacaggcactgagaggtcacacctgtgaagtaagaatagtaatgcttcccgggtgcggtggctcagcctgtaatcccagcactttggaaggcagaggtgggcagatcacctgaggtcaggagttcgagactagcctggctaacatggtgaaaccctgtctctactagaaatacagaaatttgctgggcatagtggcgcatgcctgtagtcccagctactccggtggctgaggcacgaggatcactggaacctgggaggtggagtttgcggtgagccgagattgcgccattgcactccagcctgggcaacaagagcgaaactctggctcaaaaaaaaatatgtgtatatatatgtttttgtatatattatatataatatatactttaatatgttatatatttatattatatataatatatttttatattatacataatatatatttttatattatacataatatatatttttatattatacataatatatatttttatattatacataatatatatttttatattatacataatatatatttttatattatacataatatatatttttatattatacataatatatatttttatattatacataatatatatttttatattatacataatatatatttttatattatacataatatatattttatattatacataatatatatttttatattatatataatatatatttttatattatatattttatatatataaaaatatatctattacatatatatatatatgaatagtaatgccggcttccttgtgttcttaagaattaaatgcttgtttgtttgttgagacagtgtctggctctgtcacccaggctggagtgcagtggcacgatcttggctcactgcaacctttgcttcctgggttcaagcggttctcctgcctcagcctcccgagaagctgggattacaggcgtgtgccaccacacttagataatttttgtatttttagtagagatggggttttgctatgttggccaggctggtctcgtactcctggactcaagtgatccgcccgccttggcctcccaaagtgctgggattacaggtgtgagccaccatgtctggcaaatgcttgatgtttataaatagtagtaaaaactgtcccagacaggtgttaaagaaatgttgttttaaaagattaatgattaccagtttaataatccactattttctttttttaaagggtgcatttgttaatagctggatgtggtggcatgtgcctgtagtcccaggaggctgagacgggaggattgctttgagcccagaagttctaggttacagcgacctatgattgcgccactgcactctagcctgggtgacagagcgagactctgtatctaaagagtgcattcagttggaaattctaatgaatccacacagatagaaagcagaggtctcctggtcatcttcccactgtctgccagtctcaggccccagacatgccactattgaccctgtggtttgtgttcttaagagtttttaaaaataattttagaaccacataaaacacacatatatacatatagctttacctaacaaaaatgtgtggtcagttttcatgaatgtttacccttgcagtgttgtacaattatttgatttgtaatgtgtttcagtttcatttatgattatgtcaacaataaatgacactatgtaaagaaaaccataggcacatatagcagttgggaagcgtttatttgtgagtgtaaagatttggaaaaatgtttaagctttgtgtgtagaaaacaaacaaaaaaaataataaaaataaattttgtgtgcgacaggcaagaagctaccggatgtttcacgacgacagcatgaagtctttcttccgtagactgagtttcactcccgacggatctttgcttctcacgccaggtgtgtttcgtagctttggacttaaaggaatgatggccgagtggggatgtctgctcccgttttacgctgcagcttatcagctcagtgaatgctgattagagtgggggtccccgacttacctgcccattggaacctccaggagagcttcaaaaaacacattggtgcctatgtcccatccctagagattgtagtgtatgtaattggtctgggtggcctggcttttggaattttaagaagatttccaagtgattgtaatgtgcagaaaagtttgggagtaatgagtttaaaatgataggcattttctcttagataaatttaacttttggctgggcacagtggatcacacctgtaatcccagcactttgggaggctgaggcgggcggatcacttgaggtcaagagttcatgaccagcctggccaacatggtgaaacaccctctctattaaaaatacaaaaattaatgatgtggtggcgcataccctgtaatcccagccacttgggagactgcggcaggagaatcgcttgaacccaggaggcagagggtgcagtgagccgagatcacaccactgtactccagcctgggcgacagagtgatatcttatctaaaaaaaaaaaaaaaaaaaaaaaaagaaactttactatttaaaccctttcaatgaatgctttttcattcattaacatgtgtatggaagccatagcgctaaagccaaagataaagctcctttattgtttttattctcctcaataaagcgcatttgtgacaggattagactcatggacaaacttgtggaagcagcagtggtcaaaatcaaaaggtcagccaagtagcaaggactagataggtttattgtccctatgtccctaggaaggcaaggggctcagcccagcaagataaggctaggcattattgtggccacagtgttctcagaggagaatgtctgctcattgccgtggctccaggaccatcctgtgcatagagatgacaacatagcccagggttgggccaaacgggagggcactgtcttggtttgccactgagtcccatcccagctgagccagggagggcctgagaagggcgtgaatcacacatgcagctgtgtgggtggggctttaaagaacactgcggaacatgtgcgaatgacactttggcccaagaagtctcaggactaagaataagtagttgtttaggttatatttactaaagttagttattaaaagttattcactaaacccagtaataaatccttttttttttttttttttttgagactgagttttgccctgttgcccagctggagtgcagtggcacgatcttggctcaccactgcagcctccgcctcccagtttcaagcgattctcctgcctcagcctcctgagtagctgggattacaggtgtgcgccaccactcccagctaatttttgtatttttagtagagacggggtttcaccatgttggtcaggctggtctcaaactcctgaccttgtgatccgcctgccttggcctccgaaagtgctgggattacaggcttgagccaccacgcccggccctttttttttttttaaattatttattttatttatttattaatttatttattttgagatggagtttcgctcttgttacccaggctggagtgcaatggcacgatctcggctcacagcaacctccgcctcccgggttcaagccattctcctgcctcagcctccggagtagctgggattacaggcatgcgccaccacgcccagctaattttgtatttttagtagagacggggtttctccatgttggtcagtctggtctcgaactccggacctcaggtgatctgcccaccttggcctcccaaagtgctgggattataggtgtgagccattgcgctggcctttttttttttttttttttttttttttaaaaagcagagtctcgctctgtcacccaggctggagtgcagtggcaccatcttggctcactgtagcctccacctcctgggttcaagcgattctcctgcctcagcctcctgagtagctgagattacaggcgcctgccaccacaaccagataatttttgtatttttagtagagatggggtttcgccatgttggccaggctggtcccaaactcctgacctcaggtgatctgcccaccttggcctcccaaagtgttgggattacaggttacaggtgtgagccactgcgcccagccccagtagcaaatcctttactatttggccactctaaaaatattttcaattaaaatcaagtagcaaatggatgtctgttatcaacgttattgttctttgtggtgttagtaagtgtgggaaaaacaggaaaatgaaattacaaagattggaaaagaacagataaaaaactgcaataggattgtatttctagaaaatccaagagattttaaaaatagtattagaatttttaaaataatttgataagatggctggatattataaaatatataaaaattcctatctttcgtctatattggcagtgagtacttagaaatggaaggaggagaaatatttcattcagagtagtgcaaaacctgcaaaatacatagagtaaatttatttatttatttattttttgagacagggtctcactctgtcacccaggctggagtacagtggtgtgatcatggcccactgcatcagccttgatctcctgagttcagggaatcctcccacctcagcctccctactagctgggaccacaggcgtgtagcaccatgcctggctaattttcttatttttttgtagagacatggtcttgctatgttgcccaggctggtcttaaactcctgggctcaagcaccccttccgcctcggcctcccaaagagctgggattacaggtgtgagccaccacacccaggcagaagtaaatttaatgagaaaggggcaggacctttatggagaagtctagaaggtcttactgaaggttataaagcaagttctgaacaaatggaaagatatgtcgtgttctaacaattaacatactaatttcatttccaattagaattgcattaaagtttttttttaattggatgaaatctcagctttgtttagtagaataaatgctgaagaatagccaaagaagtattaaaaaaaaaacagtgatacttgggagggcatttgcctcaccacatatcagaagatcctataacactacttttagccaatcaatatggtgttgctataggaccaaacaaatagattagtggaccagaacacagaatccagaaaaagatctcaggatataaggcgatttaatatatgacctcaggtgctgttccagtggaaaaaaatctattatttatttgtaattaattgtatgttacttaaataattctcaagagaattagacactgaaggcagataggacaagagtatgtcattaagaaggttgggaagtgttgagattggacaaagacctattcctcttttttttgagagggtttcacccttgtcgcccaggcttgagagcattggcgtgatcttggctcactgcaacctccatctcctgagttcaagtgattcttctgcctcagcctcccaagtagctgggattacaggcgccggccaccatgcccagctaatttttgtatttttagtagagatgaggttttaccatgttggccagggtggtctcaaacttctgatctcaggtgatccacccgcctcagcctcccaaagtgctgggattacaggcgtgagccactgcacctggcctccttttttttttaattgacagatgaaattgtatgtagttgtgtatgacatgatgttttgaagtatatatatgttgtggaatgactaaatctagctaattagcatagcatggtctcacataattaggatttctgtggtttgaacgctttatatctcttagcatttttcaggaatataatacattgttatgaaccataatcaccatgttgtacaagagatggatcttgcaaagggaggactctattattgaatgagtagtgctggggtagccagctatgtggaagaaggtaaaattggaccccttgcctagatgtaaaaaataaattccaggtgaattcagtacttaaacacaaaaggtaaaaatagaaaactcttgtaaggaaatataggaggacattctaggaatggagaagacccaattaagactggaaactggctgggcatggtggctcaagcctgtaatcccagcactctgggaggccaaggtgggtggatcacctgaggtctggagttcaagaccagcctggccaacatggcaaaaccctgtctctactaaaaatacaaaaattagccgggcatggtgatgcacacctgtaatcccagctactcaagagcctgaggcaggagaatcgctccaacccaggaggcagaggttgcagtgagccaagatcgcaccactgcactctagcctgggcaacagagtgagactctgtctaaaaaaaaaaaaaaaaagtatatgttcaaggatgcttattgcaagcattgtttatagtggtaaaaaaccaaaagccaaaaaaatactcattaacagaggctgggtgaatgaatcttgcagtaaatattatgcagctacaaaaaaataatgcatcagtgctatgcaagttaactttcatgagtagttgattgaaacaagcaaaataaggagaagtgtcagttttgtaaaacaaatggactcaataaaaaatatcatagaggtatacatgtgattgagttataactgattgtaatgattatgtgagcatggaggaaatatacagatgacataatggtttgttgaatgttaaaatggatttcttggggatggaagaatggagtgggatgaaaagaggggcctgggtgcagtgactcacgcctgtaatcccagcactttgggaggcggaggagggcagatcacttgaggtcaggagttcgagaccaccctggccaacatggtgaaaccccctctctactaaaaatacaaaaattagccgggcatcgtggcaggtgcctgtaatcccggctactcaggaggctgaggcaggggaattgcttgaatctgggaggtggaggttgcagtgagccaagatcacgccatcgcactccagcctgggtgacagagcaagactccatctcaaagaaaaaaaaaagagggcagctatgtagaatgtattaataataataataaaaaagactattgatactgtctactgccctccctggtggatatgaaacagtcatatgtaaagttacgtgtgtgtatatgtatcaagaaatagcataaaacagggagatgtttccaagagcagcagtgtatgatggtcactctgacagggctgaactgttttaagtacagcagggggtgagtgtagaagagctctcagatggggactgttccccagagtgaagtcaggttctgaaggaggctggaggtttcagcagagggcaaggtctcctggcagcctcatggctggatagggaagttggggaaaggcgagtctcagcctttggatggcatccaaggctggaatccaggaaatagagatgagggtcctagggagaaaggagcctgggcagctgaatctagtcacggtgcttcaatcgaggaattgcctggaggctcaacggtgccctatggcaaaggctcactatgttctcctcgcccaagatcagaaccaggtccccggggattgcccacaggtaggtggagatgacaggtaggtagaactggagtaagggctgagaacagacagtgccggaatatatgtttttgtgctctgtcacaacattgtccagagaatataactgcagggggaagtattttgcaaaccggacctgaaggctcttgagtttctgttggtgaacagtttgctgaaacagtgacttttctttcctctccctcccttccctgttccccagctggatgtgtggaatctggtgaaaatgtaatgaataccacttatgttttctccaggaagaatcttaaaaggtatgcagtcaaggaaatgtttgaaatgtttacattttttttagacggagtttcgctcttgttgcccaggctggagtgcaatggtgcgatctctgctcactgcaacctctgcctcccgggttcaagtgattctcctgcctcagcctcttgagtaggtgggattacaggtgcccgccaccactcctagttaatttttgtatttttagtagagatggggttgcaccatgttggccaggttggtttcaaactgctgacctcaagtggtccgcttgcctcggcctcccaaagtgctgggaatacaggcatgagtcattgcacccggcttgtattttttttttttttttttttttagtagagatggggtttcgtcatgttggccaggctggtcttgaactcctgacctcaggtgatccgcctgcctcctcctcccaaagtgctgggtttataggtgtgagccaccgcgccctgccaaaatgtttaccttttatttttgcttttgcttagtcacagtgccttttcctaacactgcaattaatccattaggcccatcgctcatcttccatgtcctggaaaagccactcttgctgttcgctgctgtccggtctactttgaactgaggccagtggtggaaacaggtatcctcagagcctcaggggtgtgttatgttttctctccgaaacaggtcaccagagtggggtggagatttggattctgtcttatggggaaaggtgggtatctgggtttggttcagttcagttattttaaaaatattttatttttacatttaaatctatttatttatttattttgagaccaggttatcagcctggttaatttttgtatttttggtagcgacagcgtttcaccatgttgccaaggctggtcttgaactcctggactcaagtgatccacctgcctcggcctcccaaaatgctgggattacaggtgtgagcccctgtgcccggcctggtttagttatttttaaaagctggagcaaagactggggttatcaaaatacatgtcagtttttttttttttttctttcttcaggatatattttcttgcttaaggcactttaaaaggaatggacgtactccttttgtttgtctatgtctctcattatcaattttctttttcttttttttttttttgagatggggtcttgctctgtcgcccaggctggagtgcagtggtgcaatcttggctcactgcaaaccctgcctcccaggttcaagggattctccctcctatcctccagagtagctgggattacaggcgcatgccaccacacccagctaatttttgtatttttagtagagatgggattttgccatgttggccaggctggtctcgaactcctgacctcaggtgatccacccaccttggcctcccaaagtactgggattataggcgtgagccatcatgcccagccattttctttgttttcttgtgcttggggttcattgaacttcgtagatctatccgtttatagtttttattacatttgggaagtttcagccatttttccttcaaatgttatttctgttattcccttctcttattcaaatactcccattacacatgtattatattaggtcctttgaaattagttcctggcctttgatactacttactttttttgtttttttcttcttccagtgtttgattttggaagtctctatagctgtgttttgagtttgctaaccctttcttctgcatgctctgcccttggtcccatccagtgtgtttttctttgttgtggttctcatctctagagattcactttgggttttccttatatattctgtgcctctccatgctccatttttcctcttgctgctttcttttttttttttttcttgctctgttgcccaggctggggtgcagtggtataatctcggctcgttgcagccttcgtctcccaggttcaagtgaatctcccacctcagcctcccaagtagccaggattacaggtgtgcgccaccacacccagctactttttttatttttagtagaggcagggttttgccatgttggccagtctggtttcgaactcctgacctcaggtgatctgcccgcctcagtttcctcttgcttcttaagcatatagagtgcagttataatagctcttttaatgtccttgtatacaggttggttttgatttttttctcctcattgtgggtcatatcttcctgtttttgtttgcctggtactttttgattagatactagacactgacttttactttagtggatgctggatgtatttttattcttataaatattctttttttttttttttgtgacagagtcttcctctgccactaaggctggagtacagtggtgcaatctgagctcactgcaacctccgcctcctgggttcaagcgattctcctgtctcagcctcctgagtagttggtactacaggcacacacccccacgcctggctaatttttgtatttttgatagagacggggttttgccatgttgcttaggcaggtctcaaactcctgagctcaagtgatccacccggctcggcctcccaaagtgctgggattctaggcgtgagccattgcacctggtcagaagccttgtttctgtggttttactttgtctctgtccccaacccccaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatggtgagtggctgctaatgagggagagtgagtgaaggagaccgtggctgtatcctggaagacaccccggggttagggagcatttcattactaaagatggctttgggggacatattcaccaattttgtttcttatttatttttttgagaccaagtatcactctgtcacccgggctggagtgcagtggtgtgatctcgtttcactgcaacctccacctcccaggttcaagtgattttcatgcctcagcttcccaagtagctgggattacaggtgcgcaccactacgcctggctaattcttgtggttttagtagagatggggtttcgccctgttggccaggctggtatcaaactcctgggctcaacgatcctcctgccccagcctcccaaagtgctgggattacaggcgtgagccaccacgcccggccccaattttgttttttaaaggaatcaacattaaaaggaaagccgtttctagtttgccacaatacttgcttcttattttcacactggtgggttttgatggcattcagattgccttgtggggttaactggactttgataaactgaggggaggccttgtagactccctggccatttggggacttctgaggccctctgggaggaagcccttccctgcatgcccctgctgcccaggacagggaagtgccccaagctgggcctgtgtagaggatgtcactcagcactgtccttctgccaccttttggtccccaattcagcccccgtggcctgcttggcccagtgtgaggttttttttttgaaacagagtctcactgtcatccaggctggagtgcagtggaacgatcgtggctcactacaacctccgcctcctgggttcaagcaattctcctgcctcagcctcccgaatagctgggattacaggcgcccaccaccatggctggctaatttttttgtatttgtagtagagacagggtttcaccatgttggccaggctggtcttgaactcctgacctcaaatgatacacctgccttggcctcccaaagtgctgggattacaggcgtgagccaccgcacccggcctattcaagtgaaaattgctagtagcacagataggttgcagcgacttagcaaatcgcgatgaaactgcatgagtgagtcgctatcacacactcttttccagttgtatcttttccctggtttttgccttcaaacaagcttgtgattttgctcgaacttccctcttctaagtagatgtgagagtgttggtaaggtctgtaacttttccctgttttggggacgaaggtccagcgatggtgccttcctggccatttcttccacggacggttactgctcatttgtgacatttgagaaagatgaacttggaattcctttgaaagagaagccagttttgaacatgagaactcctgatacagcaaagaaaaccaagagtcagacacatcgagggtcttcgccaggacccagaccggtagagggaacccctgccagcagaacccaagaccccagcagccccggcacgactccccctcaggccagacaggccccagccccaacagtcatcagggaccctccctccatcactcctgctgtcaaaagccccttgccggggccttcggaggagaagaccctgcagcccagtagtcaaaacacaaaagcccacccatcccggagggtcactctgaacacactgcaagcctggagcaagacaacaccccggtaagaacttgttggaacaagatgtcattgcaaaatgaaacacaaaatgcagacagaacgctcccaccctgctgcaggtgaaatttcaggcggtgaatgcttcatgccagtaggttgccagagagattcttaacttcaaatccgagagtgtcatttcttgcatataggcctctgtttgttcctccagtttctgcctgtcagataaagcccaggctcctatgcacacacacagactgtgatttggctgcagcctgtcatccaggactgtggccactctctctcctgagtctgtggccttcatctccggcctagtcctgaatgtcatcttcccagagcactctctgccctttgaggcctctgtccttcccttctctggggaagccctggacacctcttcctcttggtgatgccaggagtctcctgaaagacccatttcaatgtaccctctctgtttgcagtctttgtggcccttcagcctttcccttgtcaccacacatcagattccatagcaggtgctttgatgctccagttcccctgctggttgtgagcccccaaggacaggaagcaggtcccattttttatttatgctgttctgcccaggatgtaggcaattccaggagtgtcttcctgagactgcgtttgatgtctccagcagcctggtcggtgagaaacggaggtcctgatctgataacaaataatccccaggaggtgcagagtcgtttcttccctgcttacatcagtgtggctggcacgcacgcctgtgtctgccacttctactggatacagagccacttagcacatccttctgccgtcaggcagcacagcctcctgtttccattcttcccctgcagctgatgtccagttacccctctgatcctgtatagttccttctccaccaagccctctgcctcccaaccttcccataaactgagtcacgaggagagctgggaagggggatgcagaggggagtggtggggatggtgagctggacagaagcgccctgtgcctctcagcctctcctgcgccaataggtcttctttggcaagttcataatatgtgtatgggttgctggctttaacgccctcttaaaatctctcatttctttctgcagattagcaatgtattttacaatttttctgtttgtttttatgtgacggaaggtattccttgaactatttttggtattaaattatttttcccctcttgatttcttctgaattatttaccaagcttcttgaagatgtaatcttttgcaaacaagaatagttgttgaaaattaagactctgggtttttatttatttatttattcatttgagacagggtcttgctctgttgcccgggctggagtgcgatggcatgctctctgctcactgcaacctccgccttctgggttcaagtgattctcctacctcagcctctcaggtagctgggattacaggcatgcgccaccatgcctggctgactttttgcatttttagtagagacgaggttttgccatgttggtcaagctggtcgaaaactcctgacctcaagtgatctgcccgcctcagcccgccaaagtgctgggattacaggtgcgaaccatcttgcccggcccaacgctctggattttaaaaaagtattacctgtgtttcgacgctttctatatatagaaaccatatctgactgccttttacagcagccagcagagtgttcacaagaccgtcggtaatgaacagaacacaggttttgaaacttttcgatgactggttatggtttaagttgactgttataaatgtgatggtttaacttaatacatgaatgtaatcctcagttattaaacaagtgggcacatcttactatttaatgccttgaaccagaagttcagctgaaaatttaagtatttcctttggtagttttgaaggttggtatcatacataaacaattcctgtgatactaatgagccatcacccctctacttttttttttttaaatcaaggagaataaacttaacacccttaaagacggacactccaccaagttctgtaccaaccagtgtgatttccaccccttctacagaagaaattcagtcaggtaagtaatattgttactggtttaatataatgaaaggtagagtatcttttcttttgttcttttggaaattaatgccgcctaattttaagtcagttctgagacagcagggatgcatcttattggaaccattgtttaaacccgccggctgcctgtttacgcctcagcagggggcacctggccagtgagagcatcctggtgagccagggagtgggttcagcaggagattgtctagctcaggtttctccacctgatgactgctgaccttgtgggccaggcaattctttgttgtggaggactgtcctgtgtattatgcgatgtttaacagcatccccggctgctacttcttgcccatgacattctttttttttttttcttttttttgagatgcagtcttgctctgtcgcccaggctggaatgcagtggcacgatttcggctcactgcagcctccacctcccacgttcaagcaattctcctgcctcggcctcccgagtagccgggactacaggcgtgcgccatcacacccgggtaatttttgtatttttagtagagtcgggggtttcaccacgttggccaggctggtcttgaactcctggcctcaaatgatccacccgcctcagcctcccaaagtgctgcgattacaggcgtgagccaccgcgcccagcttgcccatgacattcaaaaatgccactagacattgcccactgtcccttgagaggcaaaatcgcccctggttgagagccactctatagaacttccattatatcagtataggatcttgccaggcagctcagttccgtgtcttggctctgtattctgtaaatgtcagcccttgacttccagaattcttcatttacttgccaaccttatgtttgttaatgttgcagagacgcctggagacgctcagggcagtcccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacgtagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttactctgtcgaattttagagtatttgaagtgattgttagatttcacttctaaggagttgattgattaaactttggaaggtagttgtgtttgttttctgattttaaaggtgacgatgcttattcttttagtaactaagtgaagtgaaaaagatgggtatcacccatcatcttcccaccagaagtaaccctcgttaatgttgtagtatatttccttagcatttttgtggatctatttattctaaaaagagaattgagattttatttcatatgcaatttggtatctaaataggttagttttttagattggtttttcaaagcaaaaaaagtatcttttttgttttttgagacagggtcttgctctgttgcccaggctggagtgcagtggcgctatctcagctcactgcagcctcgacctcctgggctcgagcgatccttccacctcagcttcccgagtagctgggactacaggcatgtgccaccatgccatgctaatttcacacacacatgcacccacacacacacatatatatgatacatatatatatatatacacacacacacaagtatgtgtgtatatatatattttttttcttttttttttgagatggagtctcactctgtcgcccaggctggagtacagtggcacaatctcggctcactataacctccgcctcctgggttcaaacgattctcctgcctctgcctcttgagtagctaggattacaggtgtgtgccaccacatccggctaatttttatatttttagtagagatggggttttgccatgttggccaagctggtctctaactcctgacctcagatgatctgcctgcctcggcctcccaaagtgttgggattacaggtgtgagctactgcacctggcctaattattatatttttaggggagacggggtttttccatgttgcccaggctggtctcgaactcctggggctcaagtaatcctccctccccagcctcccaaagtgttgggattacaggcgtgagacaccatgcctggtcaaatggtatctgttttgacgggtggttctcaactgtagctgcatactgaaatcacctaagagctgacataccagtgcctgggttcccgcttcggaggatttggcctaatcggtctggggtatgttctgaatattaggatttcttaaagctcctggagtaattctgatgcgcagccaagattgagaaatctaagggaaaaaactttccctggatacggtctgttctggttaaatgcatttccactgaaagcatttttttttttttccgagacagagtctcgctctgtcacccaggctggagtgcagtggcgcaatctccactcactgcaacctcacctcctaggttcaagggattctcctgcctcagcctctccagtagctgggattacaggcacccgccaccacgcccggctaatttttgtatttttagtagagatggtgtttcaccatgttggtcaggctggtctccaacgcctgacctcgtgatctgcccacctcagcctcccaaagtgctgggattacaggcgtgagccaccgcgcccagccgaaagcattttcttgattatctctgccccgtcactgattgacatcctcctttgctggggccgcggactgaaggacagtatgcaggaggtgccatcagctcttctgaaaagagacagctttcagtgtcatgtggctggcgtgaggtgcggtttgcagttgttgatcctgtgcagacagatgaatgaccatgggtcccctgtccttattgagcagcctgcttcctggccatacctggggaggaacagtattaggtttttctgggtgtggtggctcacacctgtaatcccagcactttgggaggccaaggtgggtggatcacttgaggttgggagtttgagaccagcctggccaacatggtggaaccccatctctactaaaaatacaaaaactagccaggcgcggtggcacacacttgtaatcccagctactcgggaggctgaggcacaagaatcgcttgaacccgggaggcggagtttgtagtgagctgagatggtgccactgtactccagcctgggcgacagagcgagactctgtctcaaaaaaaaaaaaaaagagaaaaagaagaacagtattaggttttacaaatctgtttcttgtgcattgattgtgggagttggggtgggggacccctgatggcctgcctgttctcagccatcatccttaaatataaatcaaaattggcaataaaagaccaagtgaagtca

SEQ ID NO: 620 - DNA, 31350 bp, Homo sapiens
gggaaaacgcatgcatttcaggacttcgctttcgggttcccttgtcctgtgttgtgtaatgcccccgttatggcactagaaatattttttattagccgaagctaaatatagtgggactttggctgatcccgagctcggaggacagccggggtgatccgtttccccccgaggatcgaggtggtgcgctctggacggggttgtgcattctcgccgcgcccgggcggacgatccagcgaacagccccgcttctaacccgagatgctgctgccggcgcccgcgctccgccgcgccctgctgtcccgcccctggaccggggccgggtgagtgagcacggggcccggggcggcccgagcgcgcgcctggggcccgggagcctgagagtcactgggcgtcccccgcgccgcactccctccctgccggacccccaagctgcctcggtcaacgccgggttcctcaggggctcccctccgacccccacccaggcctttctcccactgagatcccttagcctcctccctcaggtagtcaccttcctttagcgaggggacccctcttcccgaatcctgcgaccgagtagggtgcctcggtggccctgccggttcccacgctcggaaagtagcctctgtagtcactcacctcactcctaatactggatcttcgcaatttgctggcttcccctgaggggcccttctatttttagcacaccacacatctcacttccccaccctcgtctcacgttcagtgtccccatcccgccccggattccccgagtcctctccttctaccaggatttctacctctctcttttccgctccccacacaccccgccgcccgtttttttttttttttttcaagttaaatgttggacagaaaaaaggattcctttcttcttgtaggtggaataatcatatttatagagtgcttataatgaaccaaatgctggccgggcaattggcaggtgtcttatgaggattaaatgagttaatacatggggagtgcactgaacagtgcccagcacaaaggcagcgcccggttattattattgccacgatcatcatcattatcacctctatttaaacttctcactcctgtgaggcaggtcattattccaaataatgaagaaacccaggagcagttcaggggtggacctgcccttcaaatcccgatttgcaaacctgacattgtggagccaggtgcctggacccttgcccactcaatgacaaatattctcagagcccctccagctcggagctaggtttggagaggtaggtgggacacagaccctgccccagaggggttcctagtctggtggggctgcccacctgtggatcagccccccctcccatttgaggtttgtttgcttgacccctggggctgttagtggcagtgtctttcctgatgagctgtgccctttctgagttaatcagtggccctctcccttcccccaagggatggcatggtggtgctctgagcacaagtgagttgcaacactgctgtgtgtcctctgtgggtgaagaggggataggaaagggcgcaggaagaggacatgggacagaggggttcctcttctaggctgagactggggccacacttgccatactccctgtgtgatcccgtttgcaggccttccctgcactctgagactcaggaagatggagcttatagagtcctgtgtttactgagtgcctactgtgagctggtgctctgccaaacaccctagagatgaggggtacccagggaatttacatggggtggggcctttgaggagttttcggcttaataggggagaaatgcataggaaaaccctccaatatctagtagaaagcaatccatattctaaaagataagcccatgataacaataatgattatcaagcaatcaagcaccatgggcctaacaccgagccggtaagtactgtctcattcctgtattatcatgggaaacgatctgccatcagagatatatgactgaaattacatttggtctaaatccagatttatgctctgaattatgaggcctcctgaattgagaggggaaagagaaagagcattttgcagctggttccctgggctcaagttacccctttgatacagcagctggccgcatgccctagacaggatttctcaacctcaccactattcgcatttggggctacattttggttgctgtggagtctgtcctgtgcactgtagaatgtttagcagcgtctctggcctttacccgctgcatgtcaggggcacccccggccctgacaattacgaaaaaaaccctggccctgacaggaaacacaagttcccagacattgtcagatgttacctgggggacaaaagtcacctccggttgagagccagtgctctagaggaacagctttgatgtttgatcacttgttcatttactcagtgaacatttagagcacacccgtgacatgccatgtctgcatttatggagaaacagtcgcagggcattttcagtgacatccctcagtgtcctacgtgtaaaactctagtcctgagaaaaaccgctgcttttgaggaacgggtataggagatgcttcttagtgttttcttttttgccttgagtgccaggaatctctgctagttttaaaaaatacccttgatacatgttttcttttagtttaatacatgtcaactgtgaaaagtacagataaggcaaaaaaatagaaaaatcacctggaattgtaccacacagaggtacccactgttaacattttgattcatgtcctttaactttccatgaatagatatgcttttaaaaaaaacctcatagaaacaagctcatctgcccatactttattgtagcttgttttttccctttatacacttgtctgccttacagtatgttcccaggccctggaactgtgtctggcacctggtaagcccttggcaaacatttagggaatgaatgaactaatcatgtgagcccttccttgtcaatcgatatttatcacggccagcctcaggacaatcaccataaagtgtggcctttataggtgggcccagggatggcagctggtgacaatgactgccatttacttttcatgtggattattttactcagcctctcagcaacctatgatgtaggggttaccacccccatttcacagattaaacaactgaggcccatggaaattaaggaaaacttgtccgaggccttgagctggtgaacaccaggcctcccaactgactgtctctttcctcctttaaccctgacttcctgtttttttctcaatcaactttaccatcagtatcctcagttctctttggaaacaggcaggatacagattaatagccagcccaggcatgtagtaggcttataagagttcacttctgttccttatttcttgtgccaagcccagacatgactccagctcagcccgtctgacatcagggggcttgtgggccggaattggttactaccgtgtcccctgcagtgatcctgggtggttttggactcttctcaggctacctgatggtttaattttcaaaatatcaaaagcacacaatgcttttcctagtctgcccagcccttggatgggcacagcttgccctgggtcgagggctggcatttcccaccattccttagacattctctgctcttgaactcctccaaccagtggctggggcagtgcctttggcctggaatgtcctgctggccacctcggtgagcccatccagtgctttgtggccttggcaaggcagcttctgtcccttcagtatcctcgtctgcaaaatggggatgattgtattaacagccacgtagcaggtggctgcaaggattagcggtgatgtgatcagtggtttcctggatgctggtaccgaatgcgtgctctgtgagtatttgagttggagaataattaaaacctgtgattatcatcacacttctaaagtagtgaaagcgccattgaggcagtgcttggcagtggcacccctgggagcagcctgcctcctgtgccctgcatctggcccggcacacagtaggcgttgaacggttgctgttgagatggtccagaacacagcatggcttggatcctggctccaactcttggcagctctgtggccccgggcaggttactcaccctctctgggctcccttatgttctcatatggaaaataaagatgacagtagtagtcacctcataggattgtcctgcgtgttaaatggtctcatacatggaaagcactttggagtgcccagcacctgaaatgctcagtaagtgctgctgtggttatgatgatccccctctcccaccaatgggcttcctggagtgatcatcttcgatcaggaatatcaagacagcagggcccagcagtgaaggatggtggcaggaggggaggtatggaactcagatgtcctcggtctcttctgtttattccaattaagtaccccagatgccaaacctcttctgttattattgttggtttgtttgtttgtttgttttggagacagagtctcactctgttgtccaggctggagtacagtgtcatgatctcagctcactacagcctcaacctcctgggctcagtcatcctcccacctcagcctcccaagtagctggaactacaggcgcacatcaccatacccagctaatttttgtattttttttttttcgtagagacggggtttcaccatgttggccaggatgatctcaacctcctgggctgaagtgatcctcctgcctcagcctcccaaagtgctgggattataggcgtgagccactgcgtccgaccttctgttagggttttgaccctgctcacctcaggggatggaaaagacttctccctttcttgcagcctccttaatccccaaaccttccctttcctggcagaggtcatggcatggagtgaagagtccctgggctgagctgctgtgccagtggacagctgagtgaccttgggcaagtcactgcccaccttggggcggcggctttcctcaggtggaaatgaggttctagctgtatggtgaggaggatgaacgtgtcccatcagccccacctgaccatgggcctctgagatgttccaggtgcttcagccatactgtaagtctcctgagtaaggaacagctggggtcaaatcctgctctgtcactcatgagctgtgaccctgagccaggagtgagtaactctgaacctcatccgtaaacagatcattctacggtcgagtgtccctcatctgaaatgcttcagaacagagtgtttcgttttttgggtttttgtttttttgagacggagtctcgctctacctcccaggctggagtatagtggccagatcttggctcactgcaaccttcacctcctgggctcaagccatcctcctacctcagcctcctaagtagctgagactacaggcacacgccaccacgtccagctaatttttgtacttttagtagagatggggttttgccatgttggccaggctggtctagaactcctgacctcaagtgatccgccctcttccgcctcccaaagcgctgggattataggcatgagccactgcgcctggccggaagtgttttgtatattggacttgcttggattttggagaatttgccgaacaagttgagcatccctactcccaagttccaaagtccaaaatgctccaatgagcatttcctttgagcgtcacgttgacactcaaaaagtttcagattttggaacatttcggattttggatttttggatcagggatgctcaacttgtcatgcgttcctcatacgcttatgtggtggattcagtgagatgatcctgtctcacttaggttaatgcttggcatgtggtggcaagtgcttgacaaatgttgcctgatgtttgctgggcagtggctgaagcagctcatccctggcattgggtctttctttcttttttttttttttgagacatcgtctcactctgttgcccaggctggagtgcagtggcacgattttggctcactccaacctcttcttcccgggtacaagcaattcctcttcctcagcctcccaagtagatgggattacaggcatgtgccaccatgtccagctaatttttgtatttttagtagagacggggtttcaccatgttggccaggctggtctcaaactcctgacctcaagtgatccaccctcctcagcctcccaaagtgttgggattacaggtgtgagccactttgcctggctgggcctttctttccctccaggccccgccctgggccctgcactttctctgctcacctagtgttgcctttatgtcggtgatagggaggattagccttatcaggctccagataatggctggaaaagtcaggaggctgcatgaagcaaagataatttcctttctatttctcctctccttgtccttggccacccctcaccttagccactggggaacccaaggggccagtgtccagccccaggtgatagcagaagagcactggccttggagtccagtcctgggggcctggtgtcagctctgacactcatgcattgattgtatttctcaggtgcttactgtggccagtcagtgtgttaggcttggggtgcctggtggtgaatgggatgggtacgggctggctgtgtggagcctgtggcctggcgggcacacagatggtcagtcagagctctataatagggttttcactagtgcttccagaaaagtctagagctatgagaggaatccgataggagccccattccggctatgtgaggttggaccagtggaggacatctcaagcagagaggaccccagaagagaccggggtgaccggattgcaccaaatggggcagggtgatggggaatacatttggaggccttggtaaggattctgatgtctttattttagaagaaatgagaagccactgagtagtttctcactgagctccccactgtgccatctctctgatgatcagattttcatgttaactttggttgcggtgtggacctgagtgacttggagactggagcagggctggcatggcgtgagtccaggttgaagtgactagtacctcggacgaggtgtcttgggcaaggtggagtctgggccctctgtgtcttttcagtttttccctctatagatttctgaagctgcattggctggcccacagctccttgcaaccctgacatctcctggtgcagaaggtgaaatggtgcctggcctttgtagatcagatcccagtacttgcaaccctgacatctggtgcaggaggtgaaatggtgcatgtcctttgtagatcatatctcagtacttgtagccctgacatctcctgccacaggaggtgaaatggtgcatggccttcatggatcggatcccagtacttgcagccctgacatgtcccgctgcaggaggtgaaacggtacatggccttcgtggatcagatcccagcatttgtagccctgacaacttccagtgcaggaggtgaaacggtgcatggccttcgtagattagatcccacttgtagagggtgagggggaccaacttgaggtctcaggctcagggcatgagcagaaagggcactgcagattttcagggaaacctgagtcagattcagactctgtcttgtgccgccttccctaagtgggaggactgagggctgctctgagaaaggttgggttggatccatatctgcctcccagagccaggcacttcctgggtgcttggaaaacgcatgctgaataattgagtgagctgttattgacctgatccaatttatctctgcatcgttgccatgtggaataaatgtgtactgactgcataaatgcgtgaatggatgaggaatgctgtcctgccaagaaggtcctcatggatcctcagagaggccccaagtcctgtgactgattcatctctgccttcacccgagcagccagtggatggatactcctgttagcccaaaattgttcatgaaccaaaaaaaaaaaaaaaaaaaaagaaagaaagaaagaaaaaagaaagcactgatgggtgggagtccttaggttatttttagctgcagtcgactcaggctgaactttgaactagtgtctgttctccaggccacactcagactgatggacggacagctgggccagtgcttggagacttccaggcacagggaaagccgtgggggcatgtgatcctgaggtcacagtgggcatctgggcctctgccctgtggaaggaggagggaggcctgcaggatctctgactctgacatttcctgggagggaacggagaaaggagaactggccgctactacatttatttatatattttgagatggagtcttgctctcttgcccaggctggagtgcagtggcacgatctgggctcactgctacctctacctcccaggttcaagtgattctcctgcctcagcctcctgagtagctgggtgtataggcgcgtgccaccacgtctggctaatttttttgtagttttagtagagatggtgttttgccatgttggccaggctggtctcgaactcctgacctcaagcaatccgcccacctcagcctcccaaagtgctgggattacaggcgtgagccactgcaaccggcctactccgttttaacctggggatggaatatggtgctgtgtattcctccagcagttgctgagtacctgggccagtccccgaggctgtgatttttgggggcatctgggagcccatttgtctctgaaagcctgatctactgaaatagcattctgagacctttacagttttctttggaaagcaagagcaggaggggtgaggaaaggccaacacttgtaatcctcctgatggccctgcaaggtgcatcatgtcaaccttaaatagtgagattcagaaagaaggattaagtagtttattcgagctcagaacttgaggatggccaccggggagcatagattcaagttacctcgaatatacactccgattagctgcagtaacaagtgggattttaaggtgcggaggaaagaggcagtttctaagtcatttaccaaaaatttatattaaaataatataagctaccggctgggcacagtggctcacgcctgtaatcccagcactttgggaggccaaggcgggtggatcacttgaggtcaggagttcgagaccagcctggccaacatggtgaaaccccatctctactaaaaatacaaaaaatgagctgggtgtggtggcgggcacctgtaatcccagctacttgggaggctgaggcaggagaattgcttgaattcgggaggcggaggttgcagtgagctgagatcgcaccactgcacttcagcctgggtgacagagtaagactccgactcaaaaaagaaaaaaaaaagctactgatttgctgtgcattgttctttgtgtgacgctttccaggatcatgaagttaatggatgaggcagctagtcagaaacaaaatgccttgaaataattgccatcgggtgtggatgcaaagggcatgactcaggtcccatattcgtgtctccctgggcctgatacattttgcatacttcacatagctcacgctgctctgagctatttttctcttttcggtagtattgtacccattttccaggtgaggaaactgaggctcgcagactttctaagaatgcactgaggtcatggagcaggtgtgagctttgcctccggatttgtccacttctggggcctgtgcttttcccatccactgggacctgggctccaaagaggggctgggacagactcagttatttggagtcccgcttctcggctgaaagagttgatggtgatatctggctcaccatctttggtgggtgtggtgctgttgaggcctggagcgcagcttgaatgcagggtcaggagcttagctgaggtccctgtcagaagcttccagatggtcccaggggattgacactgccttgtcccttcctgagggactgtggagactcgtggctgcctctccattcttctcatgatggtagatggaagagggccgtgcagattttaatgtatttatcgttatcaaatctccatattaaccccatgagggggtgtcagtgttttagggagggagggaaactggcttcaagacatgtgacttgcccaaggtcacacagctagtgggaggcagagtgggggtggggagtgcagagctaccggctcagggtggaggttggtggggaggggaggggagtggagagaaggtcctatgtgctcactttacctgtcaggatcttgggtgccctgcccctgcctctccctctccctctaccacgcaggcccctctcagcccccccccgcctccttctacctgggatgctcttcccagctcctctcaagcctcctttaagtccctctcagggtcacctcctcagagaggccttccctgaccaccctggctgaagcagccctattctcccccttgtttgccatgctcaccatctgcggttaccttgcttatttcctgaccaggcctcacactgaaggtcacctgtgtgcagccaggggcctcgctgtctctgtcactgctttatctccagggtctgagacggcaccagagacccagcaggtcctcagtcaacctcaagtcaagtggaatgaacacagggcctggccacactcctttggttttgtgtccttccttcaggcttcccaggctgggtctttgagccccagactccttctggcccccgacactcatagccgggccagtctgtctcccatagggcaaaaacaatcccgcagaacactagcctcaggccacgtccctctgagaccatgatcagatgagacacaataagccctcttcctgatttttttttttttccttgagatggaatcttgctctgtcatccaggctggagtgcagtggcgtgatctcagctcactgcaacctctgcctcccgggttcatgtgattcttctgcctcagcctcccaagtagctgggagtacaggagtgggccactacgcccagctaatttttgtatttttagtagagacggggttttaccatattggccaggctggtctcacactcctgacctcaagtgatccgcccaccttggcctcccaaagtcctgtgattacaggtgtgagccaccatgccgggccttctcttcatgatttttgtctaagcacggacaaaaacaaggtctctgtgccacccacaaagctctgcacatcttggtaaatgttccttttttcccagtcagcctcacccccactttctgatggcagccaatccagagctaaccgtggcttccttaaaccctccccaagtcaccctgccaaaccccatgggtttcctaacagcatcttactgagatgccctgtggttccctacgctgtgtgttttccctcattgcgccgaccagtgaaccccacctgtgcacttccagctgttcgggttgtctggggccattgacaccagagagagatggtatctgggccttctggactcaagtgcaggtttcccctactcttgatcttgaactagtcattttccttttaggaccaaaatgaccttatttctgtagagaggtggctggtgaggcccgtcctatgccacggtagatgggaagtttgtcaatttcaagtgccctttgggcattagttgactttgtcatcatcattcttctcatttacagagggggaaacaggcctgaaggggaagccccacagctgggaggtggcagggctgaggctccagctctggaatgactgaccccagcgtcctagctttgagccacctgacctcccaccttgtgaccctcagatgtggtagggggtggtggaaagaggtcagaggatttgagcaaggagttcttgagactcagtgtcctggaatcaggcacctcacccccagggccagccctcccggggctgtgagctgagctcagggcagctctccaagttcatggtccacatcttggacattcctgcccagccagagctctcagccctttgtgccaaggggatctcagctggttcacattctgagactgtgttctggaatgtgctgccctttcagcttagagagaggagtttgggtctttttgggataaagcctgccttgtgggagaagaaagggagagtaacgctttgcatgtggaaaatacttcaacgtggttttgcatctgtgtgtttaaacttcaaacaaccgcgtgagttcggtgcgattattcttacttgatagacgtagaaccacgttcacaggaggcaactcacaggctcaaggacacacaaccgtgggactgggacttgaaccttgggttgtggacccccaaggtgggtttttgttgttgttttgagatggagtttttcgctctctcacccaggctggagtgcagtggcacgatctcggctcactgcaacctctgcctcctgggttcaagcaattctcttgcctcagcctcctgagtagctcagactacaggcacacatgccaccacacctggctaacgtttaaaatatttttagtagagacgggatttcaccgtgttggccaggctggtctcgaactcctgacctcaagtgatttgcccgccttggtctcccaaagtgctgggattacaggtgtgagccaccatgcccagcccaaggtggggttttgaccccccactttctagttgcattggatttcaggctctgggtgcccacctaggaccccctgtcggaggtagaggggctggggtctggtggtggggccgctgctgacctctctgcctctgtcccctgcccttgtgttccagcctgcggtggaagcacacctcctccctgaaggtggccaacgagcccgtcttagccttcacgcagggcagccctgagcgagatgccctgcaaaaggtaatgggagggtgggaggcacccgagaggtgcagggcatggagcagaggccatccccagcagccctgagatagcgccccgtgcctgcagccatcacccgcttctacccttgctcccagccttgggtggaagcctgggagggctgtgggtctggagtgtgggaacagctgggaggaccaaggtggcagcctggagctactctggggcttctcaggccaggtcagatgtcataaacctagttgttttatagttaaacatgttttccagttaattgccagcattttaaaaatcatgagatttcatataagtttcaggtgcagtttttttatctctgtgtcatgggtagacctcaccttcctgcagggtgacaatggctggagcagagtccggctgtccccgagggcagcacatgttctctgatggccaccgacctggcctggcccccttctcatttctgtattgcctgggcacctccgtctgtggactctgcgttagggttttagatgggaggaagcgaggaaggcggtgaccatacccactcttgtccctctccccaggccttgaaggacctgaagggccggatggaagccatcccatgcgtggtgggggatgaggaggtgtggacgtcggacgtgcagtaccaagtgtcggtatgtccagcgggtgggcagagctcagcccctcccctgaatatgtgacctctttctctgacagctcgtaagcttataatgtgtgggctctgacttcaaggcctttatagtgcccctccccaccccagattttgaattctgtggaccagtaaaactcccaaagcaaaggacggcacccacactgcatccagcccatagcggcatcctgtgtctgggcaagaaaggccatgagggggccacacagcatcttctgttattcctcatagatttcttgccaagggggtttgggagctaatgacaaaaagctgggccccgggccccgagcacctcagatggcattggcctaagaagcccccatgcttggagtttatccatccagaaactggcatgcactttacgtgggccaggaaactcataggtctgtgatttgagggagaataaaaggtcagcccttttgcaaacagggcaagcacattctggctctgtccggctgaaaccctgggcagacgtgtgcagggggaggggtgactgagggggaggacccaggtcccccactctgaaggttcccaggacagcctggggcaggagttgaccacagcagtgtcctggagctctagttgctgggtcaggactacctggagctgtccaagcatggcctggggtctgcaggcattggccaggtcactctgtctgtcactgggtgtgtgtgcaggtgccagctgacagcagcacctgccacccagctccctggttgtctctgtagctgcctagagcttgccctcacctgtagctccgcaggcgtctgaggctgcatggcagctgggatttttccaggcagcgaggctccggcattctgataagcccctgggtggatactgctgattttcatttcccacattgccttgccgacctggctggagattctggccatgtgctgatcactgtggcacgagacatttggggttctggggcatgtgagggcaggatctatgtttgccgggacatagtgctgacggggttctgcagtccactggggcccaggtcgcagccaccttctctgcccttaagcatcacaggccaatctcaggtgtggcccgaatacagagtgactgtgccaagctttaacatgaaggagaatggtcactttctactcaagcctagaccagcgccggccagtagaatttcctgcagtgaggacagaaatgttccagatctgcattgtccgttccagcggccatgagccgccacgtgtggttgttgagcatgtgaaatgtggctcgtggctactcttttagacaggaaagctccaataacccaccagaagacggataggtagcaaaagtgtcagctattacgatataaactatcttgccagccctaggaaggaaagaagtgaaatttctccctgcttcattggtcatgctagcgttcaccactgccgggcattaggttttgaagggaagacaggggttaaagaaagacacacacacagagagagggcagctgaaacagcaacaccagtatattgcagaaacctgaggaagtgggggaccagcttaatgccagggcccaccgctgcttacaggctgaggtactcatcggtatgggtgagacgggtctgggcagtatggcttgctgcctggcaggatattgataagatgttgttatgatcaggtggtttggccctctccggtgggatgtcatcgtggtgttccttgtacctttacccagcaagatatgatagggatggtttttttttttctgagacggagtctcgctctgtcgcccaggctggagtgcagtggtgcgatctcggctcactgcaagctccgcctcccaggttcatgccattctcctgcctcagcctccccagtagctgggattacaggcatccgccaccacgcccagctaattttttgtatttttagtagagagagggtttcaccatgttagccaggatggtctcgatctcctgaccttgtgatccgcccgccttggcctcccaaagtgctgggatcacaggtgtgagccaccgcgcccggccaacagggaagtttctttaggtgggccttcgtccgccttgcggtcaggcggctgagccggatggttctcatggcctgagctcctgtgaaatgtttcacttggcccgaggtctgcaaaatagcggggagctgacaaaatggtgcggtttggaccaacaccaggttgtgtttataaatgtttgttgaggatcttcctatttagattagtaaatctggggcttaggaaacaattgctctgtccatgatggcttcggggcagggcggaagtcccaagcatgtcacaacaccggtgcattcttttgggcctcacctggttttgttgcccatagtcgcagcctcatactggaccaaagaattttcatccatgatcccctttggttctcctgtccatgctaagagacagggagggcagtccccatttcctagatgaagagacttagggaaggaagtgagcttacctggggccccacagctagtaggtggcagagccaggattcgaacccatgtctctctgaccacaaaggtccgtgctttcctggaaagaccctggggtctatgcctttctcctggactctgagccttctggagaaggagccatgtcttactcatggtatagcgggtacaccagcacccttaacagggagcaacctgtgggccgggcactggggagggtttcatgggagcgggggaggggggacagcaggcgtgtccaggactttcctggaaaaccggctctgagtccagtcctcttcatccttatcctggcacctccctcccgggcaaggacctcactcttctctcctttcagccttttaaccatggacataaggtggccaagttctgttatgcagacaaggtgagtgagcctgtgtgcctggtgacccggggttagggttgctgcccctgctctgccctgccagctgctgatatggcgggggcagggggcatcagttgctgtgtccttctttggccatggtgggtaggtgggcagggggtggctgacactgagggagtccctgggtgatgtctttgactgggccaggcatacaaaggttaacttgagccaaacacaagctgcctcagccagggctgagacattcccagacatgcccattgtggtggggcagaccttggactggggaggaggtggattctggaaggctgagtcagggcaattggagacaccattgatggaaagctaggccaagaattggcactggaaagggccagcaggaggggctggggtggctgggggtccaggaactggcattgtgtggcgatgagggcagttggggtctgggaggccagcagcagagccgtgtctcaggctccagttgacctcaagtttctggatggtgggttaaggggcaccaggtcccaagaataaggtaaggttttgattagaccatgagagaaagtggagccagtgtaacagctgcgggactcagtgccaaggcctcggagagctgaccaacctggccgggcccttcaggcttcagactggcagccactacaggctctgatgggacgctgttgttggcagctatggtggcagggggctgagggcccagggagacaggcattgtccccggatggaagagagtggcctcccaggtctctcctccctcgctcactccccagggcctttcccgctgcaggtggcagtccccaacctctccctctccctttagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacaggtgaggtgctggtgggcccgggtgggtggggcggggtggggtgggagtcaggtgtgccctacccatggcagcagacatcagctgaagcgcttctgggtcctaagcccttttggggacccagagatgtcctcaagggacaaggcctaggagctgggatggatgatcacagattattaggcgagacagattgtgcagagcccatgtgtcctgcctcggaaatgtcccctctcctccatccctctgtcctcgctcctaggcctttgtcatgctttgcctggactggtggtggcctgcactgtctccctgcctcctagcttggtcagcccctcgccgccctcagagtggtctttccaacacctccaggatgttactcctggcttatgacccacccagacctctccaccactgagaggcaagtcccaagacctgagccccatacccagggcccttctgcccacctctgtccagctcgcccactgctctgcatttccctgccaagctgtcctgcccatagtgtagccatttggcacttagcaggactccccggccatggcaggcatcctctctgcctctgcccacgtgtcctcctgcctggaatgcctgctgtctcttccgtgctcagtgaactcttacctcctggtccagcccagatgtcaccccctccgtgagacttcctgagccttctccagccgaaaggactattcctgcctctgtttccccagagcatgttgttcctgcatcagttacagctcagattgcactggagtgtattgagttcctaggtactgcccctttacaagctttttggacatagtaaacatgtcttgacattctcggtctttttctgggctttgcatgatacctttcaggaggcatagcaagcccctgatcaatggttttctctgcacagagctggcatgacagctcctcaccctgctaaatgcaagttgagtgaggagtggctctagcaggcagagtgtgcgggggacaggagtcgagggagaaagggttatttcaccacctccaggacctgagccctacgctgccaactaacctgggttcctgaagggtaaattgcaggagccagaacccaggctgctttctggatcaggcatttgccactgcctgctcctcggtccccatggtgagcgccccctctgctgcacagagctggtatgacagcccctcagcctgctaaatgccttcttagattggctcagcagccctctggggtgggcgtcagctctgcgtgttcctggtgagccgcacgttgctgggaagacagtctaggatcagtttaggctttctctgtatttggcctaagactcaggaacttctaggaagcaaggtacacatcttagctcagcttcatgggctgtgtgtctctaataggtcgtgcacctgccagtgaccttgggtgccaagaggaggccacgtcaatctggaaaagccccgttcttggctgtccacagttcttttccctgcagctcacatttgctgttattaagaattgacggtttaagggaatcacagtcactcgcctcttggtttttggcccaaactaaccagcaaggccgaacatcattcctggggaaggagccatccacctcccacacaccgagtctctctcctggttttccagtgaccaatctccagctcatgctaatctgcccttctgtctggaaggctctgatcctgaatttagtctgaggcttgaccatagatcctttgccatgcaccaccattcagagttgctatgaaatgaagacagtgcatggcaagtacctggcctgctacagaggatcactaaaattcttctgatccccgtccagcccagagggccggctacaggaggtgctagctcaggggcttgagaatcctttccccctcagcccctgggatgggacctggtgagccctccaaatgtttcctggtccctcctggggcccggctcagtgctcgctttgggcacagcgtcagatgtgagaagaggatggacaggaggctgttggctgctcctgacccccggccctctgccttgcagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggaggtacctgcaggaggcagtgggcgagcaggcggggcagcccaatgccatgggcctgatctcaccgctgcctccttccccagggcttcgtggcggccatctcgccctttaacttcactgcaatcggcggcaacctggcgggggcaccggccctgatggtgagatgtgggcacaggtgggacagcggcagctggttgtcctcctggtcccaacagacagacagaggccaccctgagccccttgggtctcagcctagtcatggggagaggcacagaaggtggaggcagcttggggctgtgggtaggctttgggaccagagacccagtttgaatcccagcgtcgtgcctctctgcctgggagaccctggcaatccctgaacttctctgaggcacagtttcctcatctgcaaagtggaaataataggaaagcctccatgactgggttgtgaggctcaaatgagacacatccagcagcaggcagggctggcccggagctggctgagtgttggtggctctgttgatgatcattaccgctgaccttcagtgctcaccacgtgcctgctgctgtcaagcacggcatggagatgatctcatttcatcctctcagcagcttcgagagggagttgtgactctgcctctttgccagatgacaaaactgagacacacagccgtgacttacttggcaagactgagtgactagtaaataaatgatggagcagagaaagatttggatgtagtctctctcggggttgatggtattcaagtcactcctctgccattatcggagtgaggttggctattactggatgaagtcccaggcctgtgggggaggtgcagcccagctcccagacagcctgggtgggagaggtccacatagttgtcgggaaccccgagccccagacaggggcactggatgctgatgccggagtgtgtactagggacatggatggggacgtcctcatgcatctgtgcacagacaaacacggtgcatggccaggcgcccacgtgcctggctgctgcacatgcctgacccaggacatgtgctgagagagcccgtgtgtacttgccccgccgcgcccggtgagcactcagtgactctagcagtaagaacagacctgcctaggtgatggcaggaccggttggtgcaggcttctggggaaagggagccttggccagagcgtggggcagattgggctgtgccgtggcctccttggcagggacttttggagatagggccagacgccttggaggagtggggtcgggtaggggatgtcctggttggcacagagtctggtggttccaggtgagggacaaccatgctgtagggtagggtggggtgggggttgggggctggtggcgccatcctcatgcatcactgaaacacctcccgggcagggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgccgtaagtccctggggatggtgtaggctgtggtggctaggggacgttcacctgctcacctgctgtctgcctggggatggggctgtgaacccaggggtcatgcacggactctactcccttacttgctgtgtggctatgagtgagccacttcacctctctgagcttccatttcttcacctgtacagggagtgattatccttaatttgcagagtcattgcaaggattaaacatgttaatgaacaggaaagagcttcgcagactggaagtgcaccctacagctgtgggtaatattgatttcagtgctacctctgctactggaaagggcacaggggagcacagaatgaactggaggagtcaggaagccttcctggaggaggtgacatctaagcagaggagttggccaggcagaggggaagaggcaggagaagaatatatatgttgggagagggaatagcacatacaatgttgccaagccaaaaacttgtgctctggggcatggcaggatcctgtgtggctggagtgtggagtttgggggcgacagggcaagagagtgagggcagggcatggtttgagttgaggtaggggaggcaggccactacctgatctcgaccatccatgcactcactggctgagcaggaaatttggagctcacactaaggctcagtggtgagcacacaccagggacaaggtcccggctctcaggctggaggtggcggcagggagtggttcagtgaccataagatacttaggagtctgcaaaggtgtctggcctttatcctgaaggtgatgggagccatggaaggcttcaagcagggagagtggctgagtcagagttctgtgtcaggcagagattgcaaataatggcccccaaattggatctggcaagaggctctactttctttgactcctaacagtgatggcccaactttgtataattgggacaatttcatagataaatccaaatattggcctgtcttggtcccctggacctggatgctctgatcttgcatttcctggtggtaccactggctggaagtgggtgggtgccctctggctccctgcatacctgatccacgctgtttcctttccctgctggctcctctgggcccctgtgttggcaccctcattctcagtgatctctctgtgacctgatgcaggagactggccagggactgttgacctccagggaggggtggtaggggcttgaaccaggggagagatgggggatgtggagaagggggcaggttcaggtgagaaggatgcagggaggcacagtggccattgcctgtcctggagttggggttggggtgcgtgtggggatgaggggggttgtcagcgagaatgttcaagatgggcacctgggagggcgagcgggctcgggggaagatgaatctcctgttggtcacttcgggtgttatctgggtggagatgcctggaggcagccagacgcccgggtctgcagctcagggtccttcttacctcctcttccaggccccaggctctgccacccccttccccgcagctttgctgggggtgggagtgggtggtggcagcgttagaactgctgagaagggccgttttccaaaaggcctgctctgccagccacgggcccctgggctccccgcctatcagcgggcggagcgggcctggaccccattctccacgctctgatgagcagcgggcttaaaggtgggaaggccataaattagtattagctactgtgtcgctggctcccgggtgattagcatttttattgttttgtggtgctgaggttggtcacacttggagcctggggaggaggcgaggccctccagggtggtggcttcgggcggggcctgagctccctctcccaggactctcctcggtttggcctctcaggcctgggcgctgggcttgggggggatccttcgcagaccacagcggggtctgttccctgccaggtacctgcagtgtgcccagcatgtcttaagcacatgcctcacacttgaactcatcacaaaacaaccctgccaggtcaggattgttctccctgtttcccagatgaggtgcagaattcgaggctcagagaggttaagtaatgaacccaggatcacacagcccttagtgtcctcctggctgcagaacatggacctcctctgcagcatcttgctgcctagccccccgttgcccgctccccgtagtcttggaatgcagcctgttcccagccgccatccccgacttggctcccacctcctgctgggctgcccccggcaatgctcctccctgggcttttccgcccccttcctctggcctggctccctgaaccccaccctttctcctgtggttccagcaccttcaaacacctgtggaagcaggtggcccagaacctggaccggttccacaccttcccacgcctggctggaggtaaggcctgcctcacctcctcctcccgtgtggccccagggacccctcccctggccattatgaaagaggagggaggtagaggggatccagccacaagtcaggtggatgaaccatttcaggcaccagcactgcccagtagaactttttgtgatgagggatgcgtccagtaccttcactctccaatatgcagccaccagccacacatggccatggagcccttgaagggtggcctgtgcgactgaggaactgcattatctagttttctttcattttaattaagttaaatcttagtagccagtcgtggctggtggctgccgtgtcgggcattgcagctgtaagcggaggcaagtgcaaatgcagagaccagaagtgggaatgaacttgtatttgaagaaacaaagcaaggcccatgagtagggagggaggagggctggtaggagaagacgggctgagacgtaggcagggctggaccttgttggcatattaaagttttcccacaaagaaacagtttcatggtcaaggaaatttggcatgtgtggtgttaaagcaaaatggactcctcccgtgcagaacttctcagagccttgaatgctctaatacgcatggcacatcttcaaggacaaggtctgccatgtagtgtttcccacacgcattgggccatggaaccccgtttctgcaaagacccccatggaccaagtgttttgtggagcacattttgggaatgtgctgaggcctagagggagggagagttgcagccagcacgtgaccagcagagctgggaccggtggtccagcatgtttctctgtggcgtgaattggggcccactggggagtctggaccctgttcctggactggtgggagttcggatgggggtgtcagggaaggtgagcgctcctcagggtcagctgtgtggctttctgctctcagagcctccttccctgcctccctgagggagagaggccgctggttaccactttccaacctggagcaggtgacttcatctctctgtgcctcagttttcttggcttgaaattggggatagtaatgggaggttgttgtgaggctttggtcagacaaagcacagcgtacttcgtccagagttgggcagctgttaagtgctttcagctgctgttagctgctgcttcccacggagggaggaaactgaggccgggagagtgaagtgacctgtctgaagctccctcccactggggaaatgggggagcggtttccagcacgcgtggggaggaggggcccaaccctggcagccgacatagggtaggctccaatgtccctcgtggacgagggctcaggagaacctcacaaaaagctgtgcccacttctgggaatggctggctctcgggggccttgggttctcatctgtcctctgctgttgtgttgggtagtttcagttttcccatcagtgtaatggggctgttggacctgatcacctctgatgcccttcacccctccctgggcctcagtttcctcatctgtggagtgggagaatgggcctggcccgtgggtctctgggatgttggccagcgctcactctgagcctccgcccgctctgggctgctccgtgctcgtgttggtcccgggccatggatggcgtaggtggtgttttgggcccctgggcaaccgggggagccagctcctctggtcatttccccacccccgacccctgtagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgacgtgagtggcaccgtcacccccgccgcggcccagcggggggctgatgggattgggtccctgggaggctcctctgcagccggggctggggtgtgcggggaggggtctcccttggtctcggcctgcagtgactcgtctcttctggcgcctcccttgcctccagcctgcagaggattttgggaccttcttctctgcagtgattgatgccaaggtacggggtgggaagtgggcgttcctgggtgggggcaagccctggagtgggtggaagagggaggaagagatacagggtaccctgacccagggcatgacccagccccactgctttgatcaaggcagctcagcagccacacacgcacctccagcttcagaaagggcagaatcagccgtagccagacaagagctcatcttgcggccaccctggaaccaggctcagcgagctcctaatagcatttgcatgagtgcatgtacacgtgtgtttgtgaatgtgttcatatagggctccgtgtggctccacatgtaggtctttccatataaacacgtacatatccatttgcacataagcacacacacgcatatgtcgataagtccacccacacgcatgtacatggagaaggcatgcagatccctacatgcttagacatgtgaccatgcatatgcctatatatgcattgattgatgtgtgtctgtgtttatatgcgagtgcacctgtagtactaacacacgtacacttgtgtgtgtacacacacacacacacacagtgttcatgtctgtccttgtctctgctgtggctcagccagaccctggcttttgcccttggcgtcccctacccctgcccctgtttcaggagttgggcccttcaggtgcaggtgtttcggggtgagtgtgttgtgggggctgccgcagggatgccttcccagcctcttagacctccctcctccctgcccaccccagtcctttgcccgtatcaagaagtggctggagcacgcacgctcctcacccagcctcaccatcctggccgggggcaagtgtgatgactccgtgggctactttgtggagccctgcatcgtggagagcaaggaccctcaggagcccatcatgaaggaggtgactggggtgggcagcctggggtccagaggaggacaatcccaccggagcacagcacacacacagttctcctggagacattctcccatttcacagatgaggccctaaagggagaccctaaaagggaatgcctccgaccgggagagagtagagccaggttttgagctcaggctgcctaactccaaatccggggctgtgtccttgaccctggctggggtctgagcatttccagtgccctcagcaaccacgtccactgcagccatcataatggctgacactgatagacttttactgtggggccagctgtggctgagcacttggctgagatgacgtgggtgttactgttcccattttacagatgagaaactgaggtcaaggcacttgcccaagttggtagtgcagggctggagtgtgcctgagaagatcttccccccagccccttggtggcagagggaaccatgaacccttctggagggaatggtatctctgggcaactctcatgccagctgctgctggaagcctctgggacctggacccttagttctccgggtgtgggtttggcagggagagccagaaaatgtttgcatcttttgccggcttgtggtgggatggacaggacagggagctgggcacgttgctgtcctggagggaacccaggaggaggcgacacctgacccttcttgcagacactgaagtgtaaactgaggcccagggactggggagagggtgagccagagcaggggcactgggagggctcagggccctggtccctggtcccgtggagggtctgacgccggggcctctctcctaggagatcttcgggcctgtactgtctgtgtacgtctacccggatgacaagtacaaggagacgctgcagctggttgacagcaccaccagctatggcctcacgggggcagtgttctcccaggataagtgagtggccaggccgcagccctggtgctgtgctccgggtgtcctgtccgtgtccccatccccacctcctggacgtggttcccagtaataatgctgcccctaccttctctctgtcccctcccctcagcccagacaggcagccagggctcgccacatgggcccacagcagcaggctctttgttgccggtactggtggtgccggtgccagggtgccactggggaccagtggatctgaacctctaggggcagggctaggaattggtgtcttcgactggctctgcgggatctggtgttgccccactgagtgaggtgattgtcccatgctacaaagcagggcaggccaggggctgcagaggcaggattcgaacctgggtcacatgaggctaaacttgaggcttcgcctcttctttcctccgtggcactggttgcccccatgtctgcctctatgagaaagtggaggtgagcttggagagggaggaagggtgtgggcctgggagctggagtttccgctgctcctgagggacaggaacattggaccaggacaggccactcccttcaacttcgcagtagccctgtaacgaggcgtgccaagcccctccccagaggaggaagctgggctcagagactgggtaacctgaccgaaggcccacagccaacagctggcagcatccctcatccctgactcggcctcctgttgaacctggaaagccagtgtgggctggagcaggggtgttgaggctggagctggggctggaggggagatgagctggttgctctgtcaccactgctctgctttgtagggacgtcgtgcaggaggccacaaaggtgctgaggaatgctgccggcaacttctacatcaacgacaagtccactggctcgatagtgggccagcagccctttgggggggcccgagcctctggtgagtgggtcccccttcccacaggggagctgagttcctggtgggagaccctagatgttacgtctcgaggggcttcagagtaataggaaggataccatttactgagcacttattgtgggccaagcaagtgcactagctcagggtcctttcagcaaactcgtgagcaaagggactattcttcccattttacagaggaggaaactgaggctcaaggccacatgaccctggtgggattgtaattttggctccagcagccgcactttctgcaccatagccagtgtcccttaagtccaacaacctctacttcacaatggggaactgaggctcaggaggagcaatggcttgccaaaggtgactgctcctgagtggcagagccagggctgaacccaggcgtgctggggtttcccacaccgaccagttctccagctcttgatggatgctggctgggtgtcctacagtttaacttgatgctcactgcctggggttagtgcagaccccacaggttaagaactcagtcccgtaagactgaccccccaacttcagatgccaatcacaagtactgggaccccaggttacccacaccttgtctgactttgcgacgcattagaagctcccatgatgccctcttgagttttgatacgttgttagaacagctcacggaaccgaggggaagcgtgcttactattacccatgtattgcagagggtattttaaaggatacagatgaacagccagatgcgcagacacatagggcaaagactggaagggtccccggcaggggcaccgccgtccccctggagttcgggctgtgccacccccttggcatgtggacgtgttcaccaatctggaagctctcccgaccctgtccttttaggtttttatggaggctgcattacacaggcacgattgattcaatcattggccattggggtcgactcaacctccagcccctctgccctccctggggctgaaggttccaagcctctaatcacagggttggttcctttgccaatcagtgccatcctgcaagagccctcattagcataaactcatgtgtgattagaaggggcttgttatgaataacggaagacactcctttcacccccatcactctggaaattccaagagctttaggaattctggctaggaaccaggggtgaaggctagatatgtacctcttatggcaccccaggaccatgccaagtccctgcctctcagtctagtgttctctccacgccacaccctgcctcttagacatcctcgcatcccagcaaggatgcaaggctgggtgcgactggagagaacaatggaggctccccacagactggagactggaggcagggtctcctgtccatccctctggctcttctgcatgccccaagcttggcagcaggctcgctgctggccgctacactgctggtccgttgattccatcatctcctcccttccccttctgcccaggctgttgcatcttttcagagaaaaacagaagtgtcttttccgcaggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 621 - DNA, 6563 bp, Homo sapiens
cggctgcgcgggagattcgctggacgatcgcaagcgcggaggccgggcgggcgcgcgcgccatggagcggctgcgggacgtgcgggagcggctgcaggcgtgggagcgcgcgttccgacggcagcgcgggcggcgaccgagccaggtgcgggctgcccaggggccgaggggctgagggcgcggcccgcggctgacgcgttccctttacaggacgacgtggaggcggcgccggaggagacccgcggtgagcgcgcggcggggcggcgggggcgagaagacaccgggtcggcaggggcccaggccccaccctgaccccgcctcccgctcgcccacgcagcgctctaccgggaataccgcactctgaagcgtaccacgggccaggccggcggcgggctccgcagctccgagtcgctccccgcggcggccgaagaggtacccaggccccgccgccccagcctcctcccacttccctgtttggcggagtggcgggagccacggagtcgcggccaggccgccgtggggcacagaacttgggagggggactgggcaaagtgaagaagggccgggcctcgctccaggtgcgggaggggtggctgggagcgcttctgccgccacaacagccttttctggcctgtgcccctgttgtctcctgcaggcgccagagccccgctgctgggggccccatctgaatcgggctgcgaccaagagtccacagtctacgccagggcggagccgccagggctcggtgccggactacgggcagcggctcaaggccaatctgaaaggcaccctgcaggtgaggagtgggcaggcagtgagtccacgctaggtccacagctgcttccggtccgggtcgccctcttgtcattttttccacacagacaggcacgggcccctgtgccaaccagggcacgagtcttcagggagcttctcggggccttcgcccttgactccctttctagtccagccttgtgctaattagcctgctctacaattgagcgtggggactcaggtaggttttagagtctacagtagctcaggggcctgagttcctcctgctgttctgttgttcccctcccaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggtaagacagcgacgggccaggacaggcattccctttccctcccctcagccctcccgtatttcccgcccagtgaccctcctatgtgggcaccccccaggcatggaagcagaagtggcggaagaaaggggagtgttttgggggtggtggtgccacagtcacaaccaaggagtcttgtttcctgaacgagcagttcgatcactgggcagcccagtgtccccggccaggtgagacatctgccctggagggtgggtccggccaacactgtggagagggcgcagtgctcttttgggggacacttatgttccaagcaacaggccttccaggtacccctggtccaggccctaccctagctcccctgaaggagggtggcagggacgacgatggctgtcactcttttctgctttggaaaaagtagcccagaggaagggcactgcctgctgccaaccccctttgggggaaggagaggttgtggccagtggttgtcttgcccgacctggagctcccattctaccctctcctgcctgccccagcaagtgaggaagacacagatgctgttgggcctgagccactggttccttcaccacaacctgtacctgaggtgcccagcctggaccccaccgtgctgccactctactccctggggccctcagggcagttggcaggtgagcagtcagcttctggcccagagccttcactgaggggttggggtgactcaagtcatggtgatcaacatctgtgtctgcagagacgccggctgaggtgttccaggccctggagcagctggggcaccaagcctttcgccctgggcaggagcgtgcagtcatgcggatcctgtctggtgagcgtggctgccagggctgaggctgggctgaggccaggctgcagaaccctgctgctgactcccgccccatccaggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtgcacacagggccctgggcacacgtacacagccaagaaccagcacttgtgactcccaagggcaactgctgcttgtcccctaaccaccccctcccctgggagcttcaaggtgtctgtggcctcagtcccagtcttggcagcaggtcaaaggcagcccagctccacaggcaccacagccacccctacgggaaatgtgctgggaaaggagccatccctacttcagtctgtctgctctggggctcctgggccaaggcccacaggtggctctaaacccttagccctaggacccaggacctggttctcctctcccctgagggactaggatggacatggcagcagctctgggatgacttggggaagggccagggctgggctggcgtatgacggctgtcgctcctgcatttgcaggtgtctggcctgccaccgtgtctcaaggcggcctgcatacactcgggcatgaccaggaagcaacgggaatctgtcctgcagaaggtgggggcctcatgggcctaggggtgagggaggcagcgggcgggcacctgggctgtgcctctgatcttgctgccttcagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgagccatatgtgaactggggtgggcggccagggccgggatgggctgggcggcctcacaccactgccgcctctggtgcaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggtgggtgtgtgtgctctggggaccctgcagggccctggctgctgactgcccacgccgacccctcctcactccccaccgcccacgccgaccccttctcactccccaccgcccacgccgacccctcctcactccccacgccgacccctcctcactccccactgcacacgccgacccctcctcactccccactgcccacgccaaccgctcctcatcaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtgcggcatggacagagctggtgtccccgtggacccaccttgggcacacatggtcccatcccactgaccatctgcctgtcttccccaaaggtcgtgcccccaaaaccacagccgaggcctaccacgcgggcatgtgcagccgggaacggcggcgggtacagcgagccttcatgcagggccagttgccgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccaggttggcaccccccccccccacactgccagtgctcgagcccccagtggtccaccccaccctcatgaaagttgccctgcagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggagggtgaggaacctggggtaagccacaggggtgtggaggggctgtccccgcgtccgctgagccctgctctgcccccagccatcgagactttgctgtgctacctggagctgcacccacaccactggctggagctgctggcgaccacctatacccattgccgtctgaactgccctgggggccctgcccagctccaggccctggcccacaggtaagcacgccctgcccagttggagacgaggttggagaatcagggctgttggccacatgtccctttttccctgggcacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgcgcctctccccaccccacaccgccctggacgctgcctgcctgcatctgacatgctttccggcaggtgtgcggcgtgggacaggggtgcttgtggagttcagtgagctggccttccaccttcgcagcccgggggacttgaccgctgaggagaaggaccagatatgtgacttcctctatggccgtgtgcaggcccgggagcgccaggccctggcccgtctgcgcagaaccttccaggcctttcacaggttgggaggaggcgggcggggcctgggaccatccaccctcccgcagtgatcagctctgacaggctcctccccacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagagtgagtgcagtaaggccaggcagctcatcggggttgcaggttccctgggctgcatggggcttgctctgtggatgcagtgccacgggagctcagaggaagcctgatgtgcctgtccacacagctccaggattgggaggaccaggtccgctgcgacatccgccagttcctgtccctgaggccagaggagaagttctccagcagggctgtggcccgcatcttccacggcatcggtgaggcctgggaggccccacccgctgcaggctggggctgggggctggggcaggtgaggcctgggaggctccacccgctgcaggctggggctggggctcacggctgtgtcttggctccaccgtaggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttgtttttatggg

SEQ ID NO: 622 - DNA, 18223 bp, Homo sapiens
gccgcggccaccggaagagtcgcggtcgccagtccagtcgggagagtggggagcggaagcggcggccgcggcggcggcgggcggcgctgggacccggtagcggccggagaacaagggagctggcgccgccagcagccgccgagctgggttgagccgctgggccgcgccgcgcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcgggtgaggatggcccccgccccgcctccgggagccccggccgctctggcttctaagggatgacgcggtccgtttcgacttgcctcgctacaccggctcctagccccgctctgacttctaggggcgactcggcccatttgggcccctttggttccagccccagtagcaactcccgtttacctctgaagaggggacgttggcctcccttgtttaaggggacgtccaattccccactagcaatcagagttcctgccggtgcggtccccttacctcttcagagaccagtggcccacagagacagacacaccccccctccacctagtttcagagcccgagtcccccatcctcctcctgccgaggagccagagccacctttttccgcacagacttgggtcgtgtggccctcgttcttcgcccccttcatcttttcagcagcacagctcccagccatatttggagtatgctgcatctgagggctctgctgggactttgagctgggggaggggtgtcgggggtgctcgggcgcctggccgcgagcggggtctgcagatctgatgtttatctagctgcctgccctctcctttgtgggctgttgtgggtgttgtcaccggaacagagagcctgacccctgcggagtagtcctcactgacccaggtgctgatctttcctccaattcgggcttttttcctccagttggtggccagtggagagacgttaggaagggcctggggcctgggtgggatagccaggaagagtttcttggtgttctctatcttcccctccctggtggggtcttcccttccacccagctgcagagatctggacaggcacagtttggaagcagtcactttccctttaagaggggatggaatgttggagccggaaggttctgaagcagctggcctgggaagaggggggcctggctgatccccctcgaacccccccaactcccaggagactgggggagggggaggcgcccacacttgcctgccgcctcactaactgggcgctgggcctggaggcggtggggaaggcccctccaggcctgaaggctgcctctccagccctagcctgaggcctgcactgctctttggagctgaggccccacagccaagaggagacattcttctccccagtgttcatctgtctggcttctctcccaagcccctggcccacctagcactaggaagcaagcaccttctgtctaatgcctggcatgttttgctgtcaccttctgccctggaactcagggttggatgagcccctgaaatcatgtgtgtgagagtgctttgtacagtgggcagtgctttgtagattctaactattcttgtttctgttgttgttcctgccctggggtggggtgctcctggtgtgataatgattgtctgccttcagcccagagacagacacctctaattggaagattctgaggagggatggatctagaaggggtctgggtgagggggtggatactttggcctggcaagagaagaatagggttagaagggatcaagctactgcctccacataaggaatgggggaagatgagccagagtccagtgccctggggccacctcagatccagatgccttgagggactaagataggctgtctctccaccctgtacttatctccagacccactggacctggcccctgcctcctaagcctggacaactctgggctgctctcccaatcccaaggcctaactgcagttttaagagggcccccattacatccagtcactgttacttaatatttttctttaaatccattgtcagtccacttactgtttttcttagcttgaaccaagcaataatatgaaaccataggtctgacttttctgtttatatttctttctaaaatatgtttaacataaatatttaatgattgaactaagcaatgttaatctgtgtgccacctgaagccatcttgcaaacatcagtggtacttgaaccaaaatcagagttggaccattttagcagggttgaaaacagtattaaaaatgaagtggaggagatggattctgtttgtatccccagaaggataaatgagcaggggaactgatagagctgtcttgtcacagaggactaatagctgaagagcatatatatatgtttcatttatttaacacacgccttttatgcttagtgtgccagggactaatctaaatgcttttcaaatcttcactcatttaatcttcgaaacagccttatgaaatagatagcgtaatagtatctctagtttacaaatgaaactctgtcaggcatggtggctcacacctgtaatctcagcaatttgggaggctgaggtgggaggattgcttgaggccaggaatctgagaccagccttggcaacatagcaagaccccatctctacaaaaaaattttttaattagccaggcatgatgctttgtgcctgtagtcccaacttgggaggctgagacaggaggatcacttgagcataggagtttggggctgcagtgagctgtgatggtgccactgtactccagcctggaaaatagagtgggaccgtgtttcagaaaaaaaaaaaaaaggaaactagagcacagaaagcttaagtaacttgcctaaggtcacacagctaataagaggcagagcagagcttgctttgacatcaggaatctggatccaaaaatctaaatccttaatcgcacaattttaggtgtcattattatcaccattttactgatgaatcctctccgagggaggtggtaagccttggaaaactgtagaggtgacaaggccaccatttctccgagccccacaagaggaaggtcaggcggaggtcagtgaccctagaggaaggaaagtgggtcagaggaggaaggctgctgtctctccagtttctccactcctggctcagcctttgaggtgctagttgtgaggctcctcaagtcccatctggtctacaaaagtatttgtcaagctcagggtaggcccagccatctttttaaattttttttcttttttttttttttttgaggagttttgctctcgtcacccaggctggagtgcagtggcgcaatctcggctcactgcaaccttcgcctcccgggttcaggtgattctcctgcctcagcctcccaagtagctgggattacaggcatgagccaccatgcctggctaattttagtatttttggtagagatggggtttcaccacgttggccaggctggtctggaactcctgacctcaagcaatccacccacctcggcctccccaagtgctgggattacaggtgatgagccaccgcgcctggcctgccatcttaagttatttgagaaatggaggaaggataaacattttcagcattgagggcatggtggatggttcatagaagtaaggtgcctactgctagtctggccttgagctgtgagagagggcagcatggcgatcaggtcattagctgtgtggcttcctgctccactgtcctccctctgggccttccacctgcagactcttcttcccctgtctcctccaggttcaaattctcctgtcttctgggttgagcttttctgtgagaactgtcatggcactctcttattttatcctttttttttttttttgagatggagcctggctttgtcacccaggctggggtacagtggtgcgaccttggctcactgcaacctctgcctcccgggttcaaacgattctcctgcttcagcctcacaaatagctgggactactggtgtgtgccaccacacctggctaatttttgtattttaaatagagatggggttttgctacgttagccaagctagtcacgaactcttgacctcaagtgatccgcccaccttggcctcccaaagtgctgggattacaggtgtgagccaccgtgcctggtatattttatctttatatcctgacacctgtgtaacactcagcagatgtctatccattgaacacatgtgctgctcctacggctccaaccacttcctggattgcagtatatttccatgaactatccactggaccatagtctctctgagaacaaggcaggctctgggtctgatgtttcatgagaaaacctacaatagcaagctcaggacctgaaacccactgggccctcagccaaagcattttattttattttatttttatttttttattttttatttttattttattgtatgttttttgagagggagtctcgctgtgtcgcccaggctggagtgcagtggcacgatcttggttcactgcaagctccgcctcctgggttcacgccattctcctccctcagcctcccgagtagctgggactacaggtgcccgccaccacgccctgctaattttttttttttttttttggtatttttagtagagacggggtttcaccgtattagccaggatggtcttgatctcctgactcatgatccgctcaccttggcctcccaaagtgctgggattacaggcctgagccaccgtgccctgccagtcaaagcattttaattggatgaacaatgaatgatgaacaggtttatttgctttgcccttaataatgtatacgtagttagaaatagtgtatggatcctgctaaaaatggacaatataattagcttttactgtatgcctggatcatgccaggcatttaaggatcccttttaccaggatgagacaaaggcttggagaaattaagaaacttctctaagataagagggccagtaagtggtagaattggaatttgagtcattatttgtttgactccatttggggtatgagtgtgtgtgtgtgtgtgtaagtgctatgtaaaccccagccattcagctccatggtgggagagtaagacctgtctgaggttccccaaagctgctgaagatcagctgattgttttgagtcagcagagccttggtggcctgtcgatgacccccagaaagagaggaaacgtgtagtgtggagcagtgtggtggggcctgccaggggagcagggaggtagggactcagcagcaatttcccccagacaggcagaccctatccaaagcaggctgtgccatgtggcccacatattcccttttcctttgagccctgtggggctgccaacctggagtaccctgtggccagagtggctggtgggtctgagctacctctgtgtcccttctttctagcctgtcctttctacactttctgccatggtgggccgcagtaggatgatttgggctgctttccgagggtcgctgtggctctgggaatgatagaggagccagagctggatgggagtggggagggcaggcttggcctgtgaacttggctgtgagtccaaaaatgtgagcatcacaagggagccaagcacattcccagctctgggcagaagctgctctaagaacaaggggggccaggcacggcggctcacgcctgtaatcccagcatttggggaggccgaggtgggcgggtcacctgaggtcaggagttcaagaccaccctggccaacacggtgaaaccctatctctactaaaaatataaaaattagccaggcgtggtggcaggcacctgtaatcccagctactcggcaggctgaggcaggagaatcacttgaacccgggaggcgcaggttgcagtgggctgagattgcaccactggactccagcctgggtgacagagcgagactccgtctcaaaaaaaaaaaaccaaagaacaagtggggactgaacttcccaacctcctccttgctgtcttccctctctgctcagagctcctggcatgcgtcatcttacccttggtcatgtcttcccatctctgtactcctggcatatttgacagtctgagggtcctcaaacttttccactccccttcctagccccaaactgtagttactgcctgacttcttgcctcaccacattcccccggccaaactacatgctccgtgaccacattccacacccttcatgcctcacatcattgtcctccagcacccactctccacatagacccacattacctctgttattatataggaaagaatgtgaaatacagtggaaagagtatggattttggagtcaagcctggggtgaaattccagctctgacatctaccagtcctgtgaccttggacaagttaactgaatacatctcagtttccttattcatgaaatgaagatcatagtctgcccactgaggctgatgtgaagattataggttctaactataggaagataaggtggtgtaatggtaagaatgcagatgttagagtcaggctaaccaggattcaaatttcagcagtttaggagaattactgaacctattgagcctagtttccccattgtacctgctgccttatagcattgttgtattaaatgaaattatataagtaaagtgtttagcatagtgcttggcccataatactcatttatgctcaataaatgacagcaattttttttttttttttgagacagggtcttgctctgtcacccaggctggagtgcagtggcacaatgatagctcactgcagccttgaactcctaggctcaagcgatcgtcccacctcagccttccaagtagctgggaccacaggcatacgctaccacgctcggctaatttttgtatttgttttgttttgtagagccggcacctcgctatgttgaccaggcaggtctcaaaactcctggcctcaagcgatcctcctgccttggcctcccaaagtgctgagattaccagcgtgagaaagagcaattattactgttaattatcataatggcatgtggaaaatgttcagtaaatgccttctccccttctctttttctttttcttttctttttttttttttttttgacacggagtctcactctgttgcccaggctggagcacagtggcgtgatctcagctcactgcaacctccacctgcccgattcaagtgattcgcctgccttagcctcccaagtagctgggatcacaggactggtagatgtcagagctggaatttcaccccaggcttgactccaaaatccatactctttccactgtatttcacattctttcctatataataacagaggtaacgtgggtctatgtggagagtgggtgctggaggacaatgatgtgaggcatgaagggtgtggaatgtggtcacggggcatgtagtttggccgggggaatgtggtgaggcaagaagtcaggcagtaactacagtttggggctaggaaggggagtggaaaagtttgaggaccctcagactgtcaaatatgccaggagtacagagatgggaagacacccaagtagatgggtgcacaccaccacacccggctaatttttgtatttttagtagagatggggttttgccatgttagccaggctggtctcgtactcctgacctcagggtgatctgcctgcctcagcctctcaaagttctgggattacaggtgtgagctatcacgcctggcctccccttctcttttctaattttcttaaattctttgtccatacctcccacaacaatgttaggattcccacttaagaaaggaaggacagttataattgtatgcttttttccaattagggatcagagggaaagagaaagtctagcccaggagagtcatgttggggatgggtagagcactttagagattttagggagtggcatgggggacagtgatgtgtcagttgtaatttgcaatcacctgatgactgagaggatgccccgggaaggtatctggcctaggcagggctggtgtcttcctggtggtgccaaagagctgtctctgggtctccccaacctctgctttcatttgaacagtcttgtgctggtggtttgattcccagtttaggatggaggagcccctgagagttgggatttgaggatcctccatttgcaccctagaaggttctctgtgacatccccctttctctgcagagtggtgaaggaggagatctcggatgacaatgccaagctaccatgcttcaatggccgggtggtgtcctgggtaaggagccctcagccttccatccacctgcatccctgtgctgggctggacgagggaaaggcatcactgagattgtagctggtggttttaagcttcagtatctgaatctttctttagttttgcaaatgaactgcttctcaccccagattctgtaacctttgatgaaaagtgagaaattagtgggaagggggaagagggagagacggaaacacacagtggagacagtaacgtttcctatgccgttcagacacttgcctcagatttccttctgccatctgctcatctctgccttagacctctgagccttgttctttgtccccattccacttcaccaccccatgccttccaacaaccccgtcaatagcaggaagtggcagaggggccactgttcatctcagccaccctcgcacagccctgtcttttctccctcgatatttcctgcttccttcctcttaggccttcatgccttgctggaagtgaactatccccttctccttgatgctcctgtaacatactactcactcagtttctccctttcagctggtgtcagctgagggctcacacccagacccagcccccttctgtgctgataacccatcggagctgccaccacctatggagcgcacgggaggcatcggggactcccgacccccatccttccagtgagtgtgacctgagggtggggagggccgcatcagttcagcccagggctgggggagggagcccccagcctgccccctcccccatcaagtctcttccctgcagccctcatgctggtgggggcagccaggagaacctggacaatgacacagagacggactctttggtgtctgcccagcgagagcggccacgccggagggatggcccagagcatggtatatcttcctgaacacggacactgtccgcacctcacaccctcccctcactttccacccagctacccaccttcttgccctacttcccgagctcaggatatgcctggccccagtgcagcccctggcttgcctctctccctccttcacccctgcactgggcactgtgtaaacccaactgcttccatcccctgcagcaacccggctaaatggaactgcgaagggggaacggcggcgagaaccagggggttatgatagctcatccacccttatgagcagtgagctggagaccaccagcttctttgactcagatgaggatgactccaccagcaggtggggcttgagtttcatgggtattgtggggcaggtgaccctggaggagccctaaaccctgaggatgcggggcccctgggaggcttatgggctttgtgttggggacccaggccctgcagtgcctcccctcatgggggcagggctgggccagcctggtggggaacgactgtgggccccacaggttcagcagctccacagaacagagcagtgcctcacgcctgatgagaagacacaagcggcggcggcggaagcagaaggtttctcggattgagcgggtatggggtctgggaggctagggatgggtggaggcagattgtgagcccttcctacgcagggccaaggcttgttcttccttagatcccatccccctagtgcagtgttgagaaccttggggctgggggctgcaccggggactcaccttgaggaggagtcaggtgggagtgaattcctgccacctccacctgctgctcagggcctctgtctattccagtcctcgtccttcagcagcatcacggactccaccatgtcactcaacatcatcacggtcactctcaacatgggtgagtctgaggaaacagcactctcaagcacctgctatatgccagacactgggcagacttgagttcagagagcgtagaatatgttccctgccctcaaggagctctctttcgtaaacatcagctgatacataaactgatcattttagtatctcaccatcagggctatgacagagataagcacagagagctgtggaagcagaaaatggtatcagggaaggcttcctggaggaagtgatttctgagtgcccactccttcacatctctcagccattgcatccttgctctccgatttctgccctaggtactctctttatgagacagctggatatagtaaaaggagcccaactatgggatttaaatctgagtttgattcctggctctgccacttactggcttagaaaagtcatcttctaagttcactgaacctcagttgcctgctctgtaaaatgggactgagtccctaccttatagccagcaagggttccatggaagcatgtttgagcatgctgagtgcagtgcctgattcaggatcagcaaatgtcagttcagttcctgtccctttccattttctaatgggctgggaatgcgggtaggaaccttgctcccccttaaggtcttaaattactctctatagaaaaatataacttcttgggcatctccattgtgggccaaagcaacgagcgtggtgacggcggcatctacattggctctatcatgaagggtggggccgtggctgctgatggacgcatcgagccaggagatatgttgttacaggtatcagtgcccatcctaggcggtggtgtggatagagggcagggaggtgtcctaccatctgtaccctgctccttcagaggccccttcttggttgggggaagactccctgacctaccaagttgagttcccttttcatcctccccagcacagctgtttatcccactcctggtcctttcccaggtaaacgagatcaactttgagaacatgagtaatgacgatgcagtccgggtactgcgggagattgtgcacaaaccggggtatggatggaatggggcactgggcaaggggcttggtctggcctatacgcatcctgccttcactaggacacccttgttttcaggcccatcaccctgactgtagccaagtgctgggacccaagtccacgtggttgcttcacattgcccaggagtaagtggatgggagactcagtcctaaagctggtgcttacatacatgagcactgtctctcctttcttctctcacccagaacccccatatctatcctgttgggcccagcagtgggtggggtgggtagcccatgactcctcatcctccctgcaggcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgtgagtgtcccaccctgtctcctgggcccagcagacagggccaggtggggggactgatgagggtccatgtggagactcttgcttgagcatcagagagggctggagatggggctcggctcattccagcaaccccacactgcaactcccccacagcgggcactccaaccctcactaaacagtgtttgcttctgaacttgtatgagcacccagggcgcctcagtttcctcttacaaaatgggactcacgatataaactttaccaggttcctgtgggtttaatgagaggatataagtgaagcaccattgcgatgtgtggtgtaaagtaagcattcagtaaacggcagccatttcgattatcatcacatgcacatcgtacactggccaagcacctgcatttacattatttaatcctttattcaaatagccttgtaaagtagatattaaaatccccattttttacagaaggggaaactgagtgtccaagaaatcagtaattttcccagcattgatcccataattactagatggtagagctagaatgcaaactcttgtttacctaactccaaagcccctttctgcctcaccattctgcctcccacccccaggcctagacgacttccacttgtccatccacagtgacatggctgccatcgtaaaagccatggcctcccctgaatcagggttggaggtccgtgaccgcatgtggctcaagattaccatccctaatgctttcatcggtgagagagccccatggtgggatgcagggtgggtggggagtgatggggcagggcaggccggagggcccaggacttgccttggacccttcctttgatctggagccagccccagcctcatagcttctgtgaggccagatgagtccaagtcagatgggcctccccatcaactggcagccttgtccccaggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcagtatgtgcctccctcatcttcttgccctgtctcctggctgggagtggggaggtagccagggaagtggcagcagactctggggaacccaaactgggggacagcagagccaggggcccaattcaaggcctgagagttctatggtggaagaagagtccagtttagcctcttcacctggcccacatctccctcttgggcctggcattttctaagtgcctgctctgcctggtaccatgttggttgttcctaaagcatcatcttactcaatattcacaacctcccagaggcccagctcaggaggatactgccagaataggccttttccttctcactcgtcaaggtctcagctagggtgttgtaggcttaaagggaagaactggaggcctaggtagccccgaggagcacacagtcattccctcaaaacaaacagcctggaggctcacgtcatcaccagctctgggcaacagctgacagaccactgctttcctccaccaccactccccatgctggctgctggcctcttgacaggttgatggcttggctgcaggctccacaggcagcctcagagccctgtctcctgacttctctcttggaaggctggggctggctcttcttagggctgggaggaatgtctcatcttaatagggccggtggcctcaagggcagttgtagctctcttggagctctgggacctggtaccgatagtgtgtgagcagagggtgtcccaggcaggtattcagtcctggtggccccttatattctcttcaatgtagttccaacattggtgggagtagccttgccattaaggaatgtataatttccccgggggcgccaggatcgtgagatgagtaatgttggtggagtgagacagtgctatgaagagctaggcctggctgggaacggggtggagagcagtgggggaggcacctaagttgttctttccttctggccccttcccaccctactcaccctgcccagcagcactgggaaagtataatcagggccaagtaccttctatatagggaatctctggaaggccctgcactcattctaggcttttagtgggtatttagttctaggtgaaggggtgggtaacactttacctaaatttcccaaactgctccttgtcctaattaatgacctcatctgagaaggtaaggagaaagtaagctactcttcgcgtctgttctgattagtttaggctgagctgaaggtagtgttcgctattgtgcctcatgaacttcaggtgcgacatacctggtggctgtctagtatttcagccttccaaattctccagtcttgcaccagctgagtgaacggaagagaaaatggccacataagagttttgcaggccgggcgcagtggctcgcgcctgtaatcccagccttttgggaggctgaggcgggcagaccacctgaggttaggagttggagaccagcctggctaacgtggcaaaaccctgtatctactaaacatacaaaaaaaaaaattagccaggtgtggtggtgcaaccctgtcaggaggctgaggcaggagaatcgcttaaaccagggaggaagaggttgcagggagctgaaactgtaccactgcactccagccttggccacagagcaagactccgtctcaaagagttttgccgcttctagcccactgaggccagcagagaaagtgcaaaagcttggccagggccttcaagggattgggaggtacagctttggctgagaacctagaatgatgactcagggttgtcctgagaagggtctccccggggctggctctggtggtggcaaagggggtctgcagaaggggggagctctctgggctgtgcctcctctcattctagccagaaactaccacggtctctctcatccagagcccacctgacctaggctagggacctctctccggaaagacctagctccatccggccctccccttcacagacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggtaaggtagaggggccgtggaggaaggctataggtgggccccaggcttcccccgcccgctcagcctgccccaccccggccctgtttgcctcctacaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaatttaccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattatt

SEQ ID NO: 623 - DNA, 73736 bp, Homo sapiens
acatccgtatcccacttcaaggagacgtcttcgctgcatcctccggttccgggtggaggctgaccctgggccattccgtctccggtctctggtatttctgctgggtcacttcatcccgggggcctctgaggaggcggaactactgtgtcaggagtcgtggttttcaaggagaagtcgtggtcggattgacagaggtaggggaagtaggcggaacttccggctggctcttccatcagctgccttccccgggcgtctccccgcaacctcctcaacttccctagtcagtgacgcggcgccggccagaaatccgaccggaccgggctcgggggagcgtgagttgcaggtgtgtgcctatctttgcgtctctgtttgagaggacaaactgtggggctgggaccgcgaggtgactgtgactgaggaagagtggtaagtgacagcgagggcagtgggagccaggggctgggaggctactgtgaccgagggccagtgacagcgaggggactgtgacccaggagcagtgaatgcgaaacacggtgacctcggagagcgcgaggccggggctgcgacggcacttggaccgaggaagtatgaggcagtgactgcaagggactatgatcaaggggcaaggactccaaggagactctgatcgattggtagtgactgtgggggatccggacctaagggaacacgagcagcggccgcgaggggactccgacccagagcagtgacttcgaggggctgacttggagaagaggatggcatccgtgatgggcgatggcgctgtagggttgtgtttgggcacggggtgtgattggccgtgactgggcagagaaggtctttagtggaaagaacactggtctggaacttaacaggcctgagtttaatttttacggacaaacttcaccactgagttacagtttcttcatcagtgaatgggaagtttggactagtttaatgcctcccacactatgggtttcttcctagtattgagctgtgaaaccaatttagtggatggaacctgtactttttttctttttctttttttgagacagtttcgctcttgttgcccaggctggagcgcagtggcgcgatctcagctcaccgcaacctccgcctccctggttcaagcgattctcttgtctcagcctccctagtagctgggattacaggcatgcgccaccacgcccggctaatttttgtatttttagtagagatggggattctccatgttggccaggctggtcttgaactgctgacctcaggtgatccacccgcctaggcctcccaaaatgctgggattacagtgtgagccaccgcgcctggcctgaacctgtacttttcttttaaaaagtggaatagaatagaaactttcagtgtgtttacatagtaagggtaagtattgtttcatgtgatttgtttgagttatgtgtgtatgagattatgatgtaaaatagattttgtacatctcaaagtgtaagaagcaaaatgtactttaaaagtttgaaaaacattggaccggatgatttctgagttttcttttggttctaaaatgtaatgattctatgaatagggaactctttggaagtacaaagatgcaattgggaacaggctgtattagcctggcctaactggaggaggcttcctgaatgtaattgaggtgactagctgtgagagctgaaactcggcatctcagttgggagaaccagaaattatattgaaatagggacactgggcgggtgtggtggcgcatgcctggaatcccagctactggggaggctgaggtgggaggattgcttgaacccaggaggcggtggttgcagtgagttgagattgtgagactgcactccagcccgggtgacagagggagactctgtctcaaaaaaaaaaaaaaaaaaagggacagtggtatttgtgatatttatagaggcagtgaggatttaggggtttgtggtatgagaaactgctcatgaggaacgggaagctttgagcgtaggaacaagggttgggaaggaaactcaagataggggcagaaaataatctgccaacaataaaatggaagtaggaaggcagatatgacctccagagcctatttatcttgatatttagtgatttggcaagtacagagaattgctagtaaaaagacattgagaatgggatttagtgcagtaatagcagtaaactatgaccatgatgagaaagaaagggggacaaaatgatgacactcgcagtgtcaataatggtgattgggatgccacatgggagagacttcaatgtacttagctctctaattcaatgatttgtacactgaggccaagcctggcatgctaggaatgataccacactatgggtaatgtaaatgaagctttagctgctgactttatttcctacacattccctttctttagggctgtgagtgatgtagatgaaattaaagtgaatgttactacttccttctctcttacagccctttttattttatttatttatttatttatttttgagacagagtctcactctgttgcccaggctggagtgtgctggcacgatcccagctcgctgcaacctccgcctcctggttcaaagcgattctcctacctcagcctcctgaatagctgggactacaggcatgtgccaccatgcctggctaatttttgtatttttagtagagacagggtttcaccacgttggccaggctggtctcaaacttccgagcttaggtgatctactaacctcagcctcccaaagtgctgggattacaggtgtgaccaccacgcctggccttacagctctttttagaaggtgctattgattgtgccaccagtgctttttataataggagaagtatgaggtcatttaatttatcgtacagtgtattaatctgataaccactcctgccccctacactctgtaataggggaatagagttcagataggttcttgaatgggaatgagttgagaatggtgggggatagccttttcttggctaaataaattggttagttacacctttttctagcacattagatgtttacttgacttacattctacatagctaaaaggaactacccaggggtttcttctagaacagcatctatgcttcaaggtaacagactgtggaagaggcttgggattcagcagtactccctctagggtcttttttctttgctgaatgaaatgaatctttttgtaggacaaaagatttgctttgcaaattccctttgaaaactagcatgatggcctggttgataaagaatgagcttcattccccctcagtctatgactctcctcccataagcagtggggttttattttccctggggacctgctttttggatatgtgatcccttaagaagaatgacctcgtcagatagagcctggacttagcagtccctggtgactttctccgatgttaacatttactcgccctgtgactatgtatggaaagcattattgctttctcttgttgtagattttctaaccatggccagaggtaactcttcttatgattaaacagccctttaataatctgaaatatatgtgaacttaccaaattttgtatgtaatttcatagagtttgtaaaccatctgactccatttataattcagagctgtctggcctttaagttagacagtatttccctagggagctgaataacctctcctagagatgttataagtgctgatgagaattagtttttgaaatgctcaaataaaaagcataattttccattgttattaatgatggataatagcaaaatatctgctaataatagtagagttcttacttaagcatcatgcttttctaagtatttacataactgatctgaagcagaccttctgatttttctactaatagaaatttccctttctgaatcaagcagaaataggtctcccttacatcaaagtttgtgttaccttgaaatagattggaaagaatacatttttgtaaaagtcatttttttcttggatttgtttccagttggagaaaccctaaagtcagggcacttgccaattatcacaggactgtgagagtcccttttttgctcaagattgtggctggctgcttgtacatctttgacattatcacacatcaagcatattagaaaaaggggtgacttgggagagtgaggggatcagcactttaggccttgtcaaccctcctgcttatctgcttggcagcttctggcatctccttttccctaagtccttgaacctctttcctaagcgtaaacctttctgtttttagtcctaaacctctcttttcacagtattcctgtcaaatgagtacttaaacacatgtttcatctgtgatttgttttgttaattgctttgtggattatttgtggcagaatttaaatcctaattcctttctacaatttagccagtaaattcaaggaatgtacctttttacgtttgcagcatgtgccgaagcgccacctcagaagataaaaagaaatgagtctcatatttggcattcttttaggtttgttacctaccttattcattaatgtaaataattgaattacctgtattttaccattcgtaaaccaggttaatagatatatattaatagcaggctttctgtgtgtgtcttttccctcctttctttctatttatttatttatttattttttgagaccaagtcttgccttgttgcccaggctagaatgcagtggtgcaatcttagctcactgcaaactctgcctcctgggttcaagcgatctcctgcctcagctgggattacaggtgcccgccaccacgcccagctaatttttgtattttagtagagacggggtttcatcatgtgggccaggctggtcttaaactccagacctcaagtgatccatccgcctcggcctcccaaagtgttgggattacaggcgtgagccactgtgccttgccccttgctttcttttgggaattctcttgtaccacaagttgaaagttatattagtttgaggctttctatgtttggactaggatgactgccagtgagccaggggaacccatgaatctgctaggctgttatatcacattcacaactacttgcaaaccagttttgaagtgaaggctgccaaaaataatgacatatggtccctgctctatagaaaatgagcatatgacccttaataaaaaacaggtagtttttttatatacagaaaattaccctaaatgtgattatgtttctttattttttgaccgtagaacaggaatcttaatcttttttgtgttatggactcctttggcagtgtggtgaaagcttttagagttcctttttggaatatgtttttatatgcaaaaataaaatacatagaactataaagaaaaccagttatattgaattatattgatatatagttatcaaaatttaagaagtatgatatggtatgaaaatatccatgatttctactggtaacaaatccatttgtctaataagtctgctattactgctgtagcttatgttcatcactgaagtgaaaataaagatacagtctttttcatccaaattcacagacttcctgaattctatcatagaccctgcctcagagatatgagttccataacccactctaggaagatcacattctaaacacaagagtttactcaccaaatattctggtagaatagtggcagagtaaaattgttcaactgtaagaactattacatgtgtccctcatggttttttctttcctgaaatattctactacatgtccaggccgaagaagtataagctttattatgtgtgccagtggctaacccagggtctggcacagagtaagtgccgctcagtgtttgttgaataagggtttctctgacgaaattagagggaagagatccagttcaaagctaaggtcttaaatgtgacagtttatagggctcatgacaagtaacgttgaactttagtttagaactaatctgtcagagaagctcatgttttgaaattcacttttacatttataagttctcagcctggtgtgatagttcatacctataatcccagcactttgggaggctgaggtgggaggattgcttgaggccaggagtttgagaccaacctgggcagcaaagtgagacccccatctctacaaaaaattagctgggtgtagtggcatgtgcctgtagtcctagctacttgggagggtgaggcaggaggatcacttaagcccagcagttcgaggctgcagtgagccatgattgcaccactgtactcgaaataattctatttctaacactgtttttcactttagattgggtaaatttaggtagaatttgccaccaaattattaataaagctggtcctgatttcatctaggatgagaggtagcaaactttttcagtaacgggccagattgtaaatagtttagggtttgcaggtcacacagtatctgtgactactcagctctgctgttgtagcacaaaagcagccatggacaataaacacatcagtgagtgaacatggctgtgttctgatcgaattttaattacaaaaacaggtagtgggccatctttggccagctagctgtagtttgctgacccctgatctagattttctggttcttgagtccagctcttttccctactttcgcttagccatatactccttcaagcttcaaaggcctttacatagggggcaatgtccttacactgttatctccagaaagacctgagtgtacagcaagatgataggattaatgaatgccaggaatattagatgcactttaacccttgagtttccagagcttgcctcttagagcaccagctcattaagcaccaccacggtagaagcagagaaacatcccaaatgtaaagtctgcttgcgcactcggctttggaactgggcattgatatgctgatagaaaaatactgggcattgggttttagtggggaagataatgtaggcctagagatggggaaggcaggaatagagtgcaaaggaaaaattatgcctcatctttttgcaaatagttccttgtagtaattggtcaagtttgagttagatttttgaaatgtggaatagcatatgtaattgcaacttgctactacaagagctcacccttagtcgcagttttactttccgtggtttcagttacccacagtcagccacggtcagaaaataggtgagtatgatgtagtaagatattttgagagtgagagagaacagccacattcagataacatttattacagtatattgttataattgttttattattagttattcctgttaatctcttactgtgcttaatttataaataaaactttatcatagctctgtgtatatagggagaaaacaaagtagagtcagcccttcgtggccatgggctccacatccgcagattcagccaaacttggatcgaaaatattcagaaaaaaaaaaaaaaaaaaacaataaaaataccaatacaacaataaaaaacagtacaaataaaaaaccaatattgtataataactggttacatagtatttacattgtattaggtgttgtaagtaatgtagagaagattgaaagtatatagggggtatagattatatgcaaattcgacaccgttttatatatataagggacttttgagcatctgtggattttggcatctgcaggagatcctggaaccagtgccctgcagattctgagggacaactgtccatatagggtccatactctctaggggttcaggcatctgctggcgtcttgaaacatttcccctgtggataagagaggactctgctatatttagattgttacatagttcaggaagcaaagtccaactcctctttcccttggtaggtctgtttgcaataaggaagttgaatagaaaggattggataggccgggtgcggtggctcacgcctgtaatcccagcactttgggagactgaggcgggcagatcacctgaggtcaggagttcaagaccagcctcaacatggagaaaccccatctctactaaaaatacaaaattagccaggcgtggtggtgcatgcctgtaatcccagctactcgggaggctgaggcaggagaattgcttgaacccgggaggtggaggttgtggtgagctgagatcgtgccattgtactccagcctgggcaacaggagtgaaactctgtctcaaaaaaaaaaaaaaaaaaaaaaaaagaaaggactggataggagtccctaaaactacttgtaggagcctatcatctttcagactcaagcatagacatgccagcacctagattctgtctccttcaggacattcacattggaaaaatatgactagctgtatccttagtgtctcctcagtgccacccctccctccacaaacacatcttccacttgtctagcaaagctgatgtgcctcagcaggcatgtgttggaacgtggaggaacaaggcaagcagtgtgtactggtaggtgagtcagcagaaaccaaaccaggtctttgtgagtcggagtaaaaatcacaggcacagatactgcattctgtatttcgagggcactttggagacactaatgtacttagcaggcagggtgttgggggatgggtttttatgtccatatttagagtctgtgctcaaatttcagtgattaagataaggtgacttatctagggagtgaataggcagcagttggaaagatcaggtcttaacaattgctgtattctggctgtcagccctttttttttttttttttgatagagtttcactcttgtcacccaggttggagtgcagtggtatgatcatggctcactgcagcctccgtctcttgggttcaaatgattctcctgcctcagtctcctgggtagctgggattacaggcacctgccaccacgcccagcttatttttgtagttttagtagagaccgggcttcaccatgttggccaggctggtctcgaactcctgacctcaggtgatcctcccgccttggcctctcaaagtgttgggattacaagtgtgagccaccacacctggcctagctttttttttttttttttttttgagatgaggtcttgctctgtcacccaggcgggagtacagtggaacgatcttggctcactgcaacctctgcatcctgggttcaagcgattctgccaccacagactcccaagtagctgggactacaagcatgtgccaccactcctggctaattatttgtctttttagtagagatggggtttcgccatgttggccaggctggtcttgaactcctgggctcaagcaatccatccgccttggtctcccaaagtgctgggattataggcatgagccactgtactgggctgttatagcctttttgacaaagaaagtgttctggaggatgaaccactaaacaaacaggaagtgttggcccatcctagtagggctcttgagggaggttctctattctatctccaaatacttttcttcctgtctcattcctaagggtcagtctgcagggcattgagtaatgcactgccccatgttcgcctcctactgtattggctctgaggaggcgcgatcatttcccagtcccattgcccgctggacaaacagggatattaaggcagcctgtgtgtgtgcgtgtattttttttcccctttgaatgtagatatttaaagccacctccttttccagagccatcactgtaccttacttgaatggtattggttgatgacagaggcgcacttatcataaactgagagtccaagaaatattgttcctcattgttggaggtattccaaatggttactgggcagttatcgatgttgtaatggtggtgtggctttaggtacacctaagtttcagtgtaacaaattaagaagccaacacgatgttaggatgtatttactgtcttcagtacgccctcatcctcccacacaccttttctctacactttctcagtagcaaaggtgatgtgtccgggcaagcatctattggaacatgagggagactgggggtacctttttccatgattttaaacatcagttattattctgtatgctttggtgctgcggttataagttagtagatgtgagagaacattgggatggcataagaaggccgggaaaaaatgaaaaaaacttgtgagacctacagagtaaaagtttattattgttattattattttgagacaaagtctcgctctgtcgcccaggctggagcgcagtggcgtgcgatttaggctcactgcaacctccacctccagggatcaagtgatcctcctgccttagcctcccaagtagctgggattacaggtgcatgccaccacgctcagctaatttttgtatttttagtagagatggggtttcaccatgttggccaggctggttgcgaactcctgacctcatgtgatccacccaccttggtctcccaaagtgctgggattacaggcatgagccaccgcgcccagcccagagtaaaagtttaaacagcagtagttctagaggaaagtcatgaggagtaatctttgcataatttctaaattcttttagggttatcattatggaatatctgtgacccagatgttttccatctcctgagaagtggatgagataaagaagtgtcttacactaaaacccaaaaagcagtgggtgtgttttattttaaatccgaaggatctaaagacttcagtttaaagaacagtgtagaatataatgtaaaacccaaaagtcatctttagaaaatagaagaactgtatgtaagcagataaggaatagtataaacacataatagtgtaagcaggtaaagaaaaaaatatatatatttttttgaaatggagtctcactcttgtcacccaggctggagtgcaatggcatgatcttggctcactgcaacctctgcctcctgggtttaagcaattctcctgcctcagcctcccaagtagctgggattacaggtgcccgccaccacacctggctaatttttatatttttagtagaaacggggtttcaccatgttggccaggctggtcttgaactccagacctcaggtgattcgcctgccttggcctctcaaagtgccaggattacaggcatgaaccactgcatgtggccttttttttttttgagaaagggtctcactttgctgtccaggctggagtgtagtggcatgatcatggctcagtgcagccttgacttgctgttctcaagtagtcctcccacctcggcctcccgagtagctgggactacaggcatgtgccactacacctggtcaatttttcgtaactgcaaatatcctattcctcagcaaactttcaccccatggttttagaatcctgtagagcatttttatatcataagcatttttgaggtggagctctgtgtgtgttttccatgccttaattgaagcttccttgagaaaatagtttgtacttaatttttttttttttttcattttttgagacggagtctcactctgttgcccaggctggagtgcagtggtgcgatctcggctgactgcaacctttgcctcccagattcaagtgatcctcccgcctcagtctcctgagtagctgggattacaggaatgcaccaccaagtctggctaatttttgtatttttgtagagatggagtttcaccatgttgcacaggctggtctcaaactcctgacctgaggtgagctgcccacctcagcctcccaaagtgctgggattgcaggcgtgagccattgtgcctggcctttaattttttaaattgataaataatagttgtttatatttatgggatacaatgtgatacttcgatatatgtttacatgtggaatgattaaatcaagctaattaacaaattccttgccttatatacttatttttttgtggtgaaaacatttaaaatctactcttttagcaattttgaaatataaaatgcattattatttattttgttttggttttttttttttttggagacggagtctcactctggcgcccagactggagtgcagtggcacgatctcggctcactgcaagctctgcctcccgggttcacaccattctcctgcctcagcctccccagcagctgggactacaggtgcccgccaccacgcctggctaattttttgtatttttagtagagacagggtttcactgtgttagccaggatgttctcaatctcctgaccttgtgatccgcctgccttggcgtcccaaagtgctgggattacaggtgtgagccaccgtgcctggctgcattattatttattatagtcaccattctgtgcaatagatcactaaagcttatttctccattctttttttttttcttttttgttgagacagagtcttactctgttgccaggctggagtgcagtggtgcgatctcagctcactgcaacctctgtctcctgggttcaagggattcttctgcctcagcctcccgagtagctgggattacagatatgcgccaccacacccagctattttttgtacttttagtagagatggggtttcaccatgttggccaggatggtctcgatctcttgacctcgtgatccacccgcctcagcctcccaaaggctgagattacaggcgtgagccactgtgcccagcctgtttctcctttcaaaactgaatttttgtactcgacatctccctttttgctctccaccctcttctgtccatctcttgtaaccaccattccattctgtacttctgtgagttccactcttttagattccacaaataagtgaggtcatttgtggtatttgtctttctcgtctggcttatttcacttagcataatgtcctccaggttcagtttgtacttaaaaattatgatacagtactttgtaagcagtaagtactcatatttttgactgcctgatattattgacttgccagatgccaaattgctgattatatttctcatagtggattttgtctctctacacttagaagaattgagcagatacttacagaagagtactgtgcaaattagaaaacaatcattaattggatggattaggcattttgagtagttcactcagaccactgagatgagagtattgacctctgaatattatgaaggaatcattaagaacaatagtgaagacaagctctgatcatcatcactgaaagaactcggagtgaaatgtatagaacccttcttccattttaatttgcatttgtgatgaaaggaagtttctaggtggtgctcatctttcactttcgactctgacattttttcatgttggccatgactcatggggtgtcaccttcagcttctaagaattaggccagtttcttgtagatcttgtcatattgccactcggagttgagccggaggaaagaaagtaaggcacagttgcagttgtttagacgaacatctcagtcaggcttatgagaggcagtagggcagagcagactgtcctcattctgtctggcattggttttccacctgttctgaagatttttctctgaaccgtatcttgtgcagagatgacagtttatcatagagtttcccctacccccaatttctggctgattcctaaaatttcatcagtatcaagaaagtaatttatttgtacaaattgtgttacttaagaaaaacgcaactatccctgcagggggctgaaaagccaacatctaaatgatggcagcggtggcctgtctggatgggctgctgccatgatgccggctgcagtcggggaggcatggtctgtgctgcacgctccatggagccactgggagctgggagtaggtggaagccctgcccgtttccaagttggcagggcgggagcagccgtggctacatacccgggcttccctgtgcttttgggggcccaggaacctcccctgcccctgcaggcttgaagtgcctgctcccactgcctggcctctccttgctcctggtgcctgctctgattttggagcaaagttgaggccaagcctgggcactgtcatgacctggctgggtttgcgtgtgctaggggcagtgctgacatgccagcccccttctgccttggccccctctggattttgggtgtccagcagcacaggaggggacgccaaggcggagctgagagcagctccattcaggcctgcaggcgccccttcgtgaatagcctgggcgctgtggacagcaggttgatgacagcaggaggcagacaggctcctaggcggaaatgggcgggtccctggtgaagccccaccttcaagccagggatggcctgaagcctggggcccaggctgccagttctgtggactggaatgagaacttacgatgctttttccgggctgcctgtggctgcccatggaccaatcagcatgcacttcctgcccgctgaagcccgtagaaaccctggactcagccatacttgatgggatgacctgcctgcggataggagcttcccactccaggtctcctctccactgagggctgcagagacgtcaggatgacctgcctgcagataggagctatccactctgggtctcctctccgctgagggctgcacagatgctgggacgacctgctgcggaaaggagctacccgcttggggtctcctgagggctgttgtgttgctcaataaagcacctcttcaccttgctcgtcctccagttgtccatatacctcattcttcctggacgtgggacaagaactcgggatctgccaaatggtgggactgaaagagctgaaacacaaacagagccgaaacacgtcctcccctcccccactgcttgccacgctgtgggcaacagaaagagagaagagaggagagagaaagagaagagctgtagccctttgggaagcccagacctaggagctccttgagccagggctgtgacaccctctttggagctctgtggttcctggcctctccaagcttctgggcagcaccatgttccccagtgcctgcagtggaagctgcttgtagtacgcctggttcagctgcagcctctcagggagctggcgcctcgagctgctcaccccctggcagctggcgtgcctggctgtgcgcagtggccggaccctgtgctggctcgcctgtgcacctcttgccgctccgtgcctggcttgtccttggcatgcatggaatctgtgctggtaacacaagctgagcatagcctaccaggctgagtggacggaacgagcccggcgggcctgagcaaaactcaggcaaaggtgccactggccacagaggtttctggctagcgaagtgacaccccaagtattctgtgacttaaacatgaaatacagaatattcagaactttgctgtaatagctagttgctagaaactctctgctaaatgagacaataataaataagttcctttgggggaaggagaatccctgagggggttttaatagctggaaactgtgaacaagcttgaggtgttaagaccctgaaagaggaaagggaaatgagtactgagaaaagaaggggaagggccaggtgcagtggttcacacctgtaattccagcactttgggaggtcgaggtgggtggatcacctgaggtcaggagttcaagaccagcctggccaacatgacaaaaccctgtctctactaaaaatacaaaaattggctaggcgccatggctcacgcctgtaatttcagcacttttggaggacgaggcaggtggatcacgaggtcaggtgttcgagaccagcctggccaacatagggaaaccctgtctctactaaaaatacaaaaaattagccaggcgtggtggtgggtgcctgtaatcccacctactcaggaggctgaggcaggagaatcgcttgaacctgggaggcggaggttgtagtgagccgagatggtgccactgcactctagccagggtgacggagtgagactctttctcaaaaaaaaaaaaaaggaaagaaggagaaggacatttaaaaaatacattatgctggtcctagctattctggaggctcagatgggaggattgcttaagctcaggagtttgaggctacagtgtgctatgattatggctgtgagagccgagatcgtgccactgcactctagccagggtgacagagtgagactctttctcaaaaaaaaaaaaaaggaaagaaggagaaggacatttaaaaaatacattatgctggtcctagctattctggaggctcagatgggaggattgcttaagctcaggagtttgaggctacagtgtgctatgattatggctgtgagagccgagatcgtgccactgcactctagccagggtgacagagtgagactctttctcaaaaaaaaaaaaaaggaaagaaggagaaggacatttaaaaaatacattatgctggtcctagctattctggaggctcagatgggaggattgcttaagctcaggagtttgaggctacagtgtgctatgattatggctgtgagagccgagatcgtgccactgcactctagccagggtgacacagtgagactctttctcaaaaaaaaaaaaaggaaagaaggagaaggacatttaaaaaatacattatgctggtcctagctattctggaggctcagatgggaggattgcttaagctcaggagtttgaggctacagtgtgctatgattatggctgtgagtagccactgcgctccagcctggacaacctagcaagacccctaaaaaaataaaaacaataaaaaagtaaataaaaaccattatgctactccacaattttcatgcaagtaactctggtgaagtggtcactgaaatctatagaacttttagagttaagaaattcactcagtgatgtggttcatgcctgtcatcccaagtctttgggagtttgagttgggaggatcacttgaggccaggaattcaagaccagcctgggcaacatagcgaggcctgtctcttaaaaaaaaaaataactaggtgtggtggcatgtgcctgtagtcccaactacttgggaggctggggcaagaggatcgcttgagctaacgaggttgaagctgcagtgaggcaagatcataccactgcaccccagcctgggcaacagagtgagaccccgtcttaaaaaaaattagagttaagaaatccgtgttttgttaatccaggacttggtgagagccatccgtttacaaaaggctcttttctctacctgcaccagtcataccttcacattgccttatacctgtcatatcgatgatgcggaggatagtgggagagtctgtgtaactatctttctcagccaaattattccaatcttttgcatgcaatcaggatttaaaatgagcagttagtatgtaggctgcactgtgagggggaatgacttccgacttcaggcaattcactgtggccattgttgcacagagaggcgtttcagtatttctactagagcctgtgttttgtgaagcttcgctggttttgccagatgccattggctcatcttggtgaagtgcagctgtagaattggtattttgctgagtgtatccacgtcaacgtctctgaaatactggtgacaaactttttcccaccccaatgagaaaatttttgttttcactttctatgaccagttaaaagaagatggatgcacagtgttcagccaaggtcaatgcaaggaagaggagaaaagaggcgcccggacccaacggggcaacagaagaagatggggttccttccaaagtgcagcgctgtgcagtggtaagtggagattaacctggcagggggagggtagaaaccgatatgacattgatgatatcagtgttacatgtcttctgaaataatgaaaagaaggaatagtaagtgtattttcacagtcactggaaatctgctgcctttttactggattatgactcacagctcagttgtagaagctttacattgggtttagaaaaagaagtgttaggaaaatatggaagttgcatgtgtattaggctgaaactattgaaatatggccaggtgcggtgactcatacctgtaatcccacactttgggaggctgaggtgggaggatcacctgaggtcaggagtttgagaccagcctggtgaaaccctgtctttactaaaaatacaaaattagccgggcgtggtggcgcatgcctgtaatctcagctgcttgggaggctgaggcatgagaattgcttgaactcgggaggcggaggatgcggtgagccgagattgcaccattgcattccagcctgggcaacagagacagaccctatctcaaaaataaaaataaaaagtaaataaacaaataaataaaactaatgaaatagaaaaattggggctctaggcagtgatttgatcttcgtatcatctcatggtgtctagtgcgtcttttctgctgttttttctccctctatcattcctccatcctgttactagttgtatcttagatgagaacctttttccgtttatgcctaccttatgctcctttatctctggaaaattatctttgtatttcctaattattgccaaaccttagatgaaagaccccattccacactgcctatcccatctcagcttgctacccttcctaaagctttcctccacactgcctatcctgtctcagcttgctacccttcctaaaactttccataataaaaacatgtcagagaacacttacacacaattgaagctactgttgttaatattattatgaaatctgtgtttcaaaatcccagtgacagaattgtatgtttctttacctatattgactattagccattgatcaaactcagtttccactgcttagttctagagcttcccagcccaaagggaaaaatctattctgaaacagttaatacttattccaaatgaatgctctgtcttgagcaataaaagcaaataataccctacaaatagacaagtgcctgcagggctgatattgatcataagggcaagtatatatatttgtttcctgttgcatttgtaacaaattaccataatacaaatatacaaatgaattatcttacagttctggatatcagaaatctgaaatgggtctcagagggctaaaatcagggtgttggcagagctggagggtccaggggaaagtccatcttcttgccttttccagcttctagagggttcccacattgcttagtgcttggcaccagccagtgctcacatcactctgacgattgcttctgccatgtctcctgctctgattctgaacctcctacttccccttttcacttacaaggactcttgtgattacgttcggtatacccagataaaccagaataatcttcctttatttaatcatatctgcaaagcctctttactatttttatttttatttatttttatttgtatttttgagacagagtctcgctttgtcacccaggctggagtgcagtggtgcggtcccggttcactgcaacgtctgcctcttgggttcaagtgatttccctgcctcagcctcccaagtggctgggattgcaggtgcccaccaccatgcctggcttactatttttatttttatttttatttttagagtaagggtcttgctatgttgcccaggctggtcttgaactcctgagctcaagtagtcttcctatctcggcctcccagagtgctaggattaccaggcgtgagccactgtgcctggcctgcagagtctcttttgccatgtatggtaaaacagtcacaggctccagggaatgggtgtggccatctgcaggggggcattattctgcatactacagcaaataagctcagaaagtgactcagcaatcaacaaaacagggcattgttagtttctgaatatttcttagataattcagattaaagaaatggtggtgtgtaccaattcagcaacatcacttggagtaggaacaagttataaccaaataggtgatactgtcagctaatcagccaatcactgtagctaggaataaagcaaaggaagccagtcttttcagtggaatgagctctgagaaaacttaaatttcttggtctttagactctgggaatcttttttttttttaaattcttctggggagtcttaatgctttaaattactttgcttcatatattcatgtgaaatcagttcagtgacttgctgctacctattccacattcctccctgaaacacacagactatttggcataggtgaatggtcagagatccacccaacagcctggcccaccttagtgaggaggaatgtctgctagtaaactttctgccatctcactgtacacctgtactttctagctctgaatctcctttgaactctataacaaaagcaagcaagacttttttctttttttaacagctttattgagttataattgacatatcatttacagtatacaattcagtggttttcagtttattcacagagttgtgcaaccatcaccatgaccaattttagaatttttttctttttttttttgagacagggtcttggtctgttacccaggctgcagtgcagtggtgtgatcatagttcactgcagcctcaactttctgggctcaaacagtcctctcacctcagcctcccaagtagctgggaatataggtgcacatcaccatgcttggctaatttttaaatttgtttttgtagggatggggtctcactatgttacccagactggtctcagtctcctggatcaagcgattctcctgcctcagcctgccacagtgtgggattacaggtgtgagccaccatgcctggcctgggatatttttatcaccccagaaagaaggcctgtactcattagcagtcactccccatttccccccagtctctccagcctctggaagccactaatctgctttctgattctgtggatttgcctgttctggacattcatacaaatgacatcatacggtatgtggtctttggggctggcttctttcactgagcttgttttgaagattcattcgtactgcaacatgtacaagtacttaattttttttttttttttttttgagactgagtctcgctctgtcgcccaagctggagtgcagtggcgcaatctcggctcactgcaacctccgcctcctgggttcaagtgattctcctgtctcaccctcccgggtagctgggattacaggcgccagccaccacatccggctgattttttttaatttttatttttggtagagacggggtttcaccatgttagccaggatggtctcgatctcctgacctcaggtaatccgcccgcctcggcctcccaaagtactgggattataggcgtgagccaccgtgcccggcaatttttttttttgagacagagtctcactctgttgcccaggctggaatgcagcggtgtgatctcggcctcccaggttcaagtgattctcctgccttagcctcctgagtaactgggactacaggcatgcgccgccaccacgcctggctaatttttgtatttttagtagagatggggttttaccatgttgctcaggctggtttcaaacttctgacctcaagtgatccgcccacctcaacctcccgaagtgctgggattacaggtgtgggccaccacgtccggccagtacttcattttttttttattgacaaataacattccatcatatatcacatactactttttagttattcattctccagttgacatttgggttgagtaagcaagattttcttgcatttttatttatttatttttttgagatggagtcttgctctgtcgcccaggctggagtgcagtggcctgatctcggctcactgcaagctccgcctcctgggttcacgccattttcctgcctcagcctcccgagtggctgggactacaggcgcccgccaccaagcctggctaattttttgtattttttagtagagacggggtttcaccgtgttagccaggatggtctcgatctcttgacctcgtgatccgcccgcctcgacctcccaaagtgctgggattacaggcgtgagctactgcacctggcctttattgcatatttacaatgcgctagtatggcagtaggtggtagacgtgtaaagataaacaagaccttccttttatgagatgtgagcatagagtagaattctatagcctagagctcattagtttatttatttttttttaatgggcacttgcaggccaggcacagtggctcacgcctgtcatcccagcacttcgggaggctgaggtgggcggatcacctgaggtcaggagttcgagaccagtctggccaacatgacgaaacctcgtctctactaaaaatacaaaaattagctgggcgcagtggtgggcgcctgtagtcccagctactcaggaggctgaagcaggagaatggcgtgaacccaggaggcggagtttgcaagtgagctgagatcgcgccactgcactccagcttgggcgacagagcgagactccgtctcaaaaaagaaaaaaaaagggtagggggacttgctctgttgccctgggctcaagctatccgcccacctctgcctccctaagtgctgagatgacaggcgtgagccaccacacccggtggagctcattagctttagaaaaagtactttccttgcatgtaaagaaaggaataggaaggatcaccaagtagtagatacctgggttggtgggtcaggatgaaatggatagaaaagagacaaaggagttaagaaggaaaaactaggaaaaactttatggctattttgtcgataagtataaatcatttattgatacagatgtttctaaaggttcaatcaaaaggatcacaaaagtatttacaaaacataagacgtttagcttatcttaatatatatcaggctgggcgcaagtggctcacgcctgtaatcttagcactttgggaggccgagaagggcagatcacgaggtcaggagtttgagaccagcctggccaacatggcgaaaccccgtttctactaaaaatacaaaaaaaaattagctgggcatggtgatgtgcgcctgtaatcccagctactcaggagactgaggcaggagaatggcttgaacccaggaggcagaggttgcagtgagctgagatcacaccactgcactccagcctgggcaacaaagcgagactctgtctcaaaaaaaataaataaataaataaaataaaaataataataaataaaataaaataacttacaaagaatatcatatgtatgaatgagtcatgaagtatctaaactgtgggggaaattggccatagttctgcttatggcaaagtaggcctcacaatctcatttcaaccaaaatgtttcgagaacctctacttgccagttgcattggagatgcaaggatgaaaagatgaccttgcccttggaaaactcacagacaaaaaagagaaagaaacagcagcaaataattatgatacagtatgaaattatgatacgtatgaaaagtgccaaatagacggaagttacaaagtcaatctcttgagaaaaaaggagtaggaaggataccaggtattagatgcctgggttggtgggtcaggatggccatagttctgcttatggctaagtataggcctcccaatctcatttcaaccaaaataatcttgagaagcaagagactgactttgaccaagaggtaggggcagtggtttgggaaaagcgtcatcaaaagggttatttctgagctgaactttgaaggatacaaggaattcaagaaatgaacaagagatggggtacaagttcagaatcatgaagtagggcttaaactatgacattaggtacagagagtgcgagataaactttgcacatttctagaaggtaaaatcggctgggcatggtggcttcacgcctgtaatcgcagcccttcaggaggccaaggtgggaggatcccttgagcccaggagtttgagagcagcctgggcaatatagggagaccctgtctctattttaaattaaaattgtaatttttaaaaaagatgtaaaatggacagttcttggagattactgagatatgaaggacaaaaggtgttaagagtgactcctaggtttcagtcttaggtacgttgtgtagatggggtacttcccattgagataagaaataccaggaggaaaagcaggtttaggaggaagacaaagagtttaacttagtacaggttcaatttagagggcctataagacatccaaatagtaattggacagatgagctcattgtttacattcactgaaatggcaataggagtcagggagaatgattgcttttctttcatttttaaaaccagatcctggctgggcgcagtggctcatgcccgtaatcccaacactttgggaggccgaggagggtggatcacgaggtcaagtgatcgagaccatcctggccaacatggtgaaaccccgtctctactaaaagtcacaaaaattagccgggcgtggtggtgggtgcctgtagtcccagctactccggaggctgaggcaggagaattgcttgaaccctggaggtggagcttgcagtgagccgagatcgcgccactgtactccagcctggcgacagagcaagactctgtctcaaaacaaaacaaaacaaaaaaacagatccccggggggtggaatctttcagctctgttctttgtcccttctttctcataccacatggtattcctcttgactctgtagcgtttcccgtggcattattgaaagaattgggccaagcacagtggctcatgcctaaaatccaagcgccttgggaggtggaaggatcccttgaggccaggaatttgagaccagcctgggcaatgcattatagagagacactgtccctacaaaaaaaatggaaaaattaactggatatggtgatgtgcccctgtggtcctagctgctcaggaagatgaggcaggaggatctcttgagcttaggaagtcaaggttatagtgaggtatggatcgcactgctgcattccaacctgggcaacagtgagaccctgtctcttaaaaaataaaaaaaatagaaacaattgggatctcgggaggaccctttatcattaatacagaatgtttgggtgaaagggaaataaatgtttttctgtggcattcagaaactttttgctgaaaaatatttaagaatccttagagttggatgcggtggctcacgcctgtaatcccagcactttgggaggccgaggcgggtggatcatgaggtcgggagttcaaaaccagcctggccaacatcgcgaaaccctgtctctactaaaactaaaaaaattaagcaggcgcagtggtgggtgcctgtaatcccagctactcgggaggctgaggcaggagaatcgcttgatcctgggcggcagaggttgcagtgagctgagatcgcgccactgcactctagcctgggcgacagggtgagactgtctcacaaaaaaaagccaaaaaaaaaaaaaaagaatccttagaaagtaaaaagtgtactgggaagacaatatcaagttctagtctatattatttgaattatgtccattttcctgttagtgtggatgccagaatctcttgttttcactgaaattttaaggaatagtgaaataatgtgtgtgaatatagtctggaaaaagttgttatggaagcaatattgcattcagagacaattcataatttggggactgttgatttccattataacttttagatgcatgcatttggaaagtttatatagcattttagaagctaacctcttagattaataggagttaattttgttagcatgctgaaatctgtgttctatagaatacaagaggaaatgagctaacgacaaattcgtcgagtgcctacttttgtgaaacattatgctaattactttgcggatgctactttgtttaatcctcatagtaaacttgtagggcaggtattgttgttttctattttgtagaagatgaaatgaaagctttagaaacttgctgtgatttcacaggtattaaatgatagagttgggatttagatctaaattttccaagtcctaaccccatgttctttcatttatacctcactaccagatagtcttaagacttgaaagcgatactgtggcattcccttgaggttaaaatgaaggagatgtgttttaggagaacacagaaatatttagtcctacttttataaacctcagcttctagagacactgttctttgagaataacacagtgttttaaaaaaatactaccttttctagctggaaacaactctagaaaaaaagattttgctgctttgttatagctgcacaacgttaggtttcactccctatacttaggagaaacggattcagcctaaaccccagccaggaaggacagctgtatttgtcttctacctggaaatatacacagtatgtgagaaagactgaagaaacagttgtgaaagataagatacttaaaatatctctttttttttttttttgagatggagttttgctccactgcccaggctggagtgcagtggcgtgatctcggctcactgcaacctccgcatcccgagttcaagcaattctcctgcctcagcctcccgagtagctgggattgcaggcatgcaccaccccacctggctaagttttgtatttttagtagagatgggattttaccatgctggccaggctggtctcgaactcccgacctaaggtggtctacccgcctcggcctcccaaagtgctggtattacaggcgcccaccactgcgcctggctaatttttgtatttttagtagtgacggggtttcaccgtgttagtcaggatggtctcgaactcctgacctcatgatctgcctgcctcggcctcccagtgctgggattacaggtgtgagccaccacacctggccaatgtatcttttaaaatttgggtaaaattcacataacataaaattcactattttaaccattttaaagtatataagtcagtagtttatagtctagtcatactgttgtacaaccatcacaaccatctaattccagaacatttcatcaccacaaaaagaaaccccctgtattcattagcagtcactccctattacccctccagctacctcctggcaaccactaatctgctttctgtctctacagctttgcctagtctgaacatctaatgtaaatgaaatcatacaacttgtggacttttgtgtccgacttccttttttggcataatgttttcaagatccatccaagtggtagcatgtatcagtactttattcctttttatgggtaaataatattccattgtgtggacataccatttgtttatccattcattgatggacatttgggttgtttctactttttggctattacgagtaatgcaagtgtgaacatttttcatgtataagttttttgtttttgtttttgttttgttttgtttttttgaggcagagtctttctctatctcccagacgagtacggtagcacaatctcagctcactgcaacctccacctcctgggttcaagtgattcttctgcctcagcctcccaagtagctgggattgcaggcatgcaccacgccacctggctaagttttgtatttttagtagagatgggattttaccatgctggccaggctggtctcgaactcccgacctaggtggtctacccgcctcggcctcccaaagtgctgggattacaggcgtgagttaccgtgcctgacatagttgtttttttcttaatatatgttttcagttatcttgggtatatacctagcagtataatttctgggtcatatggtaattctatgtttaacattttgaagaactgttttccaaagctgcacattattttatattcacagtagcaatgtatgatggttctaacttcttcacatccttaccaagactgtttgttattgcctgtctttttgctcatagccatcctggttgatatgaagtagtatttccttgtgtttttgattaatatctaggtccttggttctatttttaaaagtatttcaaagaagaataacacatacacatctaaaaatgaatgtcttggctgggcatggtggctcaagcctgtaattccagcactttaggaggccgaagcgggtggatcacttgaggccaggagttcaagaccagcctggccgacatggtgaaaccctgtctctactaaaaatccaaaaatcagccaggtgtggtggtgcatgcctgcaatcccagctagttgggaggctgaggcatgagaatcgcttgaacctgagaggtggaggttgcagtgagctgagttcacaccactgcactccagcctgggcgacagagcaagactttgcctcaaaaaaaaaaaaaaaaaaaaaaaaaaaaagaatgtttccatttatatcattaagtatatcttaaactaaacttatataagtgatttttttttttttgagacagggtcttgctctgttgcccaggctggagtgcagtggggcaatctcagctcactgtaacccctgcctccctggctcaagcagtcctcccacctcagcttcccaagtaactgggactacaggcatgtgtcaccacgcccagctaatgtttgtatttttttgtagagacagggtttcgtcatgttgcccaggctggtcttgaactcctgggctcaagcaatccaccagcctgggcctcccaaagtgctgggattacaggcatgagctactgcacctggccaaaacaaaacaaaacaaacaaacaaacaaaaaaaacgtgttttaatgttaaaacaattttgaaaatctacacttacctgaaaacaaaacagtatcttcccagtctctggattcagcccaatcatgatacgatctttttagaacggaacatcactgcagccatacagaaattagaaggattataagggagcaatttcatgccaaaaatttgacaatttaaatgtaatagacaatttcctagaaagagacaagttgcaaaaactaaccaagacaaaggagaaaatcttaatagacttatatcaagttaaaaaagaaaaaaaaggaattagtcattaaaaatcttctcacaaagacaggtccaggcccaaagttaaaaaattagctgggtgtggtggtgcatgcctgtagtcccagctattagggaagctgaggtgagagaattgcttgagccccagagttggaggctgcagagagctatgatcgtgccgctgcactctagcctcggtgacagagtgtctttacaaaaaccacaaaaacatttaaggaataaataatacgaatcttacacaaaaataaggtaaagagaacacttcacaacttattttgtgaggccagatatcaaagccagacataaacatcacaagaaacaaactatagttaaaaatcccaggccagaggctgggcacggtggctcacgcctgtaatcccagcactttgggaggccaaggtggaatgattgcttgaggccaggagtttgagaccagcctaggcacgtagtgagaccttgtctctacaagaataaaaaatcagctgggtgtcgggtagtgtatgcctgtagtcccagctactcgggaggctgaggtgggaggatcacttgagtcggggagttggaggttgcagtgagctgaaatggcgccagtgcactccagcctgggcaacagagctggaccctctcaaaaaaaaaaaaaaatccagattggaaaagaataagcaaaactatattcacagatgacatgatattatatgtagaaaatgctaaggaatccatgaaacaacaacggatactagaactgataattaactttagcaaagttataggacataagatcaatatacagaaaatttcagttacacaaacacaaatacaaatcaattgcactgttacataatatcaaggaacaatccaaaaataaaattcagaaaacaattccattcacaacagcatcaagtagaataaaatacataggaataacaaaaactcttttttttttttttttgaggtggagtcttgccctgtgggctaggctggagtgcaatggtctgatcttggctcactgcaacctctgcctcccgggttcaagcgattctcctgcctcagcctcctgagtagctgggattacaggtgcctgccaccacaccaggctaattttctgtatctttagtagagacctggtttcaccatgttagccaggattgtctcaatctcctgacctcatgatccacccacctcggcctcccaaagtgctgggattacaggcgggaataacgaaatctcttaaacgaagccatctataatagagagatcaatctcctttctctcatcttttttttttttagtattacagtgtatgccattgagttgaactttcttttccttcactttccatttcttaagggcttacggcaaccagctcctttttctgatgaaattgaagttgactttagtaagccctatgtcagggtaactatggaagaagccagcagaggaactccttgtaagtaaataccttcttaatttgttgtttgactattgtttttagcattccattgtctttatcaaatacacacctgctctctatatactgccctctgtttacttgcaaaggccagcagcgaaggggttcttctcacctgtcttgatgttctatttagaagggtaactccactccataaactttcattttttttcttattattatgcacctgtttcctgggctgctgttgtagctgtgagatacagtaaaacagaaacaatatgatattatattagcttgagctgagttatgatcttatctatttctataaagtccaaatcatgtgtcagggtgtcacattcttcatagccttcagaattccccaccacctctctacgttctgtcagctggctatgatgctgccgattgatagaggacaaaaatatcccaagttgggagatgctcgtcacttaattttatttttactgatattataattttccaggttttaaaaaatactttattttcaaagcccttgctctttatttgcatgcttaatttacataattaattagcagtttttgacacataaattactaatatatattcgagatgcttttcttatgtggggcaattggttttagagatcattataaaaagaaacttccaagagcatttgttatgaatacaaagtcctataggcaaatattctttcttctctgtaaattccccaattctccctttttttccaatcctttttcacttcttctgattactaagtgttctctctaccctgtaaatataggactgaactaagactcagacagacaccagggaataagagggatttatagccacaaatctgtgcatttgcagcatatacagtatatttgtggttacttcttaattgtgttggtatgtttgctctctgtagtaactgaagaacagtgaaatacaaatagaagtgggccaggagtggtggctcacacctgtaatcccagcactttggacaccaaggcgggcagatcatcacttgatgtcaggagttcgagaccagcctggttaacatggtgaaaccccttctctactaaaaatacaaaagttagctgggcgtggtggtgggcacctgtagtcccagctactcgggaggctaaggcacgagaattatgtgaacctgggaggcagagattgcagtgagctgagatcatgccactgtactccagcctgggtgacagagcgagaccctgtctcaaaacaaacaaacaaaaaacaaatagaagtgatgtacagtgtcatactgggaaatttttttttcttttgaggcagagtctcactctgttgcccaggctggcatgcagtggcacaatcttggctcagtgcaacctcctcctcccgggttcaagcaattcttctgccccagcctcccgagtagctgggattacaggtgtgcaccaccacgcctggctaatttttgtatttttagtagagacggggtttcaccatgttggccaggctggcctcgaactcctgacctcgtgatccacccacctcagcctcccaaagtgctgggattgcaggcgtgagccaccgcgccggccaatgccgggaattttaacacctatcctttggccttatcttgggtatatgtattgtgggtttggggtcctcaacaaaaaagaggctaattccagagaatcctttccttttgaaaaaatgtgtagatatagttcatattgatcacaaccttctgattcatgataagatttttgagtttggcttcccttatttgggtaataggtaggctcctggaggcagggtaaaatgacaaagaaaaccagagactatggattgtgtaatggtagccaggtctaacttcaaaacgccagaagatagttcagggttcacattcagatgtgatagtagaggctattgaaagcaagaactttttacatactctctaatgacacacatttacaatcagctattcatttagatttgatctgatgggttgcattatccagtttgttgctaatttgtctatatatcatttgtggtacataaaatttgaaaatatgtgtactgtttccaagttgatcttttgttttgttttgtttttgagacagagtctcgcttgtcaaccaggctggagtgcggtggtgtgatctcagctcactgcaacatttcccttctgggttcaagcagttctcaaatctcagcctcccaagtagctgggattacaggagtgagccaccgtgccgggcctgtttccaagttttaaagcttataattaacaagtcctgactggtataattgtttttaattttagaattataggattttacaaataagtcattttcaagattatctactttatagtttcttcattaagtacataaagcaattaaggtccatagtaaccaagaagcgaaggcttcccctacagtaaaacggatgattagtggaatagaattgcagctcaaacctcacccgggaatggtgctactcattgtaagcattagaatagaaggccttcagcaaaataattgtatttttggtggaacaaacagccacaaattagcctataaatttgccagcttaatttgaactctggtttttctcttagatctcattttgtctgactgttttatgttaaatcaccaagtaggtaactgcattcatgccagtgcaggacaaggaataaagcaataaagaatgcacctgctctagtgaagtttcaacacctccctcctgctccccaggtttttacgagggaggttgtataatctaggagaagattctctacttagagaaaaacaaatatgatttgagagacaagaaggtcagctctaggaatcttttgggagatgaaaaaaatcagcaatatgtttaactcagagaaaggaaggaaaagggagagtgtgaagggcaatggaaatgttaggaacagaatgtttcggtggtaggtatttgggagagtaaatctatcaaaagagatcattaactgaaacccaggtttcttctgcctaaaggaggacatatggttacttagtcaccagtggtgcagcgtataattcataacccacataaaccatataatttatcatccaaatcaggacggttttgagcatgaaagggagttgctgttaataatatacagaggttgagtgtggtggctcatgcctataatcccagcactttgggaggccaaggcagaaggattgcttgaggctaggaattcaaggccagcctgggcaatacagtgagatcccatctctacaaaaattttaataattagccaggtgtggtggtgtgcatctatagtcccagccactcaggaggctgaggtgagaggattgtttgagcccaggaggtctagaccacggcaagtcatgattgcaccactgcacttcagcctgggtgacagagaccctatcttaaaaaataaataaatacataaataaaaattaaaaaaatatatatataggccaggtacagtgactcacacctgtaatcccagcactttggaaagctgaggtgggtggatcataaggtcaggagatcgagaccatcctggctaacatggtgaaaccccgtctctactaaaaatataaaaaattagccaggcgtggtggcacacacctgtaatcccagctattcaggaggctgagacaggagaatcacttgagcctgggaggcagaggttgcagtgagcctaggtcacgtcactgcactctagcctgggcgacagagtgagactccgtctcaaaaaaaaaaaatctatctatctatctatataacatatatacatatgtaatatatgcataatatataaatgatattaaatatgtattatatagtacattatataatagaaacaggaaaaattatattaaaagtatataatttatataaatatgattatatatactataacatacattaaatcaggggtgtgtttatcctggccaatagccacttggtaaaagaatggctaacgctagctttcttcccagactagttcaacagtgaccccttctggccgtttggttaatatatcagcctgggtttgccaaagacttgggatggaatggtggccagttgagatgttggtaggctggggaagcactggagagagcaagaggcgcatctgggattggtctgagaaaaggttcagtgatctacttggcctaacataggatgattagctgtgctgcaagcagccacttgatcaacagcattctgtgctattgccaccatccaggcaatgtgtttcttgagcaaaatttccctgctgtatgctgtctagtagcaaagaaacaacaaagtagtcttcatttgtatattctatcccttgtgtttcaggatcgaatagtgtgagatcatagcccctctggacttgtttagggaaaatggaactatgttagttacttcatggacgtgacttctgggatacttcaattttttttttttttgagacagagtcttgctctgtctcgcaggctggagtgcagtggcgcgatctcagctcactgcaacctctgcctcctgggttcaagagattctcctgcctcagcctcccgagtagctgggattacaggcgcccaccaccatacccagctaatttttgtatttttagtagacacagggtttcaccatgttggccaggctggcctcaactgctgacctcaggtgatccacctgccttggcctcccaaagtgctgggattacaggcgtgagccactgtgcccggcccaaaaatctttttaatgtattattttttaataggcatagagccaatgcagtgatttctgggacatagaagggggattatatgctcaaattttgttttattttgctttgtcttattaaaaattatctttttaaaaatatttttttcttctttttttttagttgacacatgctggcagtaaaaaataattttaatagagatagggtttcactgtgttgcccaggctggtctcagactcctgggctcaagcagtcctcctaccttggtctcccaaggtgctggaattacaggtgtgagctactgtacccagcctgctttctctcatagatgagaaaactgaggcataaggaagttaaggttacagaggaagaaagctggttggaaagcttggtcaaagcttgagctatgacctttctgactcttaaatccattaattaattcttagtttttcattggattggtatatttaatttaaaatttttatttcctgtattataaaatcaatacaaccagcctgggctgggcatggtggctcacgcccgtaatcccagaacttcgggaggccaaggcgggcagatcacttgaggtcaggaaattgagaccagcctggccaacatgggatacgaatataaaaatacaaaaattatcccggcttggtggctttcgcctgtaatcccagtgacttgggaggctgaggcaggatagtcacttgaacccaggaggcagaggttgcagtgagcctagatcatgtcaccacactccagcctgggcaacagagcaagactccatctcaaataaataaataaataaaaatacaactagcttgggcaacatgtgaaaccccatctgtacaaaaaatacaaaaatcagctgagcgtagtggtgtgcgctgtagccagtggggcgtggcggtgtgcactgtagccagtggggcgtggcggggtgcgctgtagtctgcggggcgtggcggggtgcgctgtagtcagcggggcgtggtggtgtgcgctgtagtcccagcttctcgggaggctgaggcgggaggatcatttgagcctgggaggtggaggtttcagtgatctgagaccatgccactgcactccagccagggtgacagagccagaccctgtctcaaaaaatcaaatcaagtgaaatcaatacattcccacagtttaatatccataaaatacaaaaagggcataaagtaaaatgtctccctctcaagacctgtctcacagccacctggtatccctataacaggccaccaatattacccatttctgtgaatatctaagtaaattgtttatatatcctcccaccttttagtgggtgtattatgctatattcaatcttccgttgaaatgtaggtcgtttcctgactgttgctattataaacagtactgcaatgaataacatctatatttactgtgagataattcccagaattagaaaagctgggccacagctataagcatttgtcgtttgtcttttgatagatacgacctaattgcccttcttgaaagttgctgatactcctttcagcagtgtatgatttcttggtttaaaatctacttatttatgagtaaagctttttgaaaacaaaaattcataaacctcctgagaactactttccttctccttcattcattgccctgaagacaggaaggagatgtatctgatcctcaacctcagcatggtgtatctgatcctcagcctcagcatagtgtatctggtcctcagcctcagcatagtgtatctgatcctcaacctcagcatggtgtatctggtcctcaacctcagcatggtgtatctggtcctcagcctcagcatggtgtatctggtcctcagcctcagcatggtgtatctggtcctcagcctcagcatggtgtatgtgatcctcagcctcagcatggtgtatctggtcctcagcctcagcatggtgtatctgatcctcagcctcagcatggtgtatctggtcctcagcctcagcatggtgtatctggtcctcagcctcagcatggtgtatctggtcctcagcctcagcatggtgtatctggtcctcagcctcagcatagggtatctggtcctcaacctcagcatagtgtatctgatcctcagcatagtgtatctggtcctcagcctcagcatggtgtatctggtcctcagcctcagcatagtgtatctgatcctcaacctcagcatggtgtatctgatcctcagcatagtgtatctggtcctcaacctcagcatagtgtatctgatcctcagcatagtgtatctggtcctcaacctcggcataatatatctgatcctcagcctcagcatagtgtatctgatcctcagcctcagcatagtgtatctgatcctcaacctcagcatggtgtatctgatcctcaacctcaacatagtgtatctgatcctcagcctcagcatagtgtatctggtcctcagcatagtgtatctgatcctcagcctcagcatagtgtatctggtcctcaacctcagcatagtgtatctgatcctcagcctcagcatagtgtatctggtcctcagcatagtgtatctggtcctcagcctcagcatagtgtatctgatcctcagcctcagcatagtgtatctgatcctcagcatagtgtatctgatcctcagcctcagcatagtgtatctggtcctcagcctcagcatagtgtatctgatcctcagcctcagcatagtgtatctgatcctcagcatagtgtatctgatcctcagcctcagcatagtgtatctggtcctcgcctcggcatggtgtatctggtcctcagcctcggcatggtgtacctggtcctcagcctcggcatggtgtacctggtcctctgcctcggcatggtgtacctggtcctcagcctcggcatggtgtacctggtcctcagcctcggcatggtgtacctggtcctcagcctcggcatggtgtacctggtcctcagcctcggcatggtgtatctggtcctcagcctcggcatggtgtatctggtcctcagcctcggcatggtgtatctggtcctcagcctcggcatggtgtacctgatcctcagcatagtgtatgtggtactcaacctcagcatggtgtatctggtcctcagcctcagtatagtgtatctggtcctcagcctcagcatagtgtatctggtcctcagcctcagcatagtgtatctggtcctcagcctcagcatagtgtatctggtcctcagcctcagcatagtgtatctggtcctcagcctcggcatggtgtatctgatcctcaacctcagcatagtgtatctgatgacactttgacctatctttcccaaatgatgtaaatgctcctgtcagtttctgctgcagtaaaatagctcttcctttattcacagaaagggaataagttacatggactccttagatttattatttaaagcatgatggaccattatgctgattctgtttttaatgtttatttcactttggaattagtcttgttccccgggaaatcatttcctggcttctaagttgacagttctctgttatttgttgtgcctgaaaagtttggtacaaccaggctaacagaggcagttagtgcagatgatgatgtcaaaaatctctttataggctgagcatggtggctcacacctggaatcccagcattttgggaggccaaggtgggattgcttgagtccaggagttcgagaccagcctgggcaacatggtctctacaaaaaaaaaaaaaaaaaattagctgggcatggtggtgtccatctgtggtcccatctacttgggaggctgagatgggaggatcacttgagcccaggaggtcaaggctgccgtgagctgtgaccacatcagtgcactccaggctggatgacagagtgagaccctgtctcaaaaaaaaaatgaaaaggtctttatagtcatttttcataacccaacctacccctaaaatcagggtgaatacccagagaacacctaaagaaaggagtatgcagttgggccgggcgcggttgctcacacctgtaatcccagcactttgggaggcttaggcgggtggatcacgaggtcaggagatcgagaccatcctgtctaacactgtgaaaccccatctctactaaaaaataatacaaaaaattagctgggcttggtggtgggcgcctgtagttccagctactcaggaggcggaggcaggagagtcgcttgaatccgggagttgcaggttgtagtgagccgagatcgtgccactgcactccagtctgggtgatggagcgagattccgtctcaagaaaaaaataaaaaaaaagaaaggagtatacagtcatggaactgtcacacagagccagttccatttgccaagtacaagatatcgaatcaatgtatttttgtggcttggcatggtggttcacacctgtaatcccagcactttgggaggctgaggctggcgggtcatttgagaccaggaattcgagaccagcctggccaacaaggaaaaaccccatctctactaaaaacacaaaaattaggcaggcgtgatgacatgcacctgtaatcccagctgcttgggaggctgaggcaggagaatcacttgaacccaggaggcggaagttgcagtgagccgagatcacgccactgcactccagcctgggtgacagagtgagactcggcctcaaaaataaaaataaaaatgacaaaaaaaaaggtatttttgtgatcaattctttcatttggatttaggtgagcgacctgtgagagtttatgccgatggaatatttgacttatttcactctggtcacgcccgagctctgatgcaagcgaagaaccttttccctaatacgtacctcattgtgggaggtaagaaaacatttggtgacttcaggtgctgtgcagaaaaagatgatagtacagtctgtctttctcagctgagtacactggctcttgtttccatttttaaatgaaggatgtagtacagcctctctaacacacatgaagtatatgggtaccagcaaactaaacctggagagaggagcttcaagctcctcgactgtgccatctggcatttattcactgcttgtagctgagtttctgtggtcacaggagcagccgtgacttccgttgtccactttaaaacatttgctttagatttcagtttatcattttgaattaactggagtacaaaagtctgccaaggaaatgttaggtggtccagtccagtgtgaataaaacaggaaaacatgtttaaggacttaattgatgcagacacgcacagcaggtttatttcagagtcaaagatcttggtcacctgttgtactgtcccttctccaaagtatgaacatactgtttagtgagtgttgctcctgaaggtatacgctgcattaggaaaagcgttatcacccaggttcaaccacctttagaagacttttttccagttggggaagatggttgcagtcctaagcagtgggagaagatgggagaggtcggtggctgaggaggtgctaagcaaagaggactccaacacacaatttatgatgtggtgaaccagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccgggtaagaaactggacacatattcccattccttgtttcagaatcccctcaactctcaaagctgctggcacgtaggctggttttccactagccgtgttttacttctacctcttatgtaagtttcgtaggagatgacagtgatattactagtgataacagtcacccctgacgtttatatggggctggatggtttgcaagcacttttacatccattctattccattttctgcccacagcaatcctgtggtgtgtttgtcatttccgctttacatatgagtaacaagggctagagaaaccaaataacctgctccaagttacaccattggcagggctgggaactgaactcgccacaagttacaccactggcagggctgggaactgaactcgccacaagttacaccactggcagggctgggaactgaactcgccacaagttacaccactggcagggctgggaactgaactcgccacaaattacaccactggcagggctgggaactgaactcgccacaagttacaccactggcagggctgggaactgaactcaccagttacgagaccttccccccacaccataggcacatctacccttagaacatgccagtctcctgagaatatccatagccccaggtgaactctgaagacggtcacattaccaggaaataagacggattaacatagacttttcttggcttaagtttcatttcagggctttgatcttatgctagaaattgggtggaatcagaaatcaaggatatttctcactgtttctcagtaagttattatcaaccccttacctccttttaattctcccacattaaagtaacagatttcagccaggtgcagtggctcacgcctgtaatccaagcactttgggaggccaaggtgggaggatcgcttgagcccaggagctcaagaccagcctgggcaacataccgagaccctgtctctactttaaaaaaaaaaaagccacaggtttcctgcaaaaggtgggtacaaaagatgagaaggattgattaggccaggttagaggcccccaagcctgaggaaatagcaagcatgttgtcagttctctacaggggcgcgtggaatgttgtaggtaaattgttcagtgaggcagaaagaatgaaggcagccaaagtgcttctaaagcaatacgtgggtaggcctgaagaggggatatttattaaaactattgaggattaggacagaccttttataattctctggcttttctacatcaacacctagcagccagtggcaccaaaggtggtaagcaagtttattctcagcaccacagcccacaggcccagacagaagtatgaagttagaggaatttctaactccccttttctctttgttaacaatatatactcaaccttgagttttgcttgtcccattctttttttttttttttttgagacagagttttgctctgttgcccaggctggagtgcaatggcgtgatctcggatcaccgcaacctccgcctcccgggttcaagtgattcgcctgcctcagcctcccgagtagctgggattacaggtgcgcgccaccatgcccggctaatttcttgtatttttagtagaggcagtgtttcgccgttttggccaggctggtcttgaactcctgacctcaggtgatccacccggcctcctattctttactttgctgcctatggatccctgacaagttgttcatgagtaattgagatgctggctgagagtctctgacatagtcccaatgaacatgcttcacactacagtggtctctcggggatggtatagtgatcttagtaattatcagcaaaaggctggtggcccatacaggaaggagtaagtgaagtttagcacgcctccgaacaacattattgatccccagtatcattcatctcttcttgcccttgcaaaggatattcatagcagtaaaatggccaggcgctgtggctcacgcctgtaatcccagcactttgggaggccaagtcaggtggatcacttgaggtcaggagttcgtgaccagcctggccaacacggtgaaaccctgtctactaaaaatgcaaagattaaccaggcggggtgacatgcgcctgtagtcccagctactcgggaggctgaggcaggagaatcgcttgaatccaggaggcagaggtttcagtgagccgagactgtgccactacactccagcctgggcgacagagcgagactcggtctcaaaaaaaaaaaaaaaagtagtgaaatgatagatcctgaggataaaacttcttttatttatttatgtatttttattgatcattcttgggtgtttctcgcagagggggatttggcagggtcataggacaatagtggacggaaggtcagcagataaacaagtgaacaaaggtctctggttttcctaggcagagggccctgcggccttctgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaattgagtctcccatgtctacttctttctacacagacacagcaacaatctgatttttctatcttttccccacatttcccccttttctattcgacaaaaccgccatcgtcatcatggcccgttctcaatgagctgttgggtacacctcccagacggggtggtggccgggcagaggggctcctcacctcccagtaggggcggccgggcagaggcgcccctcacctcccggacggggtggctgccgggcggagacgctcctcacttcccagaccgggtcgcggccgggcagaggagctcctcacatcccaaacggggcggcggggcagtggcgctccccacatctcagacgatgggcggccgggcagagacgctcctcacttcctagacgggatggcggcggggaggaggcgctcctcacttcccagactgggcagccgggcagaggggctcctcacatcccagacgatgggcggccaggcagagacgctcctcacatcccagacggggtcgtggccgggcagaggcgctcctcacctccaagactgggtggcggtcgggcagagacactcctcagttcccagacggggtcgtggcctggcagaggcgctcctcacatcccagatggggcggcggggcagaggcgctccccacatctcagacgatgggcggccgggaagaggcgctcctcacttcccagactgggcggccgggcagaggggctcctcacatcccagacgatgggcggccaggcagagacgctcctcacttcccagacggggtggcggccgggcagaggctgcagtctcagcactttgggaggccaaggcaggcggctgggaggtggaggttgtagcgagccgagatcacgccactgcactccagcctgggcagcattgagcactgagtgaacgagactccgtctgcaatcccggcacctcgggaggccgaggctggcggatcactcgcggttaggagctggagaccagcccggccaacacagcaaaaccctgtctccaccaaaaaaatacgaaaaccagtcaggcgtggcggcgtgcgcctgcaatggcaggcactgggcaggctgaggcaggagaatcaggcagggaggttgcagtgagcagagatggcggcagtacagtccagcttccgctcggcatcagagggagaccatagaaagagagggagagggagaccgtggggagagggagaggggagaggggagaagggagaggggagagggagaaaacttctcttatggccttcggtttgtatttctcaggccaatagatgtatctattccagtcagagggctcgtggttgctatttttatattccctcttttctcacggactgagagaaactagttaagaaagaagtaacctctttctcatactttttttttttttgagacagagtcttgctttgtcacccaggctggagtgcagtggtgcgattttggctcactgtagcctctgcctcctgggttcaagcaattctcctgcctcagcctcccaagtagctgggactacaagcgcccgccaccatgcctggctaatttttttgtatttttagtagagacggggtttcaccatgttagccacgttagtcttgaactcctgacctcgtgatctgcccgccttggcctcccaaagtgctgggattacaggcatgagccaccgtgcctggcctttctcatacttttagaaacccttatttgaccaaatccttccagacccaggacagggagatttccttctttcctaggctccacccactaaccggttcaccagcaaaccctctggccctattgaccacagcaagatgactggtatacagagtgagggtaacagttctagcagactaggagaaatagctacaaaagcagctggctaacttcatatgtatactccataaatcattaggttgggtggtttgtgaatagattgtagaatttatgagcaaagcaaagagagatatgaagtccactgaggcctggcctctgcctattgtcctttttctgggcctgagaacattgactgggtctttctgaatggcagttatcatgggttttaatgatgtttccttattttcagattgattttgtagcccatgatgatattccttattcatctgctggcagtgatgatgtttataagcacatcaaggaggcaggtgagtgagctgtgcttcctcactgtaggggatctcagggcagctgcagatgttcagccatgttgctgctttacagaggaaaatgtgtacattagaaattcaacatcctctttcaggccacattttggataaaaggtaaagatgagcatagcacccatcaattctttgtcgtcagttcatgacatccatcaattcttggtctaaacatctactttggatatctctcttaatttcaggaaaccctttctcatatttttcttaatattagggctatgtaactcttctttgccttacctctggcctttgattcggtctaccttctgtatatcagtatctttcagtttcatttagtaataacagattctgctttttgaggaaaggaaaggaatgttgcccccaatttccatttagtcttaatacctgagctaaccagaacctcacagtgtttgtctgtatgtgtttctgagttaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgtgagttccagccttaccccagagttccctgactctgtaggagacatatcacctcccactccatctcagctgaactggctttgcagttggctttgatgatcactcccaaaagttcagtgaatgaattaccactatgttaactgttcacaaaaagaatgaaacagacagtttctgccgttacggtctggtaccaacacattcgtataaagccatacagccaactaaataaatgagtaatttatatagtgcagtatttctgtcaataaatggaaaacggtgtctcttaaacttcctctctcttcttcggttggatgatgtcttgggaacctgcgaaaggctatgagccctcctcgtgtggatagtgacacccgacacaccacttcccacacagacctgagttttaaatttggattgacgaaagttaagtttatcttagcttaatattgccttttagaaactctatatatttttctgggcatggtagttcatgcctgtactttgggaggctgaggcgggaggactgcttgaggccaggagtttgagaccagtctgggggcaacatagcgagaccccatctctaaacaaacagacaaacaaaaaaactaaaaaaattcatgcaaatatatatatatgtagtgtttctttctttttgagacagggtctcgctctgtcaccgaggctggagtgcagtggcgtgatctcggctcactgcagcctctgtctcctggtgccttagcctcctgaatagctgtgattacaggcatgtgccaccaggcctggctaattttttttttttttttttttttttttttttttagcagagatggggttttgccatgtttgccaggctggtctcaaactcctggcctcaagcgatcggacccccttggcctcgcaaagtgctgggattacaggcatgagccaccgtatccagccaacactatacattttgtatgtaaattagacctcaataaaatcgatttaaaaagaagaaagctgctaactttaatgtcttctacataaccagtttaccatgctccctgacctactcccatctctgtaaattgtgctataagaatggataaaatgattacatctaaatatgatttatctaggcagataaaccctagctcttgttaatttacttactatagctttatttttcccataaaaatcaggtgtttaaaaattctaaacataatcccttttctctttatgatctggaaattttgagagtacttttctttttctttttttgagatagagtcacactcagtcatccaggccagagtacagtggcgcaatcttggcttactgcagccttgacctccgggctcaagtgctcctcccatctcagcctcctgagtagctgggactacaggcacaggccaccatacccagcttattttttatatttttatttttagtagagatgaggtcttgctatgttgtccaggctgctctcgagttcctggcctcaagcagtcctcccacttcggcttcccaaagtgctggtattacaggcatgagccactgtgcctggccaaggatacttctcatttgactaaatactcccttcccttccaccggagggtttataccattttccttatctttagcaaagttggtaagaccaacgagtatcatcattttgcaaatgagtaaatggaccttaaaatactaaaggaacaaaaagcaaaaaacacaattcatttaaaataatagaataagccagtgatagaggggaaaaatccagtacaataagcagattaattaagtaaaagatctagtattttctctttcaatctattgtaattagtttattcttggcagtattgtgcagtgatcttttagctgcctctgtatctccgtctggaatgaggttcgggccatgctgcgcatgtttatgttccaagtttatgttttatctttaaaactctgactttatttggctacgtgcctgttactgggtatagcctatatttttagtttattcccaaatgcccacaatattagaattaccacttcttgtgtgtgcatccacagcatatcttatctgttattatgctgagagtggggtagattaaagcaaagcaaaattctagactgaaaacagtgtcaattgagtgcttgagccatgttttttcgttctcttatggtagagaagtttaggatgagcattatttctcagaagagttatttctttatctaggagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgtttggtccggaaggagcactggtatgttctttcccactggacaatgtagggagttccatgttgtggaaagaatgacagaatcattgagcaggaaggggcatcgacactgagaagttatctagtctatccccttatctgggcagaactatctttcaactgtccccagcaaggtttttgaaacctttacagaaagacgttacacattctcctagataattttgccagctctctctcaaccttaaagtctggtgacaagataagcaagtcgccttgcccagcttttatctgtggtatgattttagatagaaggaaaggaaagaataaagaacaataaaaagaaagcagcctccactacaagtagctgcagcaggaaccccaggtaaggtgggaattctgtctttgaggagtagcagtcttttcaaccaaataaaagattgagcaagtgagtcctaggttagatatcaggaaggatctgtctgtgaaggtgtttggataaattagaataatcctagactagattattgaggaagaatggggaatttcccgggtgatgacagcaggggagaacccttaaataaatagtacagcatagactatcccagtcctagatgcttcagtgatgattaagtaggatccacggtgtttttctgactcttcctttcggtttctgcagaaacatatgctgaaagaggggaagggccggatgctgcaggccatcagcccgaagcagagccccagcagcagccctactcgcgagcgctccccctccccctctttccgatggcccttctccggcaagacttccccaccttgctccccagcaaatctctccaggcacaaggctgcagcctatgatatcagtgaggatgaagaagactaatgtttcctccctcctttcctgtcctccctttctgtcccattaccttcagaagctctctgttgaattccaaattgtgaccccaacactaaacctaaggacagctacaaaggaaagacaactggggaaagaagacctaggactgggggaacccaaacagcctgtcctgcaagtgacatcactcacccacacgaaggagggggactgcaccttagaagcctgctctgcatccatttacccccccccaagggctttgtttcactgtttatgttcacgtgatctcaacagggaaattgtcattttcattaattttttaaaaaattcgtctttcaaatgtagaactaattttttgcccctgaggagtgggcagaagaaggaggtagtgtaatacgcagaggccttttcttcccggtatactatagcatttgccttccgttctgaagctatgtggcttgccaagtccttcacgaaatgagccacgctgatgggtaatttgtggagaaatatcttaattttgatttccttaaggaaaagcgaaaagcagagttacagtcacaaatcccctgaacgtactgctgtcaccagtgtcattgtggctgcgggaaggagatctgaacctaacttttcttactccctgaggagtttcttgttggacccaatggggtccatgaagacactgatggggatggaagcagacccatggcatcaactgcagtgtttctgctgtgttcatcttctcagaaaactctgtgacccagttctttgggagcttttgtcagtctctttcgtgccatctaccttcgaaggaaggaacacttttagagttacaatgatgaggagaggagcgggacaatactcaatcctataccaagtcgattgagattagtttcctactgggagtaagtgcctggccctgctactcctatttgaatgctattaatattacctagccttttacaaaggatactttgtaaatgtctgctgttggaacttgatgttaatccattttggtcatagccatattagagagatttgcacagaatgtaaaggcaaaagcataggaaacaccttcctttctaaagcaacagccttatcaccttgacctctgtccctcttcagaacattcttccctggaaccagtgctccacatctttcttttcctctgagagctgcagctggcagggacctccctctgctgctcctccagcaagccacagagcataccctcacgtgacaagagtgtggtaggttttctccccacttttcacacacgcctggtggttgtggttccatctgccttgttggcttgcccggggggattcaacacttgactttcaaatcaaagaatgctaatgcttagcacttgctgttgagcatgctctaacttttaaagccctggcctcctgtctccttagctgcttagctacgcggcctagcagatcatcacccatcagtaatcctgtggctagatccaggggaaaattgcttatgtccaggccccacccctgtcactcataaataccccttgtgggggtggaattttagtgttttcagctaagaaaaccacattttctctttccttgcctctgctaggactgtgagcatctcatagtccactccctaaacactttctggtaacacctagttttccgcctgagggtcagaggctagaatcattgcctgcacagcaggactaccttggttcttaaaacttggatcacccaggcaaggcgtggtggctcacgcctgtcatctcagcactttgggagactgaggctggtggatcacttgaggccacgagtttgagaccagcctgaccaacgtggtgaaaccccatctctactaaaaatacaaaaattagccaggcgtggtggtgggcacctgtaatcccagctacttgggaggctgaggcaggagaatcccttgaacccaggaggcggaggttgcagtgagcagagatggtgccgctgcagtccagcctgggtgacagagcgagactctgtctccaaaacaaaacaaaaaccacacacacatacagaaataaagagaaataatcaactagaaaaaaaacaaaacttggatcacccagaaagagcgtcacagaggcgagggagaatgaagcctcttgttatcctgatcgcctatgacaacgacatttctaactcttctttgaagcgcagttcttactcttaaatctggtcatacaagctttggcttggaatcctgtctgtctttgaaacagctgaagttagtgttttcctgtgttacccagtgttacatagtctcatctttgaacttttctgcgtcagccttctctctttgggaatgctgcctgtttctgtctaacttattctccctggtgtggtgtggcagtgaagtctgtgctgaagcccatctgcttggttcctccaagtgcacattatgcaagtgtatttggatagacagggagatgcccggaacgtggttttcctcctccctccctattggagccatacctcctaaatatattgtctgggtcccaaatgtttgagccctcttcctctgctctcagtgggctgctcttggcatgccctgtgcttggaacgggacctgcaggctgacaggcctctgagactgctagggccagcaaacgtacatgttattgggaaactccctttccccttttggtgagcttctaccacctcagtctaatcgttttgactgaaagctatttgtctgactgaaagctaaaatcttttatagtgtggcctgttagatactttggggtaaatgtggtctgaggtgctggactagcacgggtagatggagaaagctgttgggaagttgcataatgtggtcatctgtgcctaattaaatgaggttagaggtgtgcacaccaccacaatgcctgggatctaaatcttcagatattaacgtttgaggctatggagctgtttccctgaatcacacacgagaaagcagtcaacatgggtgggccaaatgtggccaagatgagagagccagaagtgttggccttagagcagagcctctgtgtgtgagacattagaaggccagagccggggaggtgccggcgcagccactgccttccggtgggccggacggaaagcttggtcttatgctagattcagaagcactgaagaatggaggttgacactttagaggactaggaagggatcatttgtgctcttgcagctattgctgatagctagagccaaagaccattatattgctgaggcttgggtaagaaagttagggatgtgaggaggttgaaaatcctgaagaagagaaaaaatatgagggaggctaaggaaacttagccactttctgatcactgatgactccttaggctgcacctgagtgatggtggtgtttttggaggctgtacctgagtgatggtggtttttggggggctgcacctgagcgatagtgatttttttttggaggctgcacagctggtcagaccatctctagatgttctttccacagtggttcatagggcgtcattcccccttcctggattattttgactatgggtagcttattttcaagagctctttgcctttttaatcctgttccagatcacttatccaaaatctttccaaatcaattatattttgctgcttttctttaattccctaaaagccatagcttctagattttctatcagcacacattctcaccagaagttgaaccaatacaggtagaaaaagaaagcccccttaatgtttttaactgatgatatttttttaagcttaccaatataagtatttttaaaggttctatttttcaaagtcataacaatgattgttcttgttttctctcatagaatagactgccatcggataaagagtggtccctagcttctatttttccaagtaaataagtagaacatgttcttgggattataccattaaatgttaattttcttgaagaagaaagattgttgtctgccaagattttatgttagcgctcggattgaggcagaaaacggaagcaccaggtttaacactgggatgacttgggttgtgttcctggaggtttgaagtgggccttcccgccttttgagggggaaaactgactgttttgaacacatatcctggattagttgggttgttttgtattgaggatccctaaaagacaaaagagtcttggaaaggactgctggcttcgtcttgaacgttcgccccatcaccagtgtgagtccgtggggaagtcttcctcaagtggggttcagtctgtaattttcctgtctgttcttagtttgttctgagttattttggattttgttctttagccaaataaaggcagtgtggttttacctgatgttccatgtccagtggtgtttttattttttatttttattttttttgagacggagttttgctcttcttgcccaggctggagtgcagtggcgcaatctcggctcactgcagcctccgcctcccaggttcaagcgattctcctgcttcagcctgccaagtagctgggattacaggcatgcgccaccacgcctggctaattagtgtttttagtagagatggggtttctccatgttgagcaggctggtctcgaattcctgacctcaggtgagccacctgcctcggcctcccaaagtgctgggattacaggcgtgagcccccgcgcccggccgtgtcctgtgttttgacctgtgtggtgcattttatggatttgggacttttacttggactctcggtgcctttgcttccacgtgctgactctctccttagaaatcaagctccatgaccacagtgtcaggagattccttttctagcttgtcactgaagactcaaaagccattgtcccacaaagtgaggctgacccagaccaccagggccccgcgtggttggtgccgtagtagcacacctgtcagggaaaggtcaccttccatctgttctccagggcccctggcttcttcaagactctgggctggtgctatttcacctcaccaagttctccttttcttatgccagacacaatactatatactcttcttttcatctgctttaggaaagctcagtaagctttcttttttttccagaggcagggtctggctgtatcacccaggctggagtgtatggcacaaccattgctcactgcagcctcaacctcctgggctcaagtgatcctcccgcctcaggctcccaaagtgctgggatagcaggcatgagctgtcgcacctagccagcaatatacaaccttgaagggttaatagtgacatggacagaggcaaggtgcccagttacacattttcagacatcatcttgtttattacaaaacttaaaacaccttccaggcaagatccaaagcaattttattctaacattgttcaccttcatctgtagagtcaaatgtatctgccagcttgtgttgacaagggggaatgcttcccatttggtcaaggttgagggacagtaaaggaatcttgtattctaatgagtacagcatcctttcattgtccaagccatccaccttaggctttgaggttcaagtccaggtctggagaagagaaagtttcatacccaaccttgtggtctttccttcggtagtacattcgtgtcagcacagtcattagaaaagtctccagtatgaggaggtggcaattcatcactgcagtgtagggtgaaatacagcgtaggttatgctgagttacagaggtggtattttactagcagcccgggcacgggagttgagcaacactttctccagtttatccccaaatcaggacttagggatacgaaattgtcataaataacacagcgggttaatggtagagccagaaccggaagttggctgtctacttctgtgctctgaggctggcatacagtccatttcttatgtgtgttcaatcaacatgggcttctgttttttaaccattcccattcctctcccaggagctgaggactgaacccatggcttcctgggttggccctcagggctggcctcaagctgtggggtttcacttctcttctgtgtgatcagagaggtcatagtttccttaaagcctctgttgggatttcccgaagatcccttctgaacactctgagcagaagtcaggctggcctaatgtctgttctggggccccttctttcctgactctccccgtctcatccatcccacgatgggacaggaggcttaacgtgctcaccttgagacctggttttagaggaatagggaggcgaacaagcaatctgcccaccgttggccaagactgagaagatggagggctgtagggcagtcaggatgaggagaacctgcggaacataaaagagaggcaagggtggactgggcctgccctcacggcacagaacgcagccagcccactgccgggccttgcccttccgctgggcaggttccacccaccgtcagatctgtgcagtcacagagggttgaggctctcacttcattaaaaatctgtgggattttcatctttaggcaaatgacattcttattttctacccagtagtttattagagtttctgacaagatataagaactgattaaagggttcatttttaattccctttctcagccatggctaccaatgagcactcaatggataaagagatgggtgattagagaagagtcattccatctagctcaagtgcctgaggtccctgctcctagaataatggacaattaaccattaaaatgccctttggaagctctgccatcccagagactgcagggagagggcaatggggaatgtgtttaatgggtgcctggagatggacggtggtaatggtagtgcaactatgggaatgtacttaatgccacagaacctgacacttcaaaatcattaatggcaaattttatcaatatttcaccaaataaagaaggcaaaaggggagaagaagaagatcactgtccagaagccctggaagcaccatttatcttagtattgccctccctgagtacattgtgtggaaacctcagcttcttcaaggctggcgtggctcacccaggctcccccacattaaccatgggcaggctcggccatcacacggcttttatctttcggcctggtctcaagtacttctgggacccagaacctttctgccccttcagtccctgactcattccggggacttctctctctattcccatagcccctttcattctacctcctatgtgcctggaagttcacatttgggaggcatgtacgtagatcaaatgagaatgtacgtgaactcactctgttaaactgtagggcagtcattatgccttgggagtagaagaccagcaaggagacaggatggagagagaaggagaacaagactgggttagaagtcattgcatttggtggaaaagtcatctttgaggttagagaaggcagcacgtagaaggtgggccaacatgcctttgagagaattttcagaagcgttgtgaagatgaagggcagggtaaggagaagacagatgtgtggaggagtcaagacatacctgggtataaattctagccccgttccttatgtgcctttgagcaagaacatctctgggtctgtttcttcctttgtaaaatgggaaaaatgactcctggggttgtgaaaattgaagtgtaatgtgtgaaagtgcccggcacatggtgtaggtaggtcctgtagctaatgctaatgcttctgctggtgttgatgggttataggattttaggaagtcataggtagaaaaggaaaggaagaagcaaggagacaaatgtaaggtttgttaactaacacacgtgttacaggttaaattgtgtccccaaaaagctatgttgaagtcctgccccccggtactcgtgaccttatttaagaacagtttgttacaaatgtaattagttaagatgaggtcataatggaatagggtgggcccttaatccaatttgactggtgtcctaaaaatagatgagatggaggggcacagtggctcacgcctataatcccaatactttgggaggctgaggcgggtggatcacctgaggtcaggagtttgagaccagcctggccaacatagcgaaaccccgtctctactaaaaatgcaaaattagccgggcgtggtggtacatgcctgtaatcccagctacttgggaggctgaggcaagagaattgcttaacctgagatggcaccactgcactccagcctgggcaacagaccaagactctgtctcaaaaaaaaaaaaaaaaatagaagacacacagaaacacaaggggagaatataacgagataatggaggcagaaatgggagtgacgcaaatgctggtcaaggatggtccaggactgctggcaactaggaaactagggagaggctgggaccccctgcagggctcaaagggagcagggccctgctggctccttcgctgtggacttctagcctccagcacaatgagacaagacatgtctgttgttttaagccatctgatttgtggtattttgtcatggcagccctgggaaacaattccagcacagaaagacaaaagcgggaagcacaggaatcattttccaaatctcatgagagacgtgaggcttatgaaaaagattcccggcccactttagcctttattggcctcacttactaaccccaactatctgtagctcggttatgaaacatcttttctctcccagggtatagttacctggaacagagcaaatttggctcccatgttctgctcacccaggtgtagcctggcttgacgggaaatgatgcccagggtccagagagccagcagtgtggacacgccaaggaaagtgttgatccatagagctgtgctcccctcagaaatctggtggcaacagaaagtagtcagtgaggcaggcaagctctctctctctctctctctctttcaagagatggtgtcactctgtcacccagctgaaagtgcagaggtgcaatgatagctcactgcagcatcacactcctggctccagtgatcccctcgcctcaggcttctgagtagctgggactacaggtgcacaccaccattcccagctaacttttttttttttttaataatagagatgggccaggcgtggtggctcacgcctataatcccagcactttgggaggcagaggcgggcggatcacctgaggtcaggtgttcaagaccagcctgaccaacatggagaaaccccatctctatgaaaaatacaaaattagccgggggtggtggtgcatgcctgtaatcccagctactcaggaggctgaggtaggagaatcacttaaacccgggaggcggaggttgcagtgagccgagatgcgctactgcactccagcctgggcgacaaaagagaaactccgtctcaaaaaaaaaaaaaaaaagagatggtatctcactatgttgcccaagctggtcgcaaactcctggcttcaagtgatcctcccacctcagcctcccaaagtgctgggattacaggtgtgagccaccatgtccagcctaattttaaaaacatttttagaaatggcatctcgctatattgtccaggctggtcttgaactcccactcttgagcaatcctcccacctcggcctcgtgagccatgcatcatggcacctggtgcttcctttgagctctcctctcccacggcaggaacggtaatgaaaaagcccgggggcctggcctattgcggttctctccctggcagtccctgagcctctgttttcccacagccacccttttctggggccctctgtcaaggggtgttggctctggtgattccttttagaacacaaaggtactaaatgagtcttggactgtgctgtcccttactcccggcttacgtctgctgggtcatagatgccgtcggggacgagaaacaggcccaccagggtcagcgttatcttcaagaaggcgtattggaaagggcccaacatcagcagctgaagcttcttcctgagtggggaagagggttaggaacatgggcccacaaaccccctgccccaggaagacgccccggctcctcacagggctcctgggctgaggctcggctgctgtcataaacaccaaccaggttaagtggatggggacagaggaaaaaagcagaatgttgagagtgctgggaaccctcttggtctcccactcacctccagacaagaattccgtctttggagcgaggtctgggagtgtgacctcaacctcattcaccaaagtgggcagaaggggcaagcgaatggccccaagtccagttttctctgtgtggctaaggcttgcagggtgcagtgaagttcagtgatgacaattgaggagctctccttcctctgctcccctgtcccctgagggtggcgcccgtgggtcctggccgtgggatgcccacccttccgtcactggctttggcctattcacgcctaattcccagagccttgaaggggaccaggggtccaggagaggctccccggctcctggggaaggcaccttggccccgcctcacctggtgagcagcagccgtggacagcaggggcagcagcagcagcaggggcctgtgtggaccatcatcggggtgtccctcagcgtcctcagcactgcctccttccccccaaagccttccaccatgaccagcatcagcaggtaaaagcacacggcataaaacctggggtggggagagaagagggcctacgaggtctgctgccagagagaaagacagcagggagaggtggggcttactgaggagcagagctagggctgggcgttctgggtgtgtgacccaagaggggcgagggagaggagacggcccacaggactgggagaaggggaatttcagactgtgggaacagagggctggctgaggaatgtgccagatgccaaaatgaggcattccctgagcagagccaggagcgcaagagcccggaactagcacaagctgggaagggccagatacatggtcagctgggatcaaggacacggactcgagtcctggtgagcgggagcagaggggcccttggaggtggggcgaggcagggcactcacgaggtgatggtcatttccaccagcaccagggaacgagggatccagagaccaaagcagcacagcacagacaccacctgctcagaaggggcaggagcaggtgagggcgggagggagaccctgaggctccggaagccttttgcggcaaggacacaggaggcaaaacctacacattcgaggcagcgttccttaaacgttgccagctggaaaaagcactaattaagtcaagcaaaccaaggacctgtgggagggtgtttcaaaagcctcagcgtaagggtggagctgagtgtgaccctgtggaatgagactttcccccacactctgaggaaccactgaaggaagctcttcaagtggcaacactgtagcggggagcaaggatgaggcggctggtgggctgagcagatctccagctgtctccgcagcccttagaatgcaaacactgcacagccttccaagcagaggatcctaactgcaaggggaggtcggcctgcaaacctcggccctccgcgggtcgtggcaggacactctttgccgaagtgacgtgctgagtttagaggaattctcaccttggtctctgccttcttttcagttccccccacagggcagccccgggggcctcaccgtgggtgccgagctcttccagagcagagtccgcctcttgatggggcaaagggtgttcttgtacaggtagacggcatcctccaggaagatggcaatggagcccagcgccagcaaggtcaggatgctagtgagggcaagttccacagggcccagggctagaggaggagaaggcagagagctgacgaccgggactgagcgggagaaggcctgggcttgttcctcggatcgaaattgccttactggatctaggctcccacccgtgcacaggaatgaggattttttagacctagagtattcaacctaagaaatagtcttttttttttctttttcttttttttttttttttaagacggagcctcactctgttgcccaggctggagtgcagtggtgtgaacttgggtcactgcaacctccatctcctgggtttaagtgattctcctgcctcagcctcccaagtagctgggattacagacacccaccactatgcccggctaatttttatatttttagtagagatagttttctccatgttggccaggatggtctcgaactcctcacctcaagtgatccactcgccttggccctgcaaagtgctgggattataggcctcagcccccgtgcccaaccccacttcacttttctatctccagtgccaggtgctgcactagcgaatgtagatcaattaacataattgaagccgaatataatttatgggacattctggatctgtttaagttgatttcaccaaaattatatggtgaaaccaggacattagcagagaacttttttgtggggaggaggacaggttctcactctgtcgcccaggctggagggcagtggtgtgatcatggctcactgcaaccttgaccttccgggttcaaaccatcctccaacctcagcctcccaagtagcctgggactacaggtgtgcacccccaccacggccggctaatttttaacattttctgtagagacggggtctcactacgttgcccagactggtctcaaactcctaggcttaagcagtccttccaccctggtctcccaaagtgctgggattacagacgtgagccaccacactcggccaggggagaacttcaacaaaagagaaacggatcaaataaaaaccccaaggacacctgacgcacgctggcctcatgcttggtcttacatgaactatagtccaaggttttcaaactttcgtggatattgcagtcattttgggagttgttaaaaagcagctagctgcccaggccctacgttcagacatgtgcgtccatagatctgagatgggcccagtcatctgcatttttaacaagctcacctgatagtggtcggaggatagcagacactttgacaaatactggtagacctcatctggcctcaccgttgctaacagaaaaaaatgaatatagtcacaatatgtgtttccgaacaaacgtgattcattaatgcagccgttagttttaaagaaagggttctaggtccttagtgaacctgtggtcatttatctaagtgtcttttctagttattggaccctcctttgcacctgctacctgactagataagaggaagaaagggagaaaactgccacactccagtcattgtcctgttgccttgcggggtgagcacgaggaagggattagctagtctgctctgtgttttggtgactaaggaacatgagggcagctcagtgggagcaatatgactgctgaaaccaaaacagggagaaaggtggccacggtacagacttgagctggagctcttgtctcggtcagtcgcacctggtggcaccacaggaccaaccaggactatgggtgaatttgtcaaaaaatacgctgaccctcggctgggcacggtggctcacactggtagtcccagcactttgggaagctgaggtgggcggatcacttgaggccaggagtccaagaccagcctggccaacatagtgaaaccccacctctactaaaaatacagaaattagccgggtgtggtggcgcctgcctgtggtcccagctactccgggagaggtgaaggctgtagtgagccaggatcacaccgctgcactccagcctgggtgaaaaaaaaaaaaaaaggaaaatacctataatactgaaaaaagttagcaatgcttatgtttgggtgatgggactatggatgatttgtgtcttcttttctacttacttttttctatcttttctgagtagtcacttttttaaaaattaaacaacttaaatttattttctcatagttttggaggctagttcaagatcaaggtgtcagcaggtttgatttctcctgaggcctctctcctccacttgcagacaactctcctctcctcccctcccctcccctcccctctcccattccctcccctctcccctctcctcccctctcctcccctcccatctcctcccccccccgccccgcccccttctcttctttcaacgaagtttcactcttgtcgcacaggctggagtgcactggtctgatcttagcttactgcagcctccacctcccaggtttaagtgattctcctgcctcagcctcccaagtagctgggattacaggcacctgccaccacgcccagctagtagagacggttttcgccatgttggccaggctggtcttgaactgacctcaactgacccgcccacctcggcctcccaaagtgctgggattacaggcgtgagccaccgggtccagccgacaaccgcgtttctactgtgtccccacatggccttttctcggtgtgtgaaaatccctagtgtctttcttttccaattattctataatgaatatgtatttataacaaaaataaacctttttttagaaaagaacatatttttccaaatatacaatgatgtgaaaaatttattttgtatcatgcttacaaaaacagaacataaaattttaggaatagtatgatttctacaaatgttaaataaaaacatagagaaagggctaggcacagtggctcatgcctgtaatcccagcactttgggaggccgaggcgggtggatcacttgaggtcaggaatttgagaccagcctggccaacatggtggaaccccatctctaccaaaaatacaaaaattagccaggcatggtggcgagtacctgtaatcccacctactggagaggctgaggcaggagaattgcttgaactgggaggtggaggttgcattgagctgagatcacaccactgcactccagcctgggccacagagccagactctgtctgaaaaaaaaaaaaaaaaaaaaggcattaaaaaaaaggaaattacactaagatatttgccgtgcctgtctctgggtgggactgtagatgatttttttctctttttactgttctgtattttctttctttctttttttttttttaactaaacctgaatgatttttataatagaaatgtttaattaaaaaaactcagacaataggcaaagtccagataggaaaaagccaacattaatgcaggtggttttccaaaaccaatgttctgtggttgggaagcgggggccattgctagagcctctcttacccccagccccgtgtgctcatcagcccttggagagcgtaaaaactgccctttcacacgccaccaacccagtccttcccagtcttcatttccctaactgctccctgctccgtgaaaatctccattccgggtaacgttatgtcctccttccgcccacatcagggctatttgtatttacacagctgtttactcgcttattctcggctctccaccttgtggtgcacactccacggaggcagggaccttgtcaagcttgtgctctgttctcaaacgcccggaggagtaacggctctgtaactatttgttgaatgaaagaaataacctatgagaattcctatcatcatctgcatttcatagactttttcaggaaacgaggctcagagaaggaagcacatctcccagggtcacacagcctggaagtgaaggagcagagatttaaacgcaggtattcgtgactaagcccacactcttattaaccatgacacacagtgactccaggtgtgtgtactcgtggatatgggagagatcatcaaaggcaaccctgggagggccgttccatttatgaaggtgagggtggggcagattctgactgttcaacacaaatggttttgcagtgtcttctaactgttgcctttggtactctaattaggaaaggaaaagttccttagcatccatagcccgatactgggtctgtccatcaaactatcttcttaggagatggcctcttctttgctggttaaactcaatttccccaaaagggcatctaaatagacactatgggacaaaagtattccacagctgaagaatttttggaaatgcattaaggttaaatgtgatgattcctgcagagcatactgacatttttaatctgctaatttacattgtaaatttccaaaaggagggtctagaacgcaccttttacaaaacttaactttttttttttttttgagatggagccttactctgtcgccaggctggggtgcagtggcgcgatctcggcttactgcaagctccgcctcgtggatccaagcaattcttctgcctccgcctcccaggtagctgggattacaggtacccaccaccatgcccagctaatttttgtattttaagtagagatagggtttcaccatgttgggcaggctggtctcaaactcctgacctcaagtgatccacccgcctcggcctcccaaagtgctgggattacaggtgtgagccaccgtgcctggtcacaaaacttaacttcctacagaactctgtttccatgaaggactccttgggattaagagtctgagactttgggaaatgcttgtctagttgaccattttgaatataatcatacttatagcaactattaaatttcccactgtctctggaatagcaaagactactttttaaaataatgaaaacaggaacattaaataagaatttgaaaaaagagtaatcacccataatcccagctttctaaccaaaaattatttccatgcttgcatatttgcttccagtagcttaggagcacagtgtagagcactggagtcagacacttgagttcaaagcaaaatgccaggccgggcgggggggctcacgcctgtcatcccagcacattgggaggccgaggcgggcggatcacgaggtcaggagatcgagaccatcctgactaacacggtgaaaccccgtctctactaaaaaatatacaaaaaattagccgggtgtggtggcgggcgcctgtagtcccagctactcgggaggctgaggcaggagaatggcgtgaacctgggaggcggagcttgtagtgagctgagatcacaccactgcactccagcctgggggacagagcgagactctgtctcttaaaaaaaaaaaacaaaaaaccaaaccaaacaaacaaacaaacaaaaacaaagtaaaatgccacttactaatagctctatggccatagacaggttacttatcctctccttaagcttcttagcaaagcacctggcgtgtagtatttgttcaataaaaagtagctttaaggccgggcgcagtgattcacgcctgtaatcccagcccttcaggaggccgaggcaggaggatcgcttgagctggagcgtttgagatcagcctgggcaacgaagtcagactctgtctctacaaaaattgaaagttagcccaggcatggtggtgtgtgcctgcagtcccagctactcgagaggatgaggtgggaggatcacttgagcccagagctcgagctgccgtgagccgtgattttaaaattaaaaaaaaaaaattgattcaatcattcttctagaataatagcttttttttctctctctcttttttttaaattgagacagggtttcggtctgttgcccaggctgaggctggtggtgcaatcatagctcactgcaacctcgacctcctggggttgcagcatgggccaccgtgactggcctgaaatagttttcttagcatttaattttaagttcgagaccagcctgggcaacatggagaaactccacctctacaaaaaaatacaaaaattagctgggcttggtggcatgtgcctgtggtccccagctactagggaggctgaggtgggaggatcacctgagcccagcaggtggagggttggggtaagccgagatcgcaccactgcactccagcctgagtgacacagtgagaccctgtctcaaaaaaaaaaaaaaaaagaaaaattaaggaacaacaaagtttacaaatgaagcgaggaaggagtttcgccacagcctcccagaggcacttcttcctgcttctcctatttctggctgtgccgtcaccattgcccagaaccagcacttacacgcctaggtctttcctagattgcctgctctttctttgaactgcctgtttcccaacccttcctcttctttccctgccactgccctgcctcagactcttttcccgcatggcaggccggggcaacgacctctcatttacatccctgcctattttttgctgttgttgagacggagtcttgttctgtcacccaggctggagtgcaatggtgagatctcggctcactgcaacctctgcctcccgggttcaagcgattctcctgcctcagcctcctgagtagctgggattacaggcacgcgccaccacacctggctaatttttgtattttcagtagagacaggatttcaccacattggccaggctgatcttgaactcttgaccgcagatgatccgcctgcctcggcctcccaaagtgctgggattacaggcatgagccacggtgtccggccgcatccctgcttcttaagcctcttcctctgcagtccatcctgattactaacgaatggccgagaagcacgactttcatccagccactcccagcctcagagccttcacgagctccttctcgctgcgggataaagcacagctcctccgccagcccggcgcgcagcgggcctcacctctcctgcccggccctctcaattgtcccctgctcttccaccaggatccttgaatcctgccagacctcgctcccctgggcctggggcgtccccgaactcatcctcgcagcttccctgtcccaggagggcccgctggccaaatcctccccactctgcctgcggcgaggcttgctggactagcagactcagaatggcctgttctgaacagccttggggtttccgtttgcacattctgaagcaaagcaatgtgagaaccgttttcattgcgtgaggcaaggtttctcaacctgagcactattgacactttggcctgaataatcttttctgtgggggctcttcccgtgccctgtaggaagtttagcagctttcctggcctctgaccacgagatgccagtagcaccttccagtgtggcaaccggaagtctcccgacactgccaaatattccctggggggacagctgctgtgtaagggaaggcttgtaccaccagctgcactctctcaacaggaggttcactggaactagatgtagcagccacctactgccactaaccacagagtggccaccaggcatctccggacactggcagttggcaaccgctctggttcagatcatctgaaatgaagccctacacagcccaaggacacgcccacgtctgcaacagaacgcacactgagagcttcctgttgcctgggaaacgtgttaaatgtgctacagagacacagacttgtatccaacatttcagaggtagtcagtatgcagcaggaaaacaaaataaaacgcaggcgtgagtcacattttctctaagcatgctcgggccgtgattctcaatgtttttggtgtccggggaataagctgagccccatcctatgcctttcactttctttttcttttccttttttttcttttatttttgagacggagtctcactcactctgttgcccaggctgcagtgcagtggcgtgatctcggctcactgcaacctccgcctcccgagttcaagcaactctcctgcctcagcctcccgagtagctgggattacaggtgcccgccaccacgcctggctaatttttgtattttcagtagagacggggtttcaccatgttggccaggctggtctccaacttctggcttcaagtgatccacctgcctcggcctcccaaagtgcagggattacaggcgtgagccaccgctcccagccaatgcctttcactttcaaaagtaattcagtaatagaatcttgttggccaacactgcgaggacttttgcaggttcacctatgtttttttttttttaattactgttttatttggaaaaagtgcttcttgcaaaagggaagctgcaaaacagagacctctgcaacaattacttgttttttcttaaagtgaaagaatgggtgggatccaaggaatcaaagcagtagatggacgaccaggagcaccccaagttatcttcaggaaacagagcgacaaaacgcaaaggtaaaatttccagtcaaggaattcttccaacagctgaacttgagctggcctcggggatccccacaccctccccttcagtggacaattatgacttattattgcaaacaaattactccactacaataaacactgtagaacaggtttttgaatcccatctgtccacctgagagctcaggggtggaatgaggcaaatacccacaaacacacacacaaaaacccgacaacagaatgctccagtgaggacaaaggtttttcagaaaggctggatcgtaaaacaaatacaactggttcacctgtgtgaagcacgtcactcaccgtaaccaccctctagagtgacatgggtccagggcggatgccgtgcagccctccaggagacccgatggggcttggaccacttgggcaccatcttgggtccccagatggctctggggtctgaaaaagcgccccaggtcgcagtgtccgcagtttgaatgagctttgaggccagttttgtggaggcccaacatgacggttgctctccggagccaggctctcatgctacccttttgacccactgactccttgaggcattgcccttctccagagccttaaccacgatgacagacaccgggccagttattctccccggctgcccaggtgcaccagctcagggccgcctctccccagctccactcagctatcctggtttccctcctctcagttccctctgaggagggtccccactcacctctcaggagttgggctgctgtgggaggctgagagaagcaggcggaggggatgccgtaattggtcttcagcacctccagaagatctgctgtgtacctggcgagacaccagcctgtgctcagaaccatgggggctgggggaagggggagggttgcacactggaccctcaaccactcctgagtgcaggactttgtccatttcccctcagggcctctttctctctctttctttctttccttccttccttcctttcactctctctttctctttctctctcccttccccttccccttctccttccttccttccttctgctctctctttctctttctctcttccttccccttctctttccttccttccttccttcctttttctttctttttttttctttttgagacagggtcttgctctgttgtccaggctggagtgcagtggtctgtcttggctcatacaggcagccttgacctcctgggctcaagtgatctactcaacccccatccccatgagtaagctgggactacaggtgcacgccaccaggcccggctaattttttatatttttggtagagacaggatttcgccatgttgctcagacactggtctcgaactccaggactcaaactggaactgggcttaaactcctggactcccgcctcagcctcccaaagtgctgggattacaggcgcccggcctcagggcccttttcttagagggagtggagaactggcccaggtgggggagtaagacaagctgccacctagccaggctgtgcctggctgccgtgcctgaagagcccaccgtggattctctccatgcgggtcgggcagcagcccagggactgaccagagaggaagagcaggatcccagaggaagggtgagtccttacagacggacgggccccctgctgctgagggatgctgccatttcctctgcgaatgccttccacagcccccgctctgcgacctttctctccccacgctggggggcaaggccgaggccctggagtgtcacaccctggcccaaacccacgttgtccctgaggacctaggaacagctagagcatttccagtcctgtctcattctgagtgcggccgccaaagggctctgggagggagagaggacaggccgcgggataggggccaccgctgcccagcgactggcccagggcccgccgccctcacttacctggggtcaagctttatctgggtcctgcccggctccatcgccgcgttctctccagcaatcccgcaggcaccggggtgaggaagggcaggcggggcgggcaggtgggggccgggggcagggtggcttgcctgggccggggtggggggcaagcagaattgcagagtcttcccctctgccgctctccctccttgagcttcccgggccaactttctatctcagagttcaccccggaggaatttgatcctctaggctggcggagttccctgtgcctgactcgtccctgcccccaggtgtggtccctcccacctcttggacaggtgcctttggccaccccttgcctctggcccggcccatcctataggattttgctgccagtctgccctgcccttccaggagccttctggggtggggtgggctcaccacgaagcccctgccctgggccggggtggggacgaagtcctcgctcctcaccgcagtgttccctggtcagcggcccctgaagaacctgctggaactcaggcttgggcactctgcagcggggagactcagggctgaggcctcggccgtgtttggtgctgtcagcctgatgtgtggaagggaggacaggctggaaaagccagatgaggccggtgtgggtttcccagaccccagttcatcacatctggatgatgggcttagccacccccacgctgggccggaagatgctgtatttaagaggcagagttgcagagtgagattgctgggcatttgacaggtcttgaaaacctgctgaattacaggcttgcaaacgattttattggctgatagcttcccttttctctctctccacatagactgaaatctcttcgaagccagacacagcatcttgtactgtggtacggtggtacctctaggttcctggcacgcagcctgacacatacgaagggccccttagaatttggttgcatagctgatgaaagcagccagcgtctgtcagcatgtctggtgtgccagggcccgcaggacatgcagtgtgttccttagcttatttaaactttaccaccgcgttacaagggaagtagtatccttattcccattttacagataaggaggctgaggtccagagaggctaagaaaccaggtcagacagaaagctgtggggtgtggagagcggccaaaggggcctgggggaggggctctgttggggcatggtggagatggaggtagtgagaagagggcccaggagagggtgcagagggtcaattctgggaagggagagggggcttcctgcgctgggctggtgaggccatacaagcagtggaagcagtccctgatggggtacccggaggactccccactcctgtgcccagacacctcaaagtctctcccaagagtcaagctgcatccccctccagcttcccctcctcctaaagtccagttcctgggacaggacaatgtcgtgaggcaggcgtctcaggggccagctgcctcctaaggtggaggtcagggaaggaagaggcctgcaagggccctgacccccagagggtcactggcctcagcccaccctgacaaagacgcagactgactcagcttcctcccagcatctccgcaggcacgttcgccaggtcattcacccccagcccactgagaggccttgggtttaattacccaaagccctgaactttagacttcccagagctgacaacagggcgctggggatgttcttagaaacttcaggacacagtggggaatggcaggaaaggtgaaagggcaggagggagccggggggggctgcggttgggctgagacgggtgcttccccactgggcagcagagactgggagaccccaggagagaccggcagggtgtcagtgagggaagggggcttctgccccacccaaggtctctacggggttgtcttctgtacagtgtggcccgggatccagccagcgggaggccctgcctggaggccggcccatccccagctaaggcttggtcagagaggatgagctgtggccgccagggtctcctcttggcagttggggcctgccagctctcagaaactgattttagaaccaaaaagaataagtccttctgaatttcatttctttggcctattttttcccacaaaattatatgatagcatcatctgacacttattgagacagaggagggatgggactcggctgccaactccactaatgcattcgctaatgcattcccccccccaacatttttctttcttcctttttttttcttacctgctcattgaaggacagtgaaagcattaagataagcagcattccactgtaaatcttacacaaaatgccacatccactgatcacacgaccttgaaaaatgaagataggcagcgtcgcacttccaatcttgtacttcagggaatgaactccattgcctttgtgtgcaggaagccggaagcacgaccactctttaccctcggcctcattacaagaccaagacctctgcctcggcgcggcagctctcacctggaatcccagcactttgggaggccgaagcggacggatcacct

SEQ ID NO: 624 - DNA, 43657 bp, Homo sapiens
gtagggcggatctcgcagctacggcgttcttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggtacggatgccgggaaggggagaaagaaaggcggaaggggtcgttaatagctgaggcgaggtgcggagtcgtggagggggcttaggaagtgaccagcgggtaggtgccgaagctgaggagggtataggggccgggaaggagccacaggagttgaggggaccgaggaatgaaggtggcagaggaacgtaggggacaacagcctggagggatgtatggagattgagatggacaggaggtggccaagaggtcacggccgttgactgaacggagtctgaaaggaggcggagggcatgaggggcaagagcctggcgggagtcgcgggatgtaggtcggaatggagttgagtcttgctgttcccaggagtcgcgtttctgtgcgcgttttgggagacagtagtgggcgggaggcatggaagttccaagggttggtgaagatggttgagttgctgttatgtcctttctcaggagacgattgcctcgagctggagagttccatggctgagagtaggctccgggccccggacctaggtgggtaacaggacagaactagggacgtgaggtgaaaattgccccagggtctcttggagaagaccgaaaaatgttccccctgttggagttttcgatcactcagtgtttttatgtacttatttattcattttatttattgggatggggtcttgctgtgttggccaagctggtctcaaactcctggcctcaagcagttctcctgcctaggcctcccaaaatgctgggattacaggtgtgagccacttcaccaggcccacttagtggttttatgtgtgtgtgtgtatggacgcagcatcatagaccgttttgggattcatgataaaggtcaagtaagagtcatattatgaacaagattaacagacagatgtggagtcaggatagagtgacttattaaatatataaattaatacattcatagttgtttacaataaaatccttaagttaaacactgctacctaattaggtaagtattttagcacatggcacttccctccgtactgcccctttagttaatatcatctagttggccgggcgcggctgctcacgcctgtaatcccagcactttgggaggccaaggcgggcggatcacgaggtcaggagattgagaccatcctggctaacacagtgaaaccccatctctactaaaaatacaaaaaattaggcgggcgtggtgaggcgtgcctgtagtcccagctactcaggaggctgaggcaggaaaattgattgaacccaggaggcggaggttgcagcgagccgagattgcgccactgcactccaacctgggcgaccgagcgagactccgtctcaaaaaaaagaaaaaaaaaataccgtctacttttacttctggattgttaacagatatgccatcggcttgttgccttttaaacagtaatccacttcatttactgagttattcattcttcccatctcttgttggttttttttcccccttctgtttctctggagaacttcaagagtgttttcaaaaggaggctttgtgtgataaactaagaatatatttatttcagccttgtagtaaaatttaagtcaattttttttccttcaacacattgaaaaattacagtattttctccttgttttcttcagcatttcttttttattcttgctgctttgtaagtgacctccttttctcattagatgttttagattatgtgaacctatggattatattgatgaaagaaaaaaatgttttattttatttattttgaggtcttgcacccaggctggagtgcagtggagcaatcatggctcactgcaggtttggcctcaccgggatcaagtgatcctcccacctcagactcccaggtagctgggactgcaggcactcaacaccacgcccagctaatttttttttgttgtttgttttgtagagacgaggttttgccatgttgcccaggccggtcttcaactcctgggctcaagcgatcaccctcctcagcttcccaaagtgttgggattacaggagtgagccactgcacccagcccaatattttagattatacatttttatatttgttcttaaaatttactataagatgataatgtgtggattttagagggtttttattttcgtttttattccagtttgatttttttttttttttttttttttttttgagacagagtctcgctttgtcgcccaggctggagtgcagtggcaccatctcggctcactgcaacctctgcctccagaattcaagcaattcttttgcctcagtctcctgagtagctgggattacaggagcacgccaccatgcccggctaatttttgtattttcactagagacagggttccaccatgttggtcaggctagtcttgaactcccgacctcatgatccacctgcttcagcctcccaaaatactgggattataggcgtgagccaccacacctggcctccagattgattctttaaatttttttaaattattattttattttagagacaagaacttgctctgttacccaggctagagtacagtggcacaatcatagctcactgcagcctcaaagccctgggtgcaagcaattctcctgcctcagtctcccaatctcctgcctcagtctcccaagtagctatgtcttcaggtgcatgtctccacacctggcttcctgtttgattcttgacatagcttaaaaggcaggccatgtgtggtggctcacacttgtaatcccagcactttgggaggccaaggcaggcggatcacctgagatcaggagttcaagaccagcctgggcaacgtggtgaaaccctgtctctactaaaaatacaaaaaacagagccgggcgtggtagctgacacctgtaatcccagcactttgggaggccgaggcagggggatcacgaggtcaggagattgagaccatggtgaaaccccatctctactaaaaatacaaaaaattagccgggcgtggtggcaggcacctgtagtcccagctactcgggaggctgaggcaggagaatggcgtgaacccgggaggcggagcttgcagtgagcaaaattgcaccactgcactccagcctgggcgacagagcaagactctgtctcaaaaaaaaaaaaaattagctggcgtggtggcaggctcctataatcccagctacttgggaggctgaagcaggagaattgcttgaacccaggaggtggaggttgcagtgagccgagactgtgccattgcactccagcctgggcaacaagaatgaaactccatctcaaaaaagaaaaaaaaaaaaaagccaaagtttctcacaaaaaacaggaggcatgagagttaatcccctttcaggctgtctgattcccacttcctaagaaacagccatttacagcttttaactatttcttctagaagctaccaccttatttctgtaataatatgctcatactgttttaattgttttccattttgaattatgtcttctttttttttttttttttttttttgagacggtctcactctcatcaggctggagtgcagtggcacaatcatctcggctcactgcaacctctgcctcctgggttcaagcgattctcctgcctcagcctcccaagtagctgggactacaggcacgtgccaccatgactggctaattttttgtctttttagtagagatggggtttcactgtgttagctaggatggtcttgatctcctggtctcgtgatccacccgtctcagactcccaaagtgctgggattacaggcatgagccaccacgcccagccaaattttttgtatttttagtagagatggggttttaccatgttagccaggatggtctcgattgcctgacctcacgatctgccctcctcagcctcccaaagtgctgggattacaggtgtgagccaccacacccggcctgtcttcttttttttttatagagatggggtctcactgtgttgcccaggctggtcttgaactcttgggctcaagtgatctgcccacctcggcctcccaaagtgatggaattacaggcgtgagccaccatgcccagtcaattttgaattatatctattgactgtcttctatggacaataaagattttttctgtcctaccacttctctgcaccacacacaaacgcacatgcatttcccacctttccttttatctccccagtatatatgtagtaattttgatttagtcatttgtattgactttttttttttttttttttttttgagacagagtcttgctctgtcgcccaggctggagtgcagtggcgtgatctgggctcactacaagctccgcctcccgggttcatgccattcttctgcctcagcctctggagtcgctgggactacaggcacccacgaccaggcccggctaattttttggttttttttagtagagatggggtttcactgtgttagcctgtatggtcttcatctcctgacctcgtgatccacctgcctccgcctcccaaagtgctgggattacaggtgtgagccaccacgccccgccgacattattttcattatgtaaacattattcggccgggcgcggtggctcatacctgtaatcccagcactttgggaggctgaggcaggtggattacctgaggttaggagtttgagaccagcctggccaacatggtgaaaccctgtctctactaaaaatacaaaaatcagtaggatgtcgtgcacgcttgtaatcccagctacttgggagactgaggcaggagaatcacttgaacccgggaggcagaggtgtagtgagccgagatcatgccgctgcactccagcttgggcgacagagaaagattccgtctcaaaaaaacaaacaaacaaaacattattcatcactgagctatataataagctaggagattttctttgtttttttatgtatggatcactaattcaggtccaaactcttcaccagagtatgggccttctctcaatactttcaagctcatcagaggatctgtcaatttgtcttggagacatagcgttttagtactccagtctggcctggctgtgtactaggcctattgcactgatttcatcctccgatctcccctcgttattctgtggaattctttttgcctctttcctgtgttggatctcctgtattttaaattctatattttttacaccatggaatactacttagccataaaaaggaacaaaataagttctgcagcaacttggatggagctggaggccattactgtaagtgaagtaactcaggaatggaaaaccaaataccatttagttttcacttgtaagtgggagctaagctgtgaggatgcaaagacatgcaaagtcatataatggactttggggatttgatgagggggaaggttaggagaggggtgagggataaaagattacatattgggtacagtgtacattgcttgggtgacaggtgcactaaaatctcataattcactgtagaactcatccaggtaaccaaaaactacctgtaccccagaagctattgaaataaataatacttttgaaaatgaagtataagtttggggagccccacagcaatatttggctttcctgaaattctgtataaatttagacaagactatctcaacatttatccatctatatgccgatgtggtaacagtctctgtatgttttttgtgtttgtttttaactttcactaaacaagtaagaggtatccttcattccatttctaccccttactaacagtatgatcttgggcatacaagatttctctgtgcctcagtttcctgtaactgtaattattataactgtaaaacaggtataataattttatcttctttatagacctgttgagaatgtattgtgcatagcgatatatatttgctatttctattgctattattgtcaaaaattattaaattttgatttttttgtagaagtggagtctcactttgttgcccaggctggtcttgaagtcctgagctcaagtgatcctcccaccttgatctcccaaagtgctgggattacagatgtgagctaccatgcccagcttattattattattttttttaatgggcagcccccaaaccagaataggttcagagaggctcccataggaaggcttttacattagctggtctccaatattggctacaatgtaagtcaaatcctgtctttctcttcagtattctgaaattccatgacagtgtgtcttgatgtgggacttttttcatttatggagcaggtacctttcaatctgtaacatcattttctttagttctgggaaatttttagcattatttctataatatttctcccttctattttctcttttctctttctggaacttttattgtttggatattagatctcatagattcttcctttgattttcttgtggatttttgtttgtttgtttttgagacggagttttgctcttgttgcccaggctggaatgcaatggtgcaatctcagctcactgcaacctctgactcccaagttcaagtgattctccagtctcagcctcctaagtagctgggattacaggcacccgccacctggctaattttttgtatttttagtagaaatggggtttcaccatgttagccaggctggtctcaaactcctgacctcaggtgatccacccatctcagcctcccaaagtgctgggattacaggtgtgagccaccacacccggccagttttcttgtttttctctcccattttgcatctgtctttcattctgttctctagaaaatttccacaacttaatctccaattttcgttgaatttttaatttctataacatttataaatttccaagagctttttcttttctgtgtgtttcttttcttacagtgtcttgttgtgcttaatggatataatgtattccctttcctctccctggttgttaattgtactgtttttgtttctttttagttttcttctgcttcctacattatgtctatttcctcttcttttttctgtttgttagcctaatttctttctttctttcttttttttttttttttttttttttttttgaggcagagtcttgctctgtctcccaggctggagtgcaatggcgcgatctcagctcaatgcaacctccccctcccaggttcaagcaattctcttgcctcagcttcccaagtagctaggaccacaggtgcatgccaccacacctggctaattgtttgtatttttggtagagacggggtttcaccatgttggccaggctggtcttaaactcccgatctgaggtaatccacccgcctcggcctcccaaagtgctgggattacaaacgtgagccaccacacccagtctagcctaatttcttgttagaaacttcctttaaatgtctgatgatctttgtttacctattcatatttaagagtgaggagaaggggttgtcaacttgatagacttcattgtaagctgggacctggcaattttgtgggggagggacctcagttgtcactagtttgtatgtttttgtcttgagctagtcagttcgctagagaagagtcctccaaacctctctctggtaagtataagcttgtcagcattctgggagctcactggggcaacagatctgtaggtcttactgttcagtatacagatattcttttgatcccctatgttttcactggggctttatctttgctttcacctgtgcccaatgttcctctagtccagggattttttcagccccaagactattgacattttgagccaagtaattctttgttttctgaggttgtcctgtgctttgtaagatactaagtggcatccctggcctccacccgctagatgccaggagcacacccacttcccagttgtgccagccaaaaacatttccagaggttgccaagtatcccctgaggggaaaaatctccccagttaagaaccacggctctagtcttctgctggggtgggagagggttctgagagtctattccttttaaagtctttcaaataattggtattttagcctactgtttcattctagcattctactctgtatggtccctctgattgggcctttcagctctaatcagcttgcttcttgttggcttaggatttagccttctcttatctcctgtctgtttttcactcacccatctaatttccagcgtccaacattttgtagcatctcttgcctgttgtcttcttgccagtttctttatctatttttattctttttctgtcactttagtgagatttggagagagaacagaagttcttgtattcatcttccacatttatgcagaagcctggatcattatttcttcaaatattttcttctctccattgtttttccccctttgcaactcttctggtgttgttgacatttctatccctatcctctgcatttcttaaattctctgatgtccatttatttatctctttgtgataccttctgaaagagttactcaacctaatttaccagctcacactgttctatttagctcatctattgatgtggatagatcttttcgtttttaattttaaaataatttcacagttataaaaaaatttcaaaaatagtcaaaggttcctactctttacccagcttccccaaatattaacatctatgtaataatagtacaattaaaaaaatccaggctgggcgtggtggctcacgcctgtaatcccagcactttgggaggccaaggcaggggaatcatttgaagctaggatttcgagaccagcctggccaacatggtgaaaccctgtctctactaaaaatacaaaaaaattagctggatgtagtggcaggcacctgtaatcccagctacttggaaggctgaggcaggagaatcacttgaatccgggaggcagaggttggactgagccgagatcgtgccactgcactctagcctgggtacaaagcaagacctggtctcaaaaaaaaaaaaaaaaaatccagggggctaggcgtgttggctcatgcttgtaatcccagcactttgggaggctgaggtgagaagatcacttgagcccaggagttcaagaccagaatgggcaacatagtgagatcttgtctctacagaaaatcaaaaaaattcgccaggtatggtggtgcgtgacatggtggtgcatgtgatcccagctactcaggaggctcagggggaggatcccttgagcccaggaggtcaaggctgcagtgagccatgatcacaccactgcactctagcctgagtgacagagtgagatcctgtctcaaaaaaaagaaagaaaagaaaatccggaaattaatgttgatattattaactaatctatagatctcattcacattttaccaattatcccccaatgttcttgtcctggtttaagattacatgttgcagctgggcacgatggctcatgcctgtaatcccagcactttgggaggccgaggcgggcggatcatgagttcaagagatcaagaccatcctggccaacatggctgtctctactaaaaatacaaaaattagctgggcatggtggtgtgcgcctgtagtcccagctacttgggaggctgaggcaggagaatcgcttgaacctgggaggcagaggttgcagtgagccgagatcgcaccactgcactccagcctggacgacagagcaagactctatctcaaaaaaaaaaaaaaaaaggttacatattgcctttaattatatctcgttagtctcctcctgagaggaggtcctcattctttctttgtctttgatgacctcagtacttttgaagtcacctctaaatttgggtttgtttggtacgtccacatgattgaattcagctaaagcatttttggcacagaagtgatgttatcccctctccagtatgttatcaggaggcacatgatgaagataagataaatctcattaacttcgatcccttgattaaaagtggtgtctgctaggtttttccactgaaaagttactgttttaccttctgtaattaataactatcttacaggaagatactttgagactgtgcaaatactgaaatttaaattgtttttcttttagagctggctttggtgccgcatgcctgtaatcccagctactcgaggctcaggcagaagaatcacttcaacccgggagacagaggttgtagtgagccaagatcgcgccactgcactccagcctgggtgacagagtgagactccgtctcaaaataaataaatttttttttttttgagacggagtcttgttctgttgccagactagagtgcagtggcgcgatcttggctcactgaaacctccaactccctggcttaagcaattctcctgcctcagcctcccaagtagctgggattacaggcacgtgccaccatgcccagctaatttttgtatttttagtagagacagggtttcaccatgttggccaggatgctcttgatctcctgacctcattgtccatccgcctcggcctcccaaagtgctaggattacaagcatgagccaccacgcctgtcctattttttttttcttaacagcttttttgagttatagttcacacaccacacaattcatccatataaagcgtacaattcagtgacttagtatgttcacagaattgggcaaccatcaccacaatcaatttagagcacttttctcactccaaaaaagaatacccattagcagccactcacaaatttctcctgactccccagccctagtcatctgctaatgtactttctgtttctataaatttgcctcttctggacatttcatataaatagagtcataaaatgtgtagtcttttgtgactgatttctttcacttagcataatgcttttgcagtttatccatgtggtgccatgtgtcagtacatcattcctttttattgttgagtagtgttccattatatggatataccacattttgtttatccattcatcaaatggacatatgagtttccactttttttttaagagacacaaacaaaatgttattaggttcttaagaaattcagaacaccaatttgtgaggataaattccattcgttagggcagacacagatcacaggtagccctggagctgaggaaagctttgatttttttctaaaacatgtgagtccacagctttctgataagtcttgcgctgctctgtaatctatttctctttttctgtgtcaaaggtctcaccttcctggtgtttaggcttccacaccttcttaaagtaagcaccagtaagacgttttgcaatttttacattgctgctaccaattttggttgaggtagcaatgacaaatttctggtgtgttcttcgtagaggaacttgattgaggaccagaggtccagtcccaagaccagctgcttcaggaaaaccaccctcgcctctgtggcgcccagtggtgatgatcagaatcgtcctggaggtgatgctggatcgcagttttctcacatgctgactgaagggtttcttttgccatggctcaacagctttagaggcacatcttcagtagggtaatatctaggcattttgtgaagtttaaccacctgggtaccactgttcttgtcaacaccaactggttttgtaacagttgcaagaaacttctttttcttttcaaccttggatttagcagctgagtacttcttcctggacgtggtctttctggaatacatagcagatcgggaatatctgcaattcctctgacaaggacaggattgcagctgcaatggggcttccctgtcttagacgttttagccttgaggttgccccttttcaccttgccaccaacatcagctttcttggccttaggtttcttctctttagtatctggcttctcagctttctcacccatcatcttgcaagatgggaaagactccactttttggctatatgattaatattgctataagcattcatttacaagttttcatgtggctgtgttttcatttctcaaggatatacctaggagtaaaattgctgggtcatacggtaactctgtgtttaaccttttgagaaactaacacatggttttccaatgtgactgcacgattccacattccctccagaagtatatgagggttccagtttctcatatcctcaccaacacttgctattatctggcttttttttttttttaagtcaatctcgcttggtttcccaggcttgaatgcagtagtgtaatcttaactcttaactcactgtaacctccacctcctgggttcaaacaattctcctgcctcagcctcccgagtagctgggattacaggcgtgaaccaccacgcccggttattttttgtatttttagtggagacggggtttcaccatgttggccaggctggtctcgaagtccttatctcaagtgatccacctgcctcagcctcccaaagtactgggatacaggtgtgaaacacagcacctggccaagattttaaaaatactatgtttttcatgtccattatctccaactaattcttccccccccctccccttttttgcgacagaatctccctctgttacccagactggagtgcagtggcatgatctcagctcactgcaacatctgtctcccaggatcatgcaattcttgtgcctcagccacccaagtagctgggattacaggtgtgtaccaccatgcccagctaatttttctatttttagtagaggcagggttttgccatgttgcccaggctggtctcgaactcctggcctcaagtaatgtgcccacctcggcttcccagagtgctgggattacaggtatgagccactgtgcccggcctaattcttttctttaactgctgttcctgctttatgttttcctgtatcctccctagcctttttgaggatatttattatacttcaatggtttttctttttcctatctggttcattattatgacagatagacaatctataccagataaagtttctttggtagtacttgctttcttcagttgcctcatgttttcttatacacaaatatccctttgggacattagccactctgattggtaacgtgctgctcgaaggaagatcaaaagcttatgccctatctcgtgtgtccctccgctgagtttagggattggaggttgcatagaagaggaaacaaccctggccaggcatggtggctcgcgcctgtaatcccagcactttgggaggccgaggcgagcagatcacctgaggtcgggagtttgtgaccagcctgaccaacatggagaaaccctgactctactaaaaatacaaaattagccaggcatggtggtgcatgcctgtaatcccagctactggggaggctgaggcaagtgaatcgcttgaacctggaagaaggaggttgcgataagccgagatcgcgccattgcactccagcctgggcaacaagagcgaaactccgtttcaaaagggaaaaaaaaaaaaggaaacgaccccactatggtgcaaagcccctggaatatgggctcattcactctccatttgcagcagcattctgtgctctccaacacacacacacactttgtcttgttgtttttcaagagctgtctttttgagttataattacctaagttaccaaatgcagaggttgggaagtaggcccattcaggagccaacaagttcactgtccccttttcctcttatctgtctcgaatacacatgcatattcgccctaagctaggcggcaacactgccatgatgttaccctgctgactctggttaggggctgggcactggcaacagggcaggcagtgactcactcagcacagctagaaagcatcctcctgcctggcacccccgtgtgaatctcggccctcttttccctagtttactattcactgcagccccccaatgtctggtttggggatctgtctaatttctttttacttaaatggcttccctagatttagattctaaggaagaagtgaagaagtcagcaagccttgtttgcttattatcttgtttggaaggttccaatttcaccacatctgagcttctgagggtaagggcattggcttcacagctgtctgtgtgtgcccagggtctagtctgtgctattatagcacacagactgagctgtcagtgagggccacctggcttcaggactctcttttcaaacttcttactttgctcctctttattgttttctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaggtaacctgctcttctcctgcgatgccatgtgcctttgcaggcttagagcaggagttggatggggattatatctatggtttccaagtattttcttttttgagacagagtcttgctctataacccaggctggagtgcagtggcatgatctcagctcactgcaacctctgcctcccgggttcaagcaattctcctgcctcaacctcccaggtagctgagatgacaggcacacaccaccacgtctggctaattttttgtattttagtagagatggggtttcaccttgttggccagggtggtcttgaactcctgacctcatgatctgccaacctcggcttcccaaagtgctgggattacaggcgtgagccaccacacccagcagtttccaggtattttcagcggtctcactacatttccgaaagcaattttaaatataaaccatttttttggccaggcgcagtggctcacacctgtaatcccagcactctgggaggccaaggcaggtggattacttgacgtcaggagttagggactaactaccctggcctaaatgacaaaaccctgtctctactaaaaataatgaaaattagccaggcatcatagtgggcacctatagtcccagctgctcaggaggctaaggcaggaggattgtttggacctgggaggcggagtttgcagtaagccgagattgtaccactgcactccagcctgggagacagagtgagactctgtataaaaaaaaaaaaatgataaataaataaccttcaaaaaataaagataaatctttttccttattagaaacttaggctgggcacagtggctcatgactgtcctcccagcacttcgggaggctgaggaggacagatcacttgagtccaggagttcaagatcagcctggcaacatggcgagagcccgtctctacaaaacatacaaaaaattaagcgggtgtggtggtgcatgactgtagttgggaggctgaggtaggaggatcacttgagcccaaaaggcggaggttacagtgagctgaagtcgaggtcttgcaccactgcattccagcctgggcaacagagtgagaccttgtctcaaaaaaaggctgggtgcggtggctcacacctgtaatcctagcactttgggaggccgagccaggtggatctcttgagcccaggagtttagatcaccctggccaacatggcaaaaccctgtctctactaaaaatacaaaaattagccaggtacagtggcacatgcctgtagtctccgttactcagtaggctgaggcatgagactcgcttgagccccgggaggcagtccagctagggtgacacagcatgaccctgtctcaaaaaaaaagagaaactttttttttttttctgagacagtgtctcgctctgtcacccaggctggagtgcagcggcgccatctcagctcactgaaagctctgcctcacgggttcatgccattctcctgcctcagcctcccaagtagctgggactacaggcgcctatcaccacgcccggctaattttttttgtatttttagtagagacgaggtttcaccgtgttagccaggatggtcttgatctcctgacctcgtgatcctcccgccttggcctcccaaagtgctgggattataggcgtgagccaccatgcccagccaaaaaaaaggaaacttaatggccagttgtggtggctcatacctgtgatctcaacactttgggaggctgaggtgggaggattgctggagtccaggagtttgagaccagcctgggcaacatagtgagacctcatctctacgaaaaataaaattatagctgccgggcacggtggcttactcctgtaatcccggcactttgggaggcccaggtgggcagatcacctaaggtcaggagtttgagaccagcctgaccaacatggagaaaccctgtctctactaaaaatacaaaattagccgggtgtggcggcacatgcctgtaatcccaactatgcaggaggctgaggcaggagaatcacttaaactcaggtggcagaggttgcggtgagtcgagatcacgccattgcactccagcctgggcaacaagagcaagactccatctcaaaaaaaaaaaaaaaaaaaaaaacattagctgggggcagtggcacatgcctgtagtccagctactcaggaggctaagctgggaggattatctgagctcaggagtttgaggctatagtgagctatgattgcaccactacactccagcctggatgacagagcaagaccatgtctcaaaaataatgttaaaataaacaaacatattatctgttcactctagaaattttagagaacatggaactactccaagtgacaaccagcatttttaagtatttttctttcctcccttcctctcataatggcttaatttagatataattcacatgtcataaaattcatccgtttaaagtacacagctcagtggtttttagtatattcacagaaatgtgtaagttgtatgatcgcatagtcaattgtagaacattttcatcaccccaaaaaggaaaccctgtacccattatcagtcactccctatatgcttgggcaactccctatatccttgatactcctagcccttggtaatgcccatctaccttctgcctccatcctgcctttgtttttttgtgcttcttttttttttttttttttttaagagggggccacactcagtcacagaggctagaatgcaggagcgcggtcatggctcactacagcttcaacctccccagactcaggtgatcctcccgcctcagtctccctgtagctgggactacaggtgctcgccaccatgccctgctcatttttgtattttttgtggaggcagagtgtcgccatgttgccccagactggtcacgacctcctggattcaagtaatcctcccacctcagcctcccaaagtactgggattacaggcctgaggcactgctactggccctttttctttcttttttttgagacggagtcttgctcttgttgcccaggctggagtgcaatggtgcgatctcagctcactgcaacctccacctcccgggttcaagcaattctcctgcctcagcctcccaagtagctgcaattacaggcatgcacctccatgcctggctaattttgtatttttagtggagacggggtttctccatgttggttaggctggtctcgaacttctgacctcaggtgaaccacccacctcagcctcccaaagtgctgggattacaggtgtgagccatcgcacccggcccttttttatttatttatttatttatttatttatttatttatttatttttgccttacccagttgcctgcaagagggagctgagggcaaggctgggaggggcagggcaatgcttattttttttctagctatgatcatgagtactttttttttaattttagagacagggtctcgctgtgttggtcagattggtcttttactcttggcgtcaagcaatccccccacctcagcctcccaaaatgttaggattacaggcatgagccacagcatccagctggcgttagtacatttttattatcaattttttacccataaccttaaagcgttagcacttttctaccattattgcccttcatatgcatcatttgcggtgggaatataatattcttttgagtggattattaatttacttaactgttgctctgtggacatttagactcttaataatttttagcatttagaaataacacaggtgaacaactttgagtaaaaagcatttgctatatttgattccattaaaatatttttaggggctaggcacagtggctcacacttgtaatcccagcactttgggaggccgaggcgggcggatcacttaaggccaagagttcaaggccagcctggccaacatggtgaaacaccatctgtactgaaaatacaacaattagctgcgtgtggtggtatgcgcctgtaatcccagctactcgggaggctgaggcaggagaattgcttgaaaccgggaggtggaggttgcagtgagccaagatcgtgcctctgcactccagcctgggcaacaaagcaagactccatctcaaaaaaaaaaaaaaaaaaaaaaaaccatatatatatttaggctaggctcagtggctcgtgcctgtaatcccactttgggaggctgaggtgggcagatcacctgaggtcaggagttctacaccagcctggccaacatgatgaaaccttgtctctactaaaaatataaaaaaattagcagggcatggtagcacgcacttgtagtcccagctactcgggaggctgaggcacaacaatcgcttggacccgggaggcagaggttctagtgagccaaaattgtgccattgcactccagcccgggcaacagagcaagactctgtctcaaaaagaaaaaaaaaagaaaacagcatgatagtgcttgacccaaaagagactaataactggggaaactggatgaatagggcttggaatggagaggctctttgctgtcaaacccagaaactcaggactgcagaaactcagtggtgaggatggatagaatgaggattatataaccaaactggcccataattacattttgaacttttagtcctttctgtcatttagcctttgctatgtaaaacaccaaccctacttgggcttaaagcaacaatttattttctatttatttatttatttttagacaaagttttgctcttgatgcccaggctggagtgcaatggtgcgatcttggctcactgcaacctccaattcccaggtgcaagcgattctccttcctcagcctccagagtagctgggtttacaggtgcctgccaccatgcccgggtaatttttttttttttttttttttttttgtacttttagtgaagacgaagtttcaccatgttggccaggctggtctcaaactcctgacctcaggtgatccacctgccttggcctcccaaagtgctaggattacaggcatgagccaccacacctggccaaaacaacaatttattatttctcattatgctgtgggttggctgggtggtttatctggtggtttcagcagggctcactcctgaggctggattcagctggacggtcacctgggctggaaagaccaagatggcctcactcacacatctggcactctgtgtcagttatcataactatatgcaataagctaaactagctgatttaacatggtggtctcaaggccaccttcccagaaagtgaggcaggaagctaaggcctctgaggcctaggctccagaactcacacatcataatttccacatgttctattggtccaatcgagtcagattgaagggcataaaaaagtaggtcccacctcctaatggcaggaagagcaaagtcatattgcaaaggagtgggtatactgggatgggaggaggaatatatggtcattaacaatctcctatatttatataggataatcattgattgccctactcctaccctctagcatttgcttttgctgtattaaaaaaggtagatgcagccaggcacggtggctcacacctgtaatcccagcactttgggagtccaaggcgggcagatcacaaggttaagagatcgagaccatcctggccaacatggtgaaaccccatctctactaaaattacaaaaattagctgggcgtggtggcatgcgcctgtagtctcagctattcgggaggctgatgtaggagaattgcttgaacctgggaggcggaggttgcagtgagctgagatcgcatgactgcactccagcctggtgacaaaaaaaaggtagatgtgatcagacacggtggctcacacctgtaatcccaacactttgggaggccaaggtgggcagatcacttgaggtcaggagttccagaccagcctggccaacatggtgaaaccccatctcttctaaaaatacaaaaattagccagtgtggtgggacacacctgttgtcccagctacttgggaggctgaggcaggagaattgcttgaacccgggaggtggagattagagtgagccgagatcatgccactgcactacagcctgggagacaaagtgagaccttgtctcaaaaaaagaaaagaaaagaaaaaaaaaggtaaatgtaatccttcaattcataactaatttttttaatagtggtaaagtgtatataacataaaataagccattttagcctttttttttcttttttttttagagacaggatttcactccccaagctggagtgtagtagtgtagtcatagctcactgcatcactgaactactgggctcaagtgatgctcctgcctcagactcccaagtagctaggactataggtgcatgtaacaacacccagctaattaaaaaaaaaaaaaattttagagacaggatcttactatgttgcccaggcaggtcttgaactcctgacctcaattgatcctcccacctcagcctcctacagtgctaggattacaggtatcagccaccacacctggtccccagtgtgtcttacacagaaaaatcacagcttacacaatctagtcttaatcctttccagctctttcagtgtgttcttgctgcatgcaaactcaaactgctcatagaactcaaagcccgcagccttctgccactgggtcaggggcagcagtcctgtagacaaaacctgtaatacacatacacacacacacacacacacacacacacacacacacacacacaccccattagatttcaggatgatgtcttcttaggaacttggtatgaaactgcatttagtctatttaaagacattgattctggaactcctggcagccaagatttccttctccagcctctttatattgacaattctgcatttgctttttggttttcagccacctctgtgatctggtttcaggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtaagaacctcatgtaggaaaggtatgctgtgtaaacaaaggaagtaggctttggtgagccttttaaggcagtctctggttttaatttcatctggattaatttaatctctcatttgaattcagggactgagaatattttatcatagctctggatctaaacacctcagcaacatactatcccccatgctacccttttatgccttatgtcagtttttacgggacttgaaagtcagaggtttagaaaccagaggagagtcttcataaaccagagaagacgtgttgggattggtctgcgcttgggcaggagtaccctgagtaggcagccattcccttcttccttgcttgcatgtatgaagggccaagagtttggacaatacacatgttatgtctttgatttaaaatggaatatggcttttcccctctaggcttgcattcttattttgtctaacatattaatattaaaatgtccatgaacatacactgttggcattgtgatgacagatgggacttcctacgagcaaaaatttctaaagtgaaacatttgctttcattatctcctggagggtgcagagactcttaaagagggtctcaggacatttgtaacaattggatctcagtgaattcagagtgcccttctctccaccaggttcaggctgccacctcagggtgacctaaatttcctgtggctttacctttacctcctaaacgttttctaggctctcatttctaccaatcctcagttgtcactgctcccagctttccgagggacataaccccaagacataacccctcaccagctcctgtgtaaacatctttcagtgcacaggtggcctaacagcagacctcactgctcttctgtccctgtcaggtgcctctaagcagagggaaggagctgctgcagaaggctatcagaaaccaggtgagctggggcaagatgggacagagccggtggtctccagcatagggagggatttcactcttcttcccaggttcttctgaagcacccacacaaaatgcacactctgcgatatgtagtattgtcattatttccttcttctacatcaggtagtggaggctcagacaagttatttagccattcacctagagagtaagtgttgaagccagagccacctccaactctggagcctaccaagagaactgtggggatgtgggatgtggcgggacagggttgctgggtacagaagccagacttcttttacaagtaactctaggctgggtgtggtggctcacgcctataatcccagcactttgggaggctgaggtgggtggaccacttgaggccaggagttcaagaccagcttggccaacatggcgaaaccccatctctaccgaaaaattagcagggtgtggtggcacgcacctgtagtccccgctacgcaggtggctgaagcagaagaatcacttgaacctgagaggtggaggttgcagtgagccgagattgtgccactgcactccagcctgggcgatagagctagactctgtctcaaaaaaaaaacaaaaaacaagtaactctttattccttgtgtgaaaatccagggctgttaaagtttagtggcaggaggaggagttaaggtgatcttgtgagaagagtcatgctggtgacatcaggaggggtacatggctgtgatgggggaggtggtgctgctggactgagccagtggagggggaagatctgcagctagcatagtttcatgctcagtgaggatgatggtcaccgtgtttgttgtgtacttactgtgctgagagctttcctcgcagaggccctcccaacgaacagctctctcagaagcatctgttccttcctggtcacgaggtggccagagcacaatgtataggcagaccagtggtccttcctctcccaatgtggccatgtggaggacaggatgtcttcctgggggttgggatggactctctgggcactgtactctctctcctacctgcctccctgcagtccctcccatggatgactcaggcctcccagaagcaatttctatctgtccccttcactttcaggccttggggagtctctgctcctacctgactctgtgttgtaatttcaggggagcatcagtggaggaggcagtgggggcagcagcagcctcctgaccaatgcccgctcttggggagtgaggattctgcacgtggatggtaccctttctgtgctgggctcctgtggagggagaattggtgactttgaccaggagtgtcagcttttagaaggatcatggtcatgtgagcttctggtcaccggaagccagaaatactcagctgccatgttgatccacaaaggtgggaggatgtggggaagggggaaagcggtgaggacgcagagtgcaggctgtggcctcggcatcccgcaggaggtccctagaacatgccgtttcatgtcacctgctacagctctcccccagctagtatgatgatcctgttttacaaatgcagaaatgatcttaatattcatgaccactggccaggcgaggtggctcacacctgtaatcccagcactttgggaggccaaggcgggtggatcacaaggtcaagagttcgagaccagcctgaccaacgtggtgaaaccccgtctctactaaaaatagaagcattagccgagcctggtggtgcgtgcctgtaatcccagctactcaggaggctgaggcaggagaatcacttgaacccaggaggcagaggttgcagtcagccaagatcatgctactgcactccagcctgggtgacagagcgagactccgtctcaaaaaaaaaaaaaaattcggccaggtgcggtggctcacgcttgtaatcccagcactttgggaggccgaggcaggcagatcacgaggtcaggatatcgagaccatcctggctaacacggtgaaaccccttttctactaaaaatacaaaaaatcagccgggcgtggtggcgggcgcctgtagtcccagctactcgggaggctgaggcaggagaatggcgtgaacctgggaggcggagcttgcagtgagccgagattgcgccactgcactccagcctgggcgacagagcgagactccgtctcaaaaaaaaaaaaaaaaattcatggccacctaacaggtattgactctgtgctacgaattacctcatttaatcctcactacagtcctgtccccattatacagatgaggaaattgagcctcaaagggattaggcaaattgtccatggtctcaccagagtgtgtagtgtggcccaccactctcagttttactcagctgtaaattttgtgctccttcttttttcacactgtaaacaacctgtttgcagcctgtttacactagaatagttgtcttgaaccaggtggcagtgagtggtttcatacccagctccattcttgagtctggagttttctgtgatccattttagaggattggtccagatgggacagcccataggtgctgactggggcgctgccccaccccttggtaccaagatcttccaggggagtctagaggctgtacaggggaagttcctggtctgggatgtggagggcttcatctcactgaaaaatcagccatttctgacttgatttccttccctgcctttctctgttagaggagtgctagcatgtttagcccttgctggtctttcacctgagggtacagctgagtagttcacacagcatggcctccctcacagccacagctcttcagtggtgccttaaagtccttagcaagccatgaggcaccttctgttcaaagatgagttgtattcaatgctgcaaaagagcatgacacccgctcaggtgctgttccagggatagaggacccagtccttaacctccgctgtcaggagatgcagaggggatgtgtagccagaaggtggcaggcaaggctggagtgattcagtgggctggcccagcgagtttagtcctgcagcccaggaaggggctgtgctaggtaagtgaagactggaagcctttggcacaaaccctctgtcttctccacagaaatgatgatgcacgtgcaacagctgtctcttgcgtctttatgtgtgaaaaaacaacagccaaagaagccagaggtaggtcatcctgctgaactgaaggacaaatggatggttttcaatgaaatcagtgacaacttaggtaaatccatggcccacccaaaccatctcttcctggccattctgaaagatggaagaggaatgcagcctcttatttacctcagtcctagtgcccatagctttgcaacaccctttcttctctcttctctgtggcacttgcagtcctcccatggcacacaccctgctgagacatccctatggcctggactgcctgggccatgggctccctacagtagttctggaccagataaagttcataaatgcccatggcactgaccaggctgctattctggaactttccctgtacagcctctagactgggaacgagtctgcatactgcaggggtgagaaggagtgattgaaatagctgccatcttctaaatccttgtttgttttccattctttgctggcgttagaactgtgtgtactacatcaagagagcccaacctggtttaaagccacagtatcttcacccaagcctcaatctgaggaaggattaaatctacagatctacccacagcctggcatccaggcacaggacgaacagtaatagctattagttaacagtgctaattagctaacagaactagcaagccacatccaaagtggatggagcagctgggcatggtggctcacacctgtaattccagcactttgggaggccaaggccagcagatcacttgaggtcaggagttcaagaccagcctggccagtgtggtgaaaccccgactgtgctaaaaatacaaaaattagccgggcgtggtggcacatgcctgtaatcccagctactcaggaggctgaggcaggagaatcttgaacccaggagacatgttgcaatgagtcatgatcgcaccactgcactccagcctaggcgacagcaaaattctgtctcaaaaaaacataaaaaaatagtggatggagcattcagacactgacgccctctccacaccctctcctctaggagtgttggggacattgctgctgttaaatttgtgttattcaaaattcaaaagggtatacaacaaaaattctcgccctgctccagcttctcctcaaccactgaccttcctccctgaaagtgtgaacagtttctaggactctatgcacatagaagcaaatatgtcaaaaattccccccttctatgcagatacacagcatttttactttaacttaatcagttttgtaggccgggcacagtggctcacgcctgtaatcccagtaatttgggagaccgaggcaggtgaatcgcttgaggtcgggagtttgagaccagttggccaacatggtgaaaccctgtctctactaaaatacaaaattagccatgtgtggtggcgcatgcctgtaatcccagctacttgggagggtgaggcaggagaatcgcttgaaccctggagacaagttgcagtgagctgagatcacaccactgcactccagcctgggcaacagagtgagactctgtctcaaaaaaaagaaaaaaaaattagttttgtagatatctagcagtgaagtgagttttgggtgtaatgtgctgatacgcaagggaatgtgagaggcttctttggattgtgtttgcccccaaggtgtggcctagaggagaatctggaacttcttaaggcccagaggcacaggtggtcatggatccaccatcatcctggccctccagctaaagctgatttttttattttattccatttatcttacatttatttacttatttttcaggtatataccagaagatccatttactcttttttctttttattttatttgtttattttactttactttttttgtgagacaaggtctggctctgtcgcccaggctggagtgcagtggcgccatctctgttcactgcaacctccacctcctgggctcaaaccatcctcccacctcagcctcccaagtagctaggactacgggcatgcgccaccatgcctggctaattttttttttttttttttaaagatagggtcttactatgctgcccaggctggtctcaaacttgtgagctcaagcaatccacctgcctcggcctaccaaaatgttgaaattacagacgtgagccaccacgcccggcctccatttactttttaatatcagctttgtttgaccttggcttaaacattgattttgacccacaggatcagagtacacaagataggacataggaaagcaaatggctatcgtctttatcctagtcctatagggtacctggaacagcatcagtacctagaaaataaagctgccatttagtgagcatctattctgtgccacatgcgatgaggtcggtgggtactcttcacattgcaggtggcagagctgaagtacccaccaggcctctgggactccagagttcttgctctctgtactgtcctgcactccctgcacagtcagctgccattaagattcacacaccgagtgccccccttattcatcgtgttgccgaagagggagccgttgtgcccaggtctgctccagctcagggcctgagagtctggttctgcaggcctctcaacagcaggaagcaaagtgggacagactggcagccacttggcttatcaggcccagttccttgacccccgtggcttcctcacatccttaacctatttttcctttccatttagggaacatgtccagcagcagagtcaagaacacggaaaggtcagtgtggtagcttttcctcatctaattgcaatccctccctccctaaacacttccccacgactccctctgtggcagcatctgctcacttttctgtggcagcaagcgagtccaggttatcttgcccctttgtgtttccagggcctggtcctcaggtttctggagcgagagaggcatgcccaagagcaagtccagagctgctgggccggggcttctcctttagagccaagaccccatgcagacactttggctcctgtgtcctctggctgttcctgggcatcgattgaggttcagcatccttttccttctgattcagtagcagtttgggggtgggcagtttgacagctgcctaccgttttcagaactgccaaactccgtgaaactgacaaactggcagattgatggactccgtctcctggttcctcttggacagcaggagagttgctccccctggatgtttctcccaaagatgctctttcagtggcatttattcatgcacaagcaggagctaagaaaagtcacttggcacctctctcatgctcaaaattcaaggaagtctgtaggggaattgattttaataactgtctcagttaattagaaagacaagaaattgtccccaaaaagtaattaatgagagctgctgctaaaggagaaaaggctgctttttgcttgggtgctactggtggcctcaagtacagttgggagctgtaaggtgccagcgtctttggggaatttatggctgtcagatgggcccaggatttcagctgccttggctgccccttcgacaggactcctggtcactgtgggtcctgatgcctaagggattttgtaagctatgcgaataactatctaataggggtgagtctcttaattgactccaaattcatcttctcagcactcctttgccctattttttcaggaatcagattttacctgtgatatttttctaccatcctgctaataagaccactaaacactctttatccctcttcctctctgcttcccctccaaaaaacccagggtcctcctggagcattctgcctgggagttgatcttaggcccctcagtatcctgaggctccagaagcaaagggctaggaaggacctgggactttgtgggaatgaccacccccaccctgcttttagcagaagccatcaggggctgggtttctcccaccaaaccagccaggtgtctgatggtggtggcatctttggttggtcgatagcctccagaatccacacacaggagctcctgcgtcctgcagaggaagggcccatctagggcttcagtgttaactgcagcctatccccccactggtgcaacctttctcccaggggtagaggctggagatctgagtgaatggagagcgcagcctggggtggcatgatttccagctcttgcaaggctcttaggctttggcagagccttccctctcagcatttcctgcatgtgtggtgcaggccctgcacaggggcagacagatagctgatgtgtgcattcttcccctttcagtggccagactgaaggccccgttcctcaaaatcgaagatgaaagcaggtgagtgggacctcctttctctgcttgccccagctaggcctgcacagaggagggaggagggaggggtgctcaggggcctcaagctaatgtgaagacatggagccccttaaccctgcaccttcatcttcctgagaagccactttctcccattgtcatggagaagtctcatgcaaaccaggaggagcctcagagtggcattatacagtgaatagtcctcttggagatgagtcagaggttaatgatcctgtgtgtgaattacctccatttaatactctgctctatgagctcatggtgtcccatgcaggctcattattgcaactcctttccccttgggtgtatgctgacatttcatgtcaaatcattacccagtcacagtgctagtatagtccaagacatcatcttggctgaaattagggtgctaggggtggtactggggattcccttgtcaggccaccctgtacttgataaagcctttctgtttcactttgaaaatcgttttctggctcatgttacctcctgacagccctgggtgaaaaaagcatgaggagagcccatctcttcctaatggggaaaactgaggtcagagaaaggaagggacttgtgtacagccaccttgctaataaattgcagcctaaggctagaatccaggtgtcctgcctaccctgtcttgtgtcttctctgtccaccattatgatctcctcttccctcggagcaggagggtcccatgacaatgttaacctaatgagctattagcagccatgttggttatcactgaatcttcagtaagtacaagatcgaaagtgtatgtgaatctataattatctcaaaatttaaatttttgtttttaatattttttccaaaaaggcattttcagactaaataaattttttaaaggaaataagtccatgtgtatccagcagagactactgaggacagaattgtctgtgtgcctcagacagggaagggcagggcagctgagaccagccctaggagcctggcatgcctgcccatcctccagacaagcccagggtcacttctcagcacctgcagacagtgctgcgctggctttggtggcccaaaggcaagtggagagaacaatgggatggtacagaggtgctgtcttccagttccagtgggatggattgcgtgttcatccccagccccttcacacctatttaaatgtaggtaatcatgacacatatgcaacggctgaaaggcactgttacagcctcagtatctgcactgcacatggcaggcacaggtatatcactgtcaccagagaggggtacacatattcctggcattataggccagagaggagatccaactggagctgagatttcttgtgaaatttttttttttttgagacggagtctcactccatcacctaggctggagtgcggtggcacaatctcggctcactgcaacccctgcctcccagattcaagcgattcttctgcctcccgagtagctgggactaaaggtgttcaccaccacgcccagctaatttttgtattttttgtagagacggggtttggccatgttggcctggctgatcacaaactggcctcaggtgatccacctgccttggcctcccaaagtgctggaattacaggtgggagccacagtgcccagcctcttgtgattttttttttatgtgctgttttgaagcaggtgcattcaaagcctattaggcctattagcctgcccatcctcaagtttcaagccccctaagcagaaacaatatcattgaagaagaaagaaacatgccagggttgtgaggggtacccccttctccttaagggtccaagaagacttatttgttaattcactgctgagctacagtactcttaccctgctccctgagaacccctggcttgcactgtttcccccagaacatggaccattgcaaccaaacatggtgcacccggcagttacctcacttggcagggtttgcgaagtatacacagatcacttctgtctctgcaaatctcttaaatgtttgcaacttgaggcacactgccagaaccactcagtccaggtctgactatccagaaccttcactgtgcctgtcttctcctttcagaacccagccctcagatagttctaaggaccagcaagaacacttcacagaacagggaaataactgttctggtttaaacattcttccatttagaatctgccaggctagagtcctcaaagattgttgtagggtcaagaaacaaatgggaaggtggggaaaagtagatcaggagtctggagatgtggcttctgatctgaccttggctgcttaactatttgtgagcccttgagcaagtcacagaacctcttgggcttcatttccttagatataaaataggataagcccagagggtgcttataggattccagggaggcagtggtatgagtttgaaaagtagacagggaggggccgggcgtggtggctcacgcctgtaatcccagcactttgggaggctgaggtgggcagatcacaaggtcaggagatcgagaccatcctggctaacacagtgaaaccccgtctctactaaaaatacaaaaaattagccggccatggtggcggacgcctgtagtcccagctactcgggaggctgaggcaggagaatggtgtgaacctgggaggcggagcttgcagtgagccgagatcgcgccactgcactccagcctgggcgacagcgagactctgtctcaaaaaaaaaaaagaaaagtagacagggagaacatatgtattaatttaacctagaaaggctgatgagttttgttatagaatttaaaagatgtggaggtgagagtccactttatcagggctggaattctagggcattgggcgaggccccctcctcagcctttaccttccccattgtagtcaaagtggaagttttctctgttgcaggaagtttcgtcctttccatcatcagtttaaatcctttcctgaaatttcttttcttggacccaaagatgcaagtccctttgaggccccgacgaccctgggcagcatgcaccataccaggtgggtctttctggttcctgagtaccaagggctggttacaggccaaagtcctccccatcgggggcctgctggtcagatttgggaatggccatgtgtttgctccttaggcaaagtctattctgggaacgtagcccagagaagagagactaggagcgttcatccattttattttgtgttcttcatccgtactgaagaatttaacttgaagaagaaagggaggtgccagggttgtgaagggcacccccttctccttaagggtcgaagaagacctatttgttaattcactgctgagatacagcactcttaccctgtccgcccagaacccctggcctgcactgtttcccccagagcatggaccattgcaaccagacatggtgcacccagcagttacctcactcggcagggtttaccgagtatacacagaagacaatagaccgctttctcaaactcatatctatagaccaccattatcagagtcccctggggtctctttaattaaaaatacaagttctagctgggcacagtggctgatgcctgtaatctcagcactttgagatgccaaagtgggaggatcacatgaggccaggagtttgagaccaacttgggcacacaaacatagcaagactctgcctctacaaaaaataaaaataaaaatgtaaaaaattatgagtcaggcagagtggctcatgcccgtaattccagcactttgggaggctaagggggcggatcacttcaggtcaggagtttgagacaagcctggccaatatggtgaaaccccttctctactaaaaatgcaacaaaaaaaaaattagccaggcattgtggtgcacacctgtaatcccagctacttgggaggctgaggcaggagaatggcttgaacccggcaggcggaggttgtagtgagctgagattgcgccactgtacttcagcctgggtgatagagcgagactccttctcaaaaaaaaaaaaaaaaaaaaaattagtcaagcgtgatgacaagtgcctgtagtcccacttactcagatggctaaggcaggacaatcatttgagcccaggagttcaaggttgcagtaagctatgattgtgccactgcactccagcctgggtgacagagtgaaaccctgatgcaggttcctaaactccaccccatatctatagaatcaaaatatctgatgatggagccccaaaagctgcattttacaagctctcatgtgatttcagtgaatatcaaagtttaaactggttgggccaaacatcaggaataactaaggggcggggcgggggagaagatcgctgcattacgtggctcatggcttgtgggcttgttaatgtttctactctgcagatgtttgagaatttgaaccctcattaaccaaagtagagaaggaattcagctcaggtgatgggtgagatgccttctcagaccctttctaacctctgggctgtggggttatagaccaggagagaacagagcagactctcagccctggagttcctggggccaaggaggctctgtggtttccatcagctgacaaaggctgtgggtaagaaaatagtacaaataggagggaaaaaattaagggaatgtggcagtagatgaaatgggagcaaagagagaaagaggtgaggttaagtcccaatacaagggataccagggagagccagtcagaaggtggcccaggcttggcgctggcagtgatgctaggcctgggatggccttgggatcacagaggagctaagaggctgtaaagggaagatgaagcaatgaagctttggtatctgcatgtgaggcgcctaggcagggagttggccctggtgggacatcaaagttccaggcacgtgtgtatgtggaaaatatgtgtaggaagaagtgtttaaatttttacatttttgaaatcattattatattttaaagtttaaaaatttttaaatttaaaaagtttaaaatttgtgttacaaatggtttaatgtgaaaagtctatattccacacccagcctccagttctatcccctcactggtgcaaccttcctcccaggggtagaggctggaggagatccgagtggtgcctcacccctgccaaatggagagtgcagcctggggcagcatgaaaagaaaaagcaagtaacatccagcatagtcaatactgtatgattctttttttttttttttttttttgagaatgagtcccacactgttgcctaggcaggagtgcagtggcgtgatctctgctcactgcaacctccgcctcccaggttcacgcgattctcctccctcagcctcctgagtggttgggattacagtgcacaccacctcgcccggctaattgtttgtgtttttagtacagatggggtttcactatgttggccaactggtcttgaactcctgacctcgtgatccacccacctcagcctcccaaaatgctgggattacaggtgtgggccaccacacccagcctatatgattctttatgtaagaagagggaacgaaggatacacatgtacctatatatccatgaactatctctggagatagaccacacctgtaatcccagcactttgggaggccaagggggaaggatcactttgaggccaggagttcgagaccagcctgggcaacataatgagaccacccccccccccccccgcccatctctatttttatatttttaaaaaatctggccagacacagtggcttatacttgtaatcctagcactttggaagactgaggcaggtggatcacttgagctcacgagtttgagaccagcctgagcaacatggtgaaaccccacctctattaaaaatacaaaaattagccaggcatggtggtgcaagcctgtagtctaagctactcaggaggctgaggctggggaattgcttaagcatgggaagcagaggttgcagtgagccaaggtggtgaatctgcacaacagcctgggtgacagagtagaccctgtctcaaaaaaaaaaaaaaaattgcattcccttttatggctgcagggtatccattattccattgtatggaatgtatttactgtattttatttaaccagtctgttattcatggatgcttagattagctccaatgaaaatcatgttcagagtaaatttgcaattgctcatttgtggaataaattcctaaaggtagaaatattgggttaaaagatatatgcatttataattttgataaattcagccaaatggcttttcatggagcggataccaacttatatgtttacctacactgcatgagagaggctgtttcccatccccttgcctcatgctgtgactggcagatatgctgacctccagtataacagattaaaaactgtatctcagtataattataatttttgttttttcttactatgaatgaggctaagtaagtttgcatatgtttggttgtttgaatctctttttatgtgaaccttctttttatactttgcccattttttatttggttattgatcactttaatgatttgtaaggagcccttctcatattagaaaaatgagctctttgttattagttgtaaatattttcttttctctggtcactgcaacctccacctcccaggctcaggcaatcctcccatctcagcctcccaagtaactgggagtacaggtgtgcaccaccacacctggctaatttttatattttttgtagaggtggggtttcaccatgttgcccaggctggtctcgaactcctgcgcccaagtgatcctcccaccttgacctcccaaagtgcagggattataagtgtgagccactgtacctggcagttgtaaataaatcaatatatatatttttttcctaagcctccctgagcagagaagttgtaaatacttttaaaagacaagaaaaccccaagtttgtggtttgtcttttaactctgctatattagtccattttcatactgctatacagacctgtctgagactgggtaatttgtaaaggaaagaggtttaatagactcacagttcagcatggctggggaggcctcaggaaacttacaatcatgatggaaggcaaaggggaagcaaggcaccttctccacaaggtggcaggagggataagtgctgagtgaagggggaagagccccttacaaaagcatcacatctcatgagaactgtcacgagaatagcatgggggaaaccacctgattcagttatctccacctggtctctccattgacacttggggattatagggattacaattcaatatgagatttgggtggggacacaaagcctaaccatatcatttgctaatgattctttgccatgcatacatattttaaagttgtatatagctgaatttatgagtttttctgtatatcttctggggtttgtgtcatacttaggaagtctttaaaaggagtgttttggacttgtcgagtttgctggacagccagatagaaatgccctttggttgttagaaatatggggctgatattcagataagaattcaggcttggccggatgtggtgactcagtcctgtaatcccagcattttgggaggctgaggtgggcagatcacctgaggtcgggagtttgagaccagcctgggcaacatggtgaaaccctgtctctactaaaaatacaaaaaaaaaaaaaaaaaaaagaaagaaaattagccaggcgtggtggtgtgttcctgtaatcccagctattcgggaggctgagacaagagaatcacttgaacccaggaggtggaggttgcagtgagccgaaatcatgctgctgcactccagcctgggtgacagagcgatactccatctcaaaaaaaaaaaaaaaaaaagaagtcaggtttgaggaaggtttgaaaatcctagcggacagtgaggacagctgtgagagatccaaggcagcatgagagaagggacagactgaaccaagctggggagacattcagggtggaaaagaagagcagtcccttcactgtggttgagaccttttccctttcatctttcaggtctcatgaatgtgggtgtaggtttgagcacagagttggaattcctacaagggattcttgctgctgccgtcaccatcccatcttcacctgtcgtttaagagaaggacggagatggctggcgcggtggctcacacctgtaatcccagcactttgggaggccaaggcaggtggatcacctgaggtcaggagtttgagaccaacctggccaacatggtgaaaccccgtctctactgaaaatacaaaaatgagttgagcattgtggcgggcgcctgtaatcccagctactctggaggctaaggcaggagaatggcttgagcccaggaggtgaagattgcagtgagccaagatcgcaccactgcactccagcctgggtgactaagctagactctctcaaaaaaaaaaaaaaaagagagagaggacagagataagacaggctgcccacagggaggtctccagacgtcttcttccttgttcccctcttgccattcttagatgattggtaccaagctcagggaaggcctgcctgccggtgcctgcacagccccttggccatcttggtccttcccctccctgacctaggctccaggctctaagtagtggctcctccccccaagggccccagcagtaaccactttgccgcactatgtaccctccccagagaatccaaggatggagagccaagcccacgatcagctgcccacaccatgcccaggaggaagaaaggctactgcgagtgctgtcaggaggccttcgaggagctccatgtggtgagccccttccccattaagcagctgctcccagagtgccctgagggagcctgctcactggggatgagtccttcctatgcgatctctatgctgctatggctgtcctccagggccagagcatgggctgggaggtcagcttccgtgtccccctccccccaggcctcatctaatgccctgtgctcctctcccccgccggcagcatcttcagagtgcccagcaccggagctttgccctggaagcccatctatatgcagaagtggacaggatcattgctcagctcagccacagctttgcagacatccctttccaggctggcctccccaggtgagtgccacgctggcaggcacaactgtgtctgctctctcctctgttgccctctgggtgggaagagaccctcaggttggtggctgctgggaccagactgtgatgttttcctcttttctcaccttcctttccccttatcctcagtcctgtttgttttggggctggccaaaaaaaataaaaagacctccatttgtggcttcacttgatgaagactagacccagactacactgtggctcccttccaactccacaggctttgatgtggttgataagcagttctggccagggagcagggggttagtgcttgggcctctcctagataggtgaaaagcaaagtctttcccctctgtagaagtcacccccagaaagaaggactgcatggggtttggtgggaattccagggccctctgagccctgcttccccttgctgccagcaaggcagaccctctcccacctggggctgtggcttcacctctcaccccaaatctccacctcaagctcaacttgcacagccaggcactgcgctgctttcttcagctgccaaagggcacagcctcctctgtgaagtcatgaaatggaatagcctctaacctattcctctggccggccccaaccacaggctgcagagccaagagaagtgcacacagtgctggttgctgcggcaggttagacccaaacaggaggactttcacacagggcctcagagaaggcagctctctcggcacatgaaccgccagctgtggcagctctccctgtgccctcagccctggcccaggcctgctgtgaagttgaaacctgcagctcacagtgtttctgtcccaacaggtggtcaggttccccagcttctgattgtgaccctctctgtcctgagactctgcacccccatcagccctcccatcccagggcagcatctcccaggataaggaaagaagacagctgccaggcatcaggtatcccagagcaggatgggacagtggacagcacgcaggcaccagctgaacgtgcagggactggtgaggtacctggacctatagcaagctgccaggacctgggggtgtcagttgatgtgtttgtggaccccccagggataccagtgtccaggagccctgcttgccaatgcctcctgcctagctctggttttatggaactctcctctggcccagacctggcactttttggccacaagcggaaggttcagttccccagtggcagtgctaagaagagagtgggggcctcctggccacaggcttcattttttgtcccaatagcccccaacccctgcggcaccaggacaactagtggcaagcgtcttccctctcttccccttacaggccatgagtccaggctcctcgcctccctccagcccttgtgccactcacagacctgcctctctctcccagaccccttcccctggcagcccacagacagaccagcagagttctgggccacacagccctcctggctggggaaagggtggcccccagggcctgaggattctgagtgtacagccactggccctgtatcccaggaggctggccagctcctcagctgccccacagctccaggctggccatcagctcccctgtactcagctaccagtgtgcagccctcgggagcacctgtagagagcaggtctacctccctcctgcagcccctgccagccagtgcgggagccagctgttcccgatgcctctgggccccccagcctctccaggtgccctgtctccctgtctcccagccctggtcccaaccccagccccagccccagccccatgctggcagagagctgctcctacgagtccccaaggtgcttggctcttcacagggccaggcagctccagattgaagggccacagatacaacttactcctctgctgggtgctgcacacccggccagggctgaccaggacgcaggaggggcagaaccccaggacttccccaaaagagctagaaggaggcccgggcctggcctttgaagtccagcaagcagctgtcacgctcagctccatggagctgacagagccacccctcccactggccaggtctttgggagagaatctgggctgggggctgccctctcctacccctgcctcctgccatgttcctgaccaggcagagtctacagtgggcttgcccagctgaggctggccgcccacgccaggaggcagaggcgaagttggcatggggagggaccacaaaggagctggggcagcaggagtcctggcccggcttcctggccctccacaggcccttgcctctctgcagagccgcgggttagctgttggtgtgctccacccccaaccccggcctcctttctcacgagcatgtggccgctcctgctttccaaaatgactgtgtttgtcccctcccccagccccccacgctcccgcacacagatcctcaggaacatatgaagcagaggaggggcttgggctgcaccactcacagagctccctcccccaggcacttagttggggcccagcactgacctttcccctgagcccaggatgtggccagagccccctctgggacccctctcgccccttctctgcctcctcagcttgagctgcctgcccgaagttcggctgttccggggccagtgtgtcacctgccaacttccacatcaccctcctccctcgctccctcctctccttccccaaggacctccccccatttctggcagccaagccattaatctggagacagaaatgggtttgctatcgattctctggccactttttctttcattacaatttgtaccgtgattcttctcacccttctctgcgtccgtgcatttaaagagttgtctctttaaatgttgaagcttccggaagcctgatgctattctgtgtctcctttcaaaggaagaagggggggcccagctatgggtgaggactcaagttattagtttggaaatagagcaactatgtgtacagcccaccttagaggtcatgttacccccttcctgttaaattttacaattaattttggttcaggaaatgtaaataaatttgttaattacaaatagcaaagagatggggctggaatgccatatgtcggtccttgatctgccctccagtgacccaaggcagggctgcgggccagcagcgatggacagaatcactagatggtgtgatgggacctcctgcaagtcacacatgtgtgagtgccacaaccctcctgccggccttgcccaagggctccagggagcagggctgcctctgtccctgcccagcctcctttacccagtctcatctggtcacttccttggctctgctgcctggggagtggtcgcctgcagaggacatgcccctccatccctcccaagaaaactcctttgccccggcggacattcctgttaagggcccactcctcttccctgaagccagaccgtggcttatgtctgcacgctgctgggttcgtccctttccttttgtgacatggggttgcctcattccccatgacaccacccctctgcatgaggaagtttccccttgcccctgtctcagacttggatacctttacctgctgctcacacaaagcctgtggtgccgggttcgggtgccctcattgtcaactgcaggacccattccccgaacctcacatccgtgtacccttgccttcccctcctatctcaatgatcatgaccttggacatctctgccaggccaaaccccaaggctggaacactcctcagccatttctccattgcggcttcctggctgtagactcaggttagaggtgaacccagaacacctgagacttgacccaggatggatgggtgctgcttgatgtgaatgaggtcccgcagtggctccttggcgtgagcactgctcagactcctttccactccagccccctttccacatcgcaccagatgacttttacccagacccagtgggcattgccttatcttgcagtcagtcccttttcaacatgttgccgtttctttctgaagaggtgtcctccctccacaagtcacactgtctgtccctggccctccagcccacctcgccaaccactcttgttggtttccttctcagacttgccacctttcccctctgccccaaaatgccatgctcctctcctggaaaacacttgagttgattcagtaaatcgacttcaaatacttgaaggctcccaccttctgttctctggctccttcctgcggtctatacctaccgcctcctcttcacctccttcccttccacacttccttcctgggtagctctgcctgaagcattccactaagatcatctattccaaggtcatggacaggctactggtgaccaaagttggttccttttctcctttctttcctccttgaagcctggctcccttggtcgcagcagcccctcagtggcctggttctcctgtccccctgcccttcctcaccattgcccattccctcgttcgttcattcagcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgcca

SEQ ID NO: 625 - DNA, 4884 bp, Homo sapiens
cttccctcccggaaggggcgtggctcttcagaggcggcaaattgcaaggagacgccgccgccttcatgctgccggcgggctgctcgcgccggtgaggcctgcgcggcaggagggggtgggaggatgcgggcgggccggtagccaggcgcggggcccgaggcccgacgctggccgaggtgctgagccgccggtgcgtcccccaggctggtggccgagctgcagggcgccctggacgcctgcgcacagcgacaattgcaattggagcagagcctgcgcgtttgccgtcggctgctgcatgcctggtacgcggaccccggacccactggccagacctccctcgggccctcagagtcccgccccgagcgcccagggctgggagaccgggcgcagccgcccacttcggagctgtgggttgtcagtgccaccctccttaccctgcaggctctgagctgggggcctgccgcggggcccggcggccccctcgggtctgtttgggctgggccctgcctcctggccgtgcgacggctgcccgtgtctttgcagggaaccaactgggacccgggctttgaagccacctccagggccagaaactaatggagaggacccccttccaggtaaacctccaccacccgccttctccaggtgctgctctggcctgtctgctggcgtgcagttgtgaggaaccctcctgggggacagtggggagagatccctgcataattcttggctttcacagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggtaggtttcccggaccctcactggagggacttctgtctctgcctcctcagaccctggctagcaaggagcctgggatttggggtgacagggaaggcagggcatcgagccctgtggcatacccctgaggctcatgctcagaagctggcagaatgaagcagctgtgtggtggtgtccaggttggcaccatcaggtcagggaagtactggagcctgtcctcctctcttctctgtggctgtccccttatttgcccaggccagaggctccagatgggctctggagggcgtgggatctgctcacagggccccgctcacagggccccctcttctctctaatggggcagcactggacgatgcttctcctatggccactctggaagccctatccaagggggctcatccttggtggggtcgggtgtgggagaggggcaagaagcctcatccctgattgggctctgagcaggaagtgggacttgtagaccccagagcaaggcgatgctcctctgaacacgggcttctccgacaggcacctgctgcggctgcctgcggcattcaggaaagcagcttcccagaactcgaggtgaggctgaggtctttggctggacgggggtaggggagaaccgggaggcatcaccagctcggggacaggttcgagatactttccagtgggtctctttgtcctctttgctgagtgggatcactgtcgatgttaaaaatctgccagccggtcagctttgtccccttgtcctagtcagtgtcctcttggttccctgcggcctctggaggcccctcctggcattcagcagagccagacgcccagcctggggtccccaccctggcccttgcctacctcccaaggcccagcttactggctggaataaccgtgtccctctgtggttcctctgtgcaccccacgtgtgcaccccagcctgtgggcccagctcagttccacacagaccagtgattccacggatgccgccgctgccaaaacccagttcctccagaacatgcagacagctgtatccttgctgggcttgtgggagccctgggggcctctagctctgaacctggcaggtttgcagagcagccccaggaggggctggcgtgggatggccagggccactccccaggccccgttcttggtgggagcagaggggctttggctgcagggaagttttcctgacccatatccagtcaggcgggccccagcccaggctcagtgctgtggaggtggaggcggaggcggggcgcctgcggaaggcctgctcgctgctgagactgcgcatgagggaggagctctcggcaggtcagtgggtcctgggtctgtatcaggaggagtgtggagggccagtgcagggagggtttccagactgccacgggccccacctgctctccctgactcttctgcagcccccatggactggatgcaggagtaccgctgcctgctcacgctggaggggctgcaggccatggtgggccagtgtctgcacaggctgcaggagctgcgtgcaggtgagaccccgcccccaccctgccacctgcactgaggtctgggccggggacagggtgctttagccaggcttgtctgcgcctcagggaagggtgagcagcccagggaccagatgcaagttggtgggcccctccacccctcccacgccactccccagtgtgctgggtcctcaccagtcgtcctatgggagcagtcagccttcctctcctcctcagggcagctctcccacctcgctgctccccgcacacagaacctcattgctctgagcagttgcttattcacccagttgttgaaaaactagcatgtgagggccgggcgcggtggctcacgcctgtaatcccagcgctttgggaggccaaggcgggtggatcatgaggtcaggagatcaagaccatcctggctaacacggtgaaaccctgtctctactaaaaatataaaaaagtagccaggcgtggtggtgggcgcctgtagtcccagctacttgggaggctgaggcaggagaatggcgtgaacccaggaggaggagcttgcagtgagctgagattgcgccactgcattccagcctgggcgacagagtgagatgccgtctcagaaaaagaaaaagtagcgtgtgaggccgggcacagtggctcacgcctgtaatcccagcactttgggaggccaaggcaggcggatcatttgaggtcaggagttcaagaccagcctggccgacatgacgaaagcccatctctactaaaaatacaaaaattaactgggtatgatggcgcacacctgtaatcccagctacttgggaggctgaggcacaagaattgcttgaatccagaaggcagagattgcagtgagctgagattgcaccactgcactccagcctgggtgacagagtgagactccgtctccaaaaaaaaaaaaaaagagaaagtagctcgtgagaatcagctcctgggaggtgactcgcctgggattgcgtgaggtggttatttatagaacttgtttcctcctttgtattttctaattgcttgaagttttaagagtgaagatacatcatttgtcaaaaggaaagacaatctcataaaagtcatgcataaacacagtaaagaaattaggcaggcagagggccaccccacagaggactccctgccagcaagtccaggcccaagacacaccatcttgcatggggctgtcctgaaagcccacctttctcctaaaggcagggcaggtggtgcagatgcgggagggccaggcacacaggaaaagcggggccctgggttcggctgctaccccaaaggccacattctcctgtgcacacagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtgcttctggaagaggaggtgggggtgcaacagaggtccgcagccttgaggacccgagggtaggggcttgactgctccaccccccaggacccaggaggatgggggcaagcctggggtctgtgtgtgtgggttgggaagtgcatgggtcagacggggctgggacggcaggagggagcctggagcctcagaaggagggaggagggctgaagcatgggggcctcgaagcctgtcccaggattgccccccgcctaggtgcccctgagaccttggccctgccctgccctgcccccaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 626 - DNA, 29461 bp, Homo sapiens
ctgcgcctgcgcgagggctacgcgcgctccggccggggcgcgggcgcgctctcaggcgggctccggcggcagcgacgcgagcgcggcgatggggagcggcggcggtgagtgcggggcgatgtccgctggtttctgccccacaccccttctgcctgccctgcggggcggacggtgggtcccgcgggaggggaggccctggcggcctgaagagggctggctcgagctctttaacccggggcggatgtcgcgtcccgcgcagggagccccggcggccgggcgcgcggtttaaatgcccggcgggcgcccgagcccctcggagccttcccccgcggcgacgttttccggccctttcctggggcaacgatcgggtcccggggcagcgatccggcgatcgggtcccggggcggcgatcgggtctcggggagccaaacaccagcgcctcctggtcggggaaagggctgcggagcgcgtgggggcgaagcgatcccgcagcccggccgggccctgaccgagcctcagtccagcggggccgtggacctagctctgtggaaagcagcgttcggccccgcgcgcgttgaggcacaggaaacacgaactgtggtttcagctattatcatagtatctgtcctggagccggagaatgaggaatattttatggagaggtctatagaatctttgagaattcgtcgccctggaatacgtttggcttttgcagctgatttaattgctaacaggaagaccccggtcaagagaggggagccgggagcaatcgctaggaagtcctagcaaggcggggagggatttgggcccacagaggggagtggcgcttcctttcaggactggaaggaaggatggatagaaaggtagatttgtagatggggaggcaggatcctgaggttcctgtctgagggcttctgtttccctgtgaaataagggctaaggtcatctgcttagagtgaggaaggggttgctggagtaggagttggaaaatccggctgtgggaagaggagagagcacatctgagaagcatgtccgggctgcctgcctggtgggtggaatgcccgtctcacctttaatgattgcatctgtacacaaacctacaggtctaggtttgtgttgggacctgagcaacaaccttactgcgtagctgtcaactccgcattctacaatagagggcacactgagactctgcagagctgagacttggacgcacactgccccggcctccaagtctgtggcttctctccagggccgacccttctaatttggacttgaaaaccagactcttcaagcccacagatctttattgaacattatgcaccttggtcacgtgtgcaaaaagcaaagctatccagcaaaggccccaggagttttcctgagagtgaaatagaaggaaaaccgtcctcagcttcggcagctttttccccttcctgcctgtcatgtgggctctggatcagaaagtttcccaatagccaagttacatgacatgcgctatttgccataaatatttgttgaatatttgaaaatgaatgatctcttctgtaatttgtgcaatgccactcctttacataatctttgtttgggacaagaagcatagttccatcttttgtggcacagggaatagtaaccattagatcatcttcagatgtaacttttatcctttttttttcccttcaagggtgtgtatatagaataatttttcatcttatcaaggcttctgtctttttttccttcagtggtccactgtaggtgtgccaagtgtttctgttatcctacaaagcgaagaataaggaggaggccccgaaacctgaccatcttgagtctccccgaagatgtgctctttcacatcctgaaatggctttctgtagaggacatcctggccgtccgagctgtaagtccctgcatgaaaacactatgagccctagcattgttgattataccatcaggccttgtgttcttaactgtcagaacaaaactttggctaaaaaagaggttggggcagaggccaggcacggtggctcatgccttaatcctagcactttgggaggccgaaggggggtggatcacctgaggtcaggagttccagaccagcctggccaacttggcaaaacccccatctctactaaaaatacaaaaattagccgggcgtggtgtctcacgcctgtaatcccagctactagggaggctgaggcgggaaaattgcttgaacctgggaggcagagcttgcagtgagccgagatcacatcattgcactccagcctgggcgacagagcgagactctgtctcaaaaaaaaaaaaaaaaaaaggagggcaaaaaggaaacaaggatgatatcattaccagatgctttctttaagacattctgattacagaaattcctactgctgtctcctagcacactaaaattgcctctgttcattgcagtgtcaacaaagaaagtaccttttttttttttgagacagagtctcgctctgccacccaggctggagtgcagtagcgcaatctcggctcactgcaagttccgcctcccaggttcatgccattctcctacctcagccttccgagtagctgggactacaggcacccgccaccacgcccggctaatttattgtatttttagtagagttggggtttcactgtgttagccaggatggtctctatctcttgacctcgtgatccgcccgcctcggcctcccaaagtgctgggattacaggcatgagccactgcacccggctgaaagtacccttttatggcagtgaaatttgcatcccttaaaaaataggatagtgtttaaaagaataagaatacattcttgaggacaaattccatgtaacatttaacactgaaatggactctaggagttattttctagatattggaaccataggcttactttgagtgacttaacctagagtatatagtggattcatggggaaatgccagcaagaacccattttctgactcccaaagccacctccattgcaggtgcgacacactttatggaccccagggggtgctgaatttccaatggcagtggaaactttggtgcttaaagtgttcacctgtgctccaggtcctggcctggacactcctgcgttggcccagcgcttaggctccgggttctacctgagacctccatcatgggtgttgttctttgccctgagtccctgtgacctgtttccacactcccactagcaaggcctccagcggggaagcacaaaacacatttccgtcctgcctgcccccttttagagtgtttcccctgtctttgggggtgatacctttgcagggatgttgaaccctctttctcagcctaggtgtttgtttcctccttcccagatcattgtcctctgccctgctttagaacctcagagaaactcgtttctgggctcttttatctgctcaaagtgacagttactttcacacagagattggggacctcaactacttgggatggcgagggagacaggagaccctacatctgcctctcgtcctcaagagcctccaggtgtggggcttttgggtggtgcctccatcacccagccccggcccccgttgttctgcaggtacactcccagctgaaggacctggtggacaaccacgccagtgtgtgggcatgtgccagcttccaggagctgtggccgtctccagggaacctgaagctctttgaaaggtatctctgcaccctgagaatggctcagtcttctcctgccttggcctccctatgtgccagtctgtgtctcacggcctgattcagcaacgattttcctgttgctgtctcccatgacattgcctcataccctggggagtgactgagggtggcagacctcacgcatcaggccgcacaagccacacaccttccagcaggctatgcagtcagtcatccctcacgccactgacacgggcccgtggtgcctccagagggctgtgatccattcccacatgacccagacaagagtcaccttcctgtggaaacttcactcagccttccttccctttggtcaaaaccatctgaattctatcctatagcgtttcactcactggctgatcccaccccaacctgcaccccgcaccctggcccctgttcacatgtgctcatggtcccaggtacccgccgccctcagaacaaaccaaggaaccacagctcaggcggggatttttcttttttgttgttgttttttgttttttgttttcgtttttgtttttttcttgagacggagtctcgctctgtcaccaggctggagtgcagtggtgcaatctcagctcactgcaaccaccaactcctggttcaagcgattctcctgcctcagcctcctgagtagctaggattacaggcacgcgctaccacgcccatctaatttttgtattcttagtagagatggggtttcgccatgttggccaggatggtctcgatctcctgacctcctgatctcaggcgggcatttttctgacagggattcgctgtgagcctcgtccatctgagttgccagaaatccagatcgacagccaaccagggcaggcagccatgttgccgcggccatgcttgggctgcttccagggggaatgtatatatttcttattgagacattatccacacatcacacaattcatccatttaaagtgtataactcagccgggtgtggcgtcacacctgtattcccagcactttgggaggccaaggcgggtggatcacttgaggtcgggagttcgagaccagcccggccaacatggcaaaaccctgtctctattaaaaatacaaaaattagctggatgcggtgatgggcacttgtagtcccagctactctggaggctgaagcatgagaattgcttaaacccagcaggtggaggttgcagtgagccaagattgcgccattgcactccagcctgggtgatggggtaagactgtctcaaaaaaataataataaaataataaaatatggctgggcacagtggctcacgcctgtaatcccagcactttgggagaccaaggcgggcggatcacgaggtcaagagtttgagaccagcctgagcaacatggtgaaaccctgtctctactaaaaatacaaaaattagctgggtggtggcacatgcctgtaatgccagctattcaggaggctgaggcaggagaattgcttgaacccaggaggcagaggttgcagtgagccgagatcgcaccactgcactccagcctgagcaacagagcgagactccgtctcaaaataaataaataagtaaataaataaataaaatgtataactcattggtttttagtatactgagagttgtacagacatcaccagtacttaactttagaacgttctccttaccccaagaagaaagcttgtccccatcagcagtcacttcccattttccccacaatcctggaaactctagacaacccctaattgattttctgtctctccggatttgccttttgtgaggatttcacatggaatcatgcaacacgtggtctttcgtggctggcttctttcacggaccctgatgttttcaaggttcatctgtgtcatagcatgtaatggataattcgtatttgattacatgttattaagaaatgttcgaccgagcgtggtggctcacgcttgtaatcccagcactttgggaggccgaggcgggtggatcatgagatcagatcgagaccatcctggctaacatggtgaaaccccgtctctactaaaaatagaaaaaattagacaggcgtggtggcgggcacctgtggtcccagctactcgggaggctgaggcaggagaatggtgtgaacctgggaggcggagcttgtagtgagccgagattgcgccactgcactccagcctgggcaacagagcagactccgtctcaaaaaaaaaaaagaaaagaaaagaaaaaaaaaaagaaatgttctagagccgggcatgatggctcaagcctataatcccagcactttatgaggccaaggcaggaggatcacttgggtctggaattcaagactagcctgggcaacatagcaagaccctgtctctagaaaagaaaatatttttttttgactagctgagcatggtggcacatgcctgtagtcctagctacttgggatgccggggtgggagaatggcttaagcccaggaggttgaggctgcagtgagctgtgatcgcaccactgcactccagcctgggcaacagagcaagaccctgtctcagagagagagagatatatatatatatatgcacacacacacacacatatatatgcacacacatatatatatgcacacacacacatatatatatatatatatatatatatatatatatatattcaattcagggaacaagtattctgacttcttcaagtgctgtagtagttcataacgtttgtggcataaaatattgtgatgctttatgttcttaatgtttcagggctgctgaaaaggggaatttcgaagctgctgtgaagctgggcatagcctacctctacaatgaaggccgtaagtcctcaccccacctgcatgttggcgcttcagataagtgtgagcctttggccctatgaagaagtggtccccgtgttagcagttcagttgctgtccttgctctatccgatggcctgcctccccattccctctcaggagctcgtgcccagatgtaccctgctgagggacctgctaatgatactctgactttgcaggttacgaaagtcgcctcttgttttagcaaaccctttaatttcagttggcaaagagtgactgagccagagcctcagcacgggggctgtttgggctccctgccctgtgcgccatgagcacgcagacctgcctgtggatgctggccctctccttggccatcctcttagaactctcgagacagagttcagcgtgccctgtaacacagagccaggcttctaaacgggaagcaggtacaggcaggttagaactggcctggtgcctggatcccttcatccccagaggccaggtgctccttgaaagaaacttgcgcagccttttcttctaccagttaactgcttatctgctcagcaccccaaggaacgagcccatgatctgtcccagctctcaaaacaagtaaacactgggatgtagcctcccacatttgtacttctaaacgatctggtgtcttgctgggagagagtccctacctggccggctggcagaattgtgactgacagggaccatgagcaacaccctcctccagaatcaggggagccgaggtcctacccctaccctcccatcaaagagcagttcccagacataaaattcacacaccatacagttcacccctctaaagcctgcaattctgtggttttttaggatattcacagggttgtgcagccattgccactgtctaattttagaatattctcctcgtcccaaaaagaacccccacccctgccctggacccattaccaggggtcaggcggtggttcccagctggagggagggtgggacatgaagcgtcgcggggtctccttcccctgaccttcagaatccaggcttccgggaggaccacagcaggggcattgatcacaatgacccacctgttctagacattaatgaagtagggggagaaaagacaggtgcccccatcctggagggctctactctcctgaaacacagctgctttgcactatggtgggcttcaggcattacactttccaccaagaccatggagagctttccacattccgtccctaagagacatccctgggctctgtcctgtctgtccccgcagtgtctgtgtctgatgaggcccgcgcagaagtgaatggcctgaaggcctctcgcttcttcagtctcgctgagcggctgaatgtgggtgccgcacctttcatctggctcttcatccgccctccgtggtcggtgagcggaagctgctgcaaggccgtggttcacgagagcctcagggcagagtgccagctgcagagggtgagtctgggcgaggggcagcacctgcgaggccacctgcagggtcccaggacacaggaagaccccgagggtagatcctggaccctggaaagtcaggagcctaagggaagtgaagatgcagaaaactgagagtgcagatatggggaacgcatctggaaatcagctggcacagaggaggaagcctgagagccagggtgggctgtggagttctgggtacacgtgctgacagctggaaacatggggctgaggctgcatggggcagtgggagctcaagacacaaatctggccaggtgtggtggctcacgcctgtcatcctagcactttgggaggccgaggctggagaattgcttgtggccaggtgttcgagaccagtctgggcaacatgatgaaatctcgaaacctcgtctctacaaaaaatacaaaaaagttagccaggggtggtggtgcatacctatagtcccagctactcaggaggctgcggtgggaggatcgcttgagcctgggaggttgagcttgcaatgagccgtgactatgccaatgcactccagcctgggtgacagagcaagaccctgtttccctttaaaaaaaaaaaaaaaaaaagactgaaatctgggagtggccctctgcaggggagggagggccagacagcagggccatgggcatgggacccaaagacagacaagggagtggtggcccccgggcagttctctgtgctggaaatcacacttctttctcctttttttaaagactcacaaagcatccatattgcactgcttgggcagagtgctgagtctgttcgaggtgagtcaagttgttctctgcactgggactttgtgttcgatacatccctagccgagatcctggaactgaaaagcagcagaagggggtgtccaaggcccaaaacaaaaggcaagccttgcccagaaaggcctagctggagaagccaggggacacatgtgggcctggccacgggctccgatcctggctccatgacccgcctggcaggggagtgggggacggtgagaacagcagagcagatctcaaggaggcatcgaacctcgatgctcactcgtctgctggccctgctcctcgtgggcctctcctgctcgtgtggacctctctgcctggccaaaatggtgaaaccacgtctttactaaaaaacacaaaaattagctgggcgtggtggcgggtgcccataatcccagctactcaggaggctgaggcagggagaattgcttgaacctgggaagcggaggttgcagtgagccgagattgcaccactgcactccagcctggcaacagagtgagactcagtctcagaaaaaaaaaaaaaaagtatggaaaaggaggaagatggtgagtagagtgattgaacatcaagtaaagaataagggccggtcatggtggctcattcctgtaatcccagcaccttgggaggccgaggcgggtggatcacctgaggtcaggagtttgagaccaacctggccaatgtgttgaaaccacgtctttactaaaaaacacaaaaattagccgggcatggtggtgggcacctgtaatcctagctacttgggaggctgaggcatgagagttgcttgaacccgggaagctgaggttttagttagccaagatcgtgccactatactttggcctgggtgacagagggagactctgcctcaacaacaacaaaaaaaccagccaggcacagtggctcatgcctgtaatcccagcactttgggagactgaggtgggtggatcacctgaggccaggattttgagaccagcctggccaacatggtgaaaccccgtctctactaaaaatacaaaaattagccgggcatgatggtgggctcctgtaatcccagctactcaggaggctgaggcaggagaattggttgaacccaggaggcggaggttgcagtgagccaggatggcgccattgcactccaacctgggcgacgagtgaaactgtctcaaaaaataaaaatgaaaaagaataagggaacaatgaactctgctgggatttattctaggatgaggagaagcagcagcaggcccatgacctgtttgaggaggctgctcatcagggatgtctgaccagctcctacctcctctgggaaagcgacaggaggacagatgtgagtggtgcctgctctgggtcggggggagttatgctggacaaaggcgtagttgatgctggtccttggatgcgtttctgtccacaaaagggaggtggctcttgctgctcccggtctctcagcctccgggaaccactggtcagtcggctattcttggtacccccaaaaatgactccaccatttgagagagaagaggtgggaagttagcgtagtgtcggcccttctgggtcttggttctgagttcctcccaagacacagttgtacaaaggctcggtgatctcccattgacaggtgtcagatcctgggcgatgcctccacagcttccgaaaactcagggactacgctgccaaaggctgctgggaagcgcaggtgaggtgcggggctgggatgacgtggggagctggcctttctccctccagccttggggcaggactatctgggctcccacattggggggcaggactatctgggctcccacatgggaggccaggattgagggacaccctaagatcggttcagcactggaactggtcctaaaggacaggtacactgtgagaagagctgggaaatgcgttattcatctctgcctatccactcttgcctctcagccagccaacctcttaattttcaaatgcttgtgagctatagctgctgtcaaaatttgtgccattcttgaaagttgtcccataggtagaactgatcttgacaacaaaacttgaggctacttgagagcagaggggcgtggagagtcccttcctgcttcctcttcctgttagcgccttgcttgtcatgtcacctggtcaccaagtcatccagggctacaggcaggaaatcaagcattggtagactctcccctcacagctataaataagttgttagggccaggtgcggtggctcacgcctgaaatcccagcactctgggaggccaaggtgggcggatgacctgaggtcaggagttcgagaccagcctggccaacatggtgaaaccatcgctactaaaaatacaaaaattagctgggcgtggtggcaggcacctgatactcaggaagttgaggcaggagaatcgcttgaacccgggaggcagaggttgcagtaccactacactccagcctgggcgacagagcaagactctgtctgaaggaaaaaaaaagttgtcaggacgaatcaaagaaagctcctatttgccaaatggatagaagcttgttcttgtcaccccaccaagtgggtggcagagtgatctgcgctcaaatgctagggacaaaattacaaattgataatggcccagcccgaggtgtcatagcacattgtggtgttcacgtccaaaaagccagtctacagatttacaagaaggccagacgtgatggctcacgcctgcaatcccagcgctgtaggaggttgagttgggaggatcgcttgagcccaggagttcaagaccagctctggcaacatagtgagactccatctcgacaaaaaattttaaaattagctggatgggctgggtgcaagtggctcatgcctgtaatgccagcactttgggaggctgaggcgggcggatcacgaggtcaagaggtcgagaccaccctggccaatgtggtgaaaccccgtctttactaaaaatacaaaaaaattagctgggcctggtggcatgtgcctagagtcccagctacgcgggaggctgaggcaggagaattgcttgaacccaggaggaggaagttgcagtgagccgagattgtgccactgcactccagcctggcaacagagcgatactccatctcaaaaaaaaaaaaaattagctggatgtggtggcgtgtgccttgtagtgcagctactcaggaggctgaggcaggaggatcacttgagcctgcgaggtcaaagctgcagagagccgtgatcgcaacattgcacttcagcctgggctacagagggagaccctatctcaacaaaaacattgtttacaagaaatgcaacaacgtagttctcgtggaagttcaaggggcctcagtcaattctcacaaaagaggaaatagggccgggcgcagtggctcacatttataatcccaacactttgggaggctgaggcgggaggatcacttgaagccaggagttctctctgttgcccaggctagagcacagtggtgcgatctcagctcactgcaacctctgacgcctgggttcaagccttctgagtagctgggactataggtgcctgccaccacgcccagctaatttttgtatttttagtagaggtggggtttcaccatgttggccaggctggtctaaaactcctgacctcaagtaatctgccctcctcggcctcccaaagtgttgggattacaggagtgagccactgcacctggccaaaaaaaattaataataaataaataaactcaagtggttagaaattggaatgttcaaccttactactagtcataagagtgcacttttaaatgagatattttgggctcatgatattagcaaattatatatatatatatatatatatatatatatatatatatatatatgtttttgtttttgttttgttttgttttgttttgttttgtttttgatggagtcttgctctgttgcccaggctggagcgcagtggcacaatctcggctcaccacaagctccgcctcctgggttcatgccattctcctgcctcagcctcccaagtagctgggactacaggcattgcaccaccacgcccagctaaattttttgtatttttagtagagacagggtttcaccatgttagccaggatggtctggatctcctgacttcgtgatctgcccgcctcggcctcctaaagtgctgggattacaggcttgagccaccgcacccagcccttaattatatatatataatatccataattagatatatttataatatctattattatattataacataattatatttagtctgccagctatttataatatataatattatataatataatattattatatataatatataatattatataatataatattattatatataatatataatattatataatataatattattatatataatatataatattatataatataatattattatatataatatataatattatataatataatattattatatataatatataatattatataatataatattatatataatatataatattatataatataatattattatatataatatataatattatatataatatcatattattatataataattatatataaatatgtatttatatattgtataacatataattatataataattataataatataatatatatcatatataatattatatattatattctataatatataatatattctataatatatgtaatattatattctattatatataatatatattatattatatatattatattataattatatattatatattatataatatataaatatatattaatatatatgattattatatattattatattatatatttttatatatttatatattatatattatttatgttaattatatattatataattatattatatgttctataatatataatataatattatgttataatatctataatatatattatagatatattatatataatagatatttttatatataatatattacatattatatattatatgttttatattgtatataatatatattatatataatatatatataatatataatatatatatatttctctgtttttgggtggctagctggtaacttctgaaaatagctgtttttaataatcacagtgtttgctgggatgaagctgtgatgaggcaggtgctcctattcctgggtgtaaacattggcagaagcctttcggagagcactggggcgtatggccagagacttaacacagcttccccaggcattagccatgtaagaaactgagacctgagccacggtggaaaggccactgacatttcattatatatcttttctcatgtcatctattacttatacaaaaaggaataataattaaaacctgagccatccttgttcccgaagcttgtgaaggtttaagttaagtagggcagtgtgtccacatgcatttggtgcctgaatgggcctttgcttcagaaatggaaaactgcaacatggctgctgtctcacgctcatgtttgtcttttcttcctcagctgtctttagccaaagcctgtgcaaatgcaaaccagcttggactggaggtgagagcttccagtgagatcgtctgccagctatttcaggcttcccaggctgtcagtaaacaacaagtcttctccgtgcagaagggactcaatgacacaatgaggtgaggcattcaggccggggcttctaatcagagcggcgcggaagccagcctccaggggaagggagccctttccacttaaccccagttacctgtgacagggcggcatagagttcccttatcaccctttttttttttttgaagtggagtctcgctctgtcgcccaggctggagtgcagtggcgcgatctcagctcactgcaagctccgcctcctgggttcgagcaattctcctgcctcagcctcccgagtagctgggactacaggcacccaccaccatgcccggctaattttttgtatttttagtagagatggggtttcaccatgttagccaggatggtctcaatctcctgacctcgtgatccgcccgctttggcctcccaaagtgctgggattacaggcgtgagccaccgcgcccagccttgggtgttttttaaaaccagtaatgccaaagttatcgtggactttttggaagaaaatatcctactctgctttcttcagttacttttttttttttttttgagacggagtcttgctctgtcacccaggctggagtgcagtggcgtgatctcggctcactgcaagctccacctcccgggttcacaccattctcctgcctcagcctcctcaggagctgggactacaggtgcctgccaccacgcccagctaatttttttgtatttttagtagagatggggtttcatcgtattagccaggatggtctcaatctcctgacctcgtgatccgcctgcctccgcctcccaaagtgctgggattacaggcgtgagccaccacgcccagccaccttttttttttttgagacagggtctggctctgtcacccaggccagagtgcagtggcatgatttcagctcactgcagcctccgcctcccaagctcaagagatcctcccaccttaccctcctgagtagctgggactacagatgcacaccaccatgcacagctaattgttgtatttttagtagagacagggtatcactatgttgcccaggctagtcttgaactcctgggctcaagcgaacctcctgccccagcctcccacagtgcagtgatcttttttaagccacagaacacattgaacatcttttttttttttttgaggcaggctgtctgtcacccagggtggagtgcagtggtgtgttctcggcttgctgtaacctctgcctcgggctcaagcctttctcctgcctcagtcccccaagtaggactacaagtgtctccactctattcagaaaggcatttaccatattggggcatcatttaccgtattggggcattcccttgcgactgtccaccttctcccgctccctgcacgccccgagggtcagggttcatccactgtgggcagaccaacggctgtgggctgacttttcactttgcgtcaggtcgaggtctcaaagcgcttgtgtttgggagcaccaggaacacagtcgaaggatgtggggcctgctttggggctgggacccacggagcctcccgggcttcctgtgacatggcctctccagccttggttccagggtaaacccatgattccagagctagccagcttatttggtcgggcccaacaggtggggttgaaatcgcagacagggacacatggagaacgcccccaccagttcccacgtgcttctctttccgcaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtgagaagcccccttggcccagctggcagggacgtgctggcctttcccgggttcagggtcacctgcccttcatgtgctcctcactggtttggttttgttttgtgttgtttttttttttttcccgagaccaagtctcgctctgtcacccaggctggagtgcagtggtgcgatcttggctcaccgcaacctctgcctcccaggttcaagtgattcttctgcctcagcctccagagtagctgggactgcaggcgtgcgccaccatgcccgactaatttttttgtatttttagtagagacggggtttcatcatgttggtcaggctggtctcaaactcttgatttcaaatgatccgcccgcctcaacctcccaaaatgctgggattacaggcacaagccactgcgcctggccctcactggttcttgactcatgagccacgagtgtcccacctggtcagacatggagtgccacgctgagggccttttgcaggcaggggtggcagaacagccttcagcgtgtgggggccgctgtgtggggtgcctgcatccaggcaattcatcctggcatgcagtctcaggacccaaagtgtggcctcgctctggcaggcacaggctggactgccctgtcccctggctcctgagggcagcaggatgactgatcagggagggtggcagttggctgcccttctctgaagttgggttctaaagtctgttgccagagtttcctacactcttggagttagagagtttttcgtcccccactggtgccctgcagagcccactccagccacgtgggtgtctctcagcagcagcgtgcgtccttacacggcagcctgtccttttcaaatcagaccactgctttcctttaactaatgctggatcccctagttccgcctttggaaataacgtggaaatgattctcacaatacgatttgcatttcctaaaccagctgtccccagcatggtctacatttcccgaggaagtgctttccagaccgactcctctgtagagcctggtgggtgaggataggcttggctgcacacagcatatgtgtaagctacagagacttgtttctttcttgcacaggtaacccagaggcagaggttccaggctcaggtcattggcatgttttttgtttcatgaggaagcagaggagccccatctcccatcttaatctctgccaccaactagggtgctgcccttgtccctgtgacacctgtacctgccacattcacctttgcactgagcttagtcttgtgaccacatctcaccagacgggaactgggaggtgtagtctcttcgggcctgtgtgtgccagctcgatgcagtgtcattcccatggaaggagggagcaaaccctgccacaagcatccagagctgtcttcagatgcgctcttgggcctgaatccagcgtcccaggtcttccgaccagagacgactgaggaggtcgggcggccgcctccctggatctgactgcacatccatcactgcaacctacgacaaagctcctgggccacaaccggctggcagtgagagaataactgctaaaaacgtttcagggagctgagtccaatttcttccccaaccacaagacctgattgcagtggtccatataactatcaccacagctccctcaaatcaactctgccttattatcttttttttttttttttttaaatccggggaccaggcacggtggctcacgcctgtaatcccagcactttgggaggctgatgtgggcggatcgtgaggtcaggagttcaagaccagcctggccaacatggtgaaaccctgtctctactaaagatacaaaaaattagctgggcgtggtggtgcatgcctgtaatcccagctactcaggaggctgaggcaggagaattgcttgaacccgagaggcagaggttgcagtgagccaagattacaccattgcactgcagcctgggcaatggcgcaagactctgtctcaaaaaaatacaaacaaaattagccagacgtggtagtgggcgcctgtagtcccatctacttgggaggctgaggcatgagaatcacttgaacctgggaggcggaggttgcagtgagctgagatagcgccactgcactaatccagcctgggtgacagagggaaactctgtctcaaaaaaaaaaagattttaaaggctgagctgccccccacctctgctctcagaggtgccctgcccccaccagccatctcacaccccacgctgggctctcattggccactgacatcttgtctttttggcgtctgcagcccccacgctggcaggtgtagtccctgcgcctcttgtcctcttggtcaagtgaatgacgcatgcaacctgcagagtccccaggacagagcagccaagggacttggcctcagtccaaggggaaggtgccttgcggggggccgctggagcagcgtgttccctgatagttggcgctggttgacaacagagaacagggtgaccatcgcctagagacagtcaggattcctgcggccacacagtgccgggcacagactttccaacaacccttgggccctttgcctccaattcctagatctggtgactcacccaccttctgggtctataacatttctaccccactgatagagctgtcacgtgacaggcaaatctctgtccttggtgtcttttagcaaactgaatgctcagggcacttgggccttttgcagacatttgtgagtctgcctaacagccttgctgctttctgtctgccttgtggctctcatccctctttccagcactttctgacctcccctttgttattattatgatgattattttttgagacagtgtcttgctctgtcacccaggttggaatgcagtggtgtaatcaaagctcactgcagcctcaacttcctgggcttaagcaatcctcccaccttagcgtcccaagtaactgagactataggcacgtgccaccatgctctgctaattttttattttttaactttttgaagagatagggtcttgctttgttgcccagggtggtctcgaactcctggctgagctgtcctcctgcctgggcctccccttttttaaatgccccttgtcagccacaggcagctggctccattatgaagcctctgtttgtcaccaaagcccaacgccatggctccctccctaccttgaggcctcctaaagccttgggtccctccgccccacccctgccccaggaagtgggctccaccctgagaccccttctcggcgttgcaggtttatcagtaaagagatcctgaccatccgggaggccgtatggctcacggacaacacttacaagtacgaggacctggtgagaatgatgggcgagatcgtctccgccttggaagggaagattcgagtaagcagcggttccattttccttattaatcttcgttgtcgctgtgctggagggtgggggtgggcattcagctttcctgctgtgggagggcctcatggactcagagagcagctgtctctgctgtgcccaaagccatggagcaggaggccacggttgcaccacgtcgccatctgcgctggtgcgctacgcgtgcagcatcggcgtgaacatcatccgggccagaccctgcgctgggcctgcatgcggcactgcaccaaggagcccccgagcgctgagagcccacaccccgtcccggctgtctaggtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctgctcctggccagactgacgcacgggcagagtaaggagtggcccttcccagggatgcctgtgtcggggaaggtgctgacataggaggaggctgtggggaggaaaagagtccagcatccatttgtcctggttacttcttggggggtgagatacagcacggctcctaccttcagtgatgtcccagatttctgaccatgagcctgcacgccctatgtatgggtttttttcaaaactattttaaaaggattgcaaccctgagctccaagaaactccacagcagagcccacagagctatagagcgggagtgttcaggcggctgtcaccacagcccctccgtcccctccatcccctccgtcccctccatcccctccacccctggcctgctttcctccccagcacagccctggaccactcagctgtgggacctcaccggattctcctatgaagacctcattccctgcgtcttgagcctccataagaagtggtgagttttggccgggcgcagaggctcatgcctgtaaccccagcactttgggaggccgaggcgggcagatcatttgaggtcaggagtttgagaccagcctggccaacatggtgaaaccccacctctactaaaaatacaaaaattagccaggcgtggtggtgcacgcctataattccagctactcaggaggctgaggcaggagaatcgcttgaacccaggaagcagaggttgcagtgagttgatatcacgtcactggactccagcctgggtgacagagcaagactctgtctctaaaaacaactggccaggcatggtggctcacacctgtaatcccagcactttgggaggccaaagcgggcggatcaccgaggtcaggagttcaagaccaacctggtcaacgtggcaaaaccctgtctctactaaaaaaaaaaaaaaaaaaaaaaaaattagctgggcgtggtggcatgcgcctgcaatcccagctactcaggaggctgagacaggagaatcacttgaacccgggaggcagaggttgcggtgagccgagattgcgccattgcactccagcccaggcaacgagtgaaactccatctcaaaaaaaaaaaaaaaagttccagtagtttcttatctcacacatttttcacattgagagcagctgctcccaacccaagctcattgcacaggcagcagaacatactagaaaaaatgagggcatctccctgacccgtggtaacttgtgcgtgttgtcaagttgtcatctagctcaggcactggcacaccgtggccctcaggcggcatctggctgcttttgcgaatggggttttcttggcagcagccaccctcactggtttccacattgtctgctgctgcttttgctctggcggtggctgagctcatagtgcagcggacaccacgtggcccccagtcaggaaaatactccccttcccttgagagaacagcttctgccctgatgcagctgctgggatagagctatcctctgtctcactgagaagatggagactgcgggtgggtcccttgcgccgtcgtgcccggatgtgaccccctgtctgccccagccccactgggcttccctccacctgccccggcccctccgcccttctctctggtgagcctggcccggccctcgccacatctaagccccttcactcgccctggcagcttcccttcagcccacgttggtttgttccatgcagttcatgaagtccctaccgtggtccaggcgctgggggagagggcaggacagagagttcagaggtcaggtcgtgacgagagaaacagcaggcaggcgcgcggggcaggtggcgcgggcgggggcgactcccttcagggagcgtagccggggtcacctgggcatctgagtccagggcaaagggggcagccatgccagggcccagtgcagaccagtggggctgggggccatgagtggagtcatggcagtgaggggtgagggggacaagcacggggctgaatttgtacccggccagccatctccgtctcccctcctcagctgtgctcacagacttgctcctcccacctctcggcacccccactccctggtctcccacttccccgcttctgccatggcttccttttcctcagccaaatccagcagactcagcggtgtgggcttttttttccttttttgagttgggggcccaggctggagtgcagtggcaccatcctagctcactgcagccctgacctcccgggctcaagggattcttttgtgtcagcctcccgagtagcagaaaccacaggcaccagcacagcaggcctgggtgcttttctccagccagcattacgctgaccctccctccctcgggggcttcggcttcctgccctaggccatgcggcctaggtgttggtctcccttcccacccaccccaaggggccccggaattctggctttctgccactcctcagactccttcctgggagacttcaccacttccagaattcaggccacatctcaaccttgacctgccacccccctgccagcgtgactcagccaacggcctgttgcctgttctggccctggtgggtcgtggtgcatgaagccctgtgtgcccagctgaggcctccaccagccgctgctgcttctccatccctgcatcctcgtcagtgcagtttcctcgtgcgctcacagcttggggactggagctatccgtggcggctgcccggcctcctggaacactgtggcagccgccccgcacatgtcccgtgtacgtcacccagggcctcgctgtccggcttccaggatgagatcagaactccctgggggtctcgatgcccttgagcagccccttctgtggcccatctgctttttctcccaccatgctgtgctccagccacaggggacctggtggcatctcccgggctttggcatgtgctgctgctcatgctgctttctcctgcagtgcccggaccctgtgccttctgggcaaggaacgaggctgacagtagaagggttcgcatgggtctcgtcccacccacctttgcttatggggagcacagatcgtcccaaccctggccaccaaaagctgtttctgggctgcgtttattctcttcctcctgaagaagttaattttttttccaaacaagataaattagaaacgttatttagaaactacacttcctttgattgtgtgatttaacgggcttttattcacacagttgtgcttgtcatcacaacaatcaaattgatgacattttcactttccccaaagggacaacacacccctcagctgtcaccctcccgttccccccaacttcctcagcgctagatgacccccagtagtctactttctgtccatggatgtttcccattctgtacattccatataaatggcgtcatcggacaagtggccttctgtgtctaggtgatttccctcgcggtaacgtttgctgggtttgtccatgtggtgtgtgtccctgctttgttctttttcatggctgaataatattcccctgcatggaccacatgtgtttatccatcccgcagctggtggacattttgcctattgtgaacagtcctgccatgaacattctagtacaggtttctgtgtggacatagtttttcctttttcctgggtctttacctagagaggaattgctaggtcctgtggtgactgagtttaaccattcggggaactgccaggtcagattccagagtgactgcaccattttgcattctcattgctcacttcagtgaactgaagctaaaaatggggtgggggtgcctcacatgtccactccacgtgactctgtttccagcttccatgatgacgcccccaaggactacaggcaagtctctctgaccgccgtgaagcagcggtttgaggacaagcgctatggagaaatcagccaggaagaggtgcctccctcccgccacctgggcgtctcatggggtgctggggtgtgggcgggcctcaccctcggggcctctgcaccccctaactctagcttcccctcaggtgctgagctacagccagttgtgtgctgcattaggagtgacacaagacagccccgaccccccgactttcctcagcacaggggagatccacgccttcctcagctctccctcggggcggagaaccaaacggttagttaccctgcgttctggctgcgccatacaatgctggcatcctcgtgccggcccagttccctcagcgcttcctcacacagagaggcccccaaggcttgtcaggggagcagcagatcccaggacagtgaccctgggacggagccctgcagtcatgcctcgggcccctgcgtaacctccactgtctccagcccaggtctccttcctcagaggctattgcctctcgctctgactgggctccctgtggaggaagatggtttcgagcacgcgggagcctagcctggctctagccctgcccgtgcctgtcatgcgcgtcctggacttctctgctccatgatgctgctgtcactcccggcactcgagctgtgacctgagtcacatccccagcacttccctcgccacccgtgtggacctgtttacccgcctctcctatctcagcaccttggctgttcctcctggagttaacttcctctttctacctcacccgcctggagaactcctactgattccacaaggccccgatgaacagggccctccctgtgctgctggccctgcgccgtgacccctcagcaccatgtgcaccagtaaccttcccaagggcaggcactgggtggctgggtctttcctgtcaatataggaccaggcagggctgcctccagaagcgttgtgtcgggagtgggctcctggcaggagacctcaactcctggggagccctggggaagcagccaaagcccctgctgctgcttcctccccaagaagcgtgacagcactttccattgtgtggaaggcaggagacctgaccctcctgtgtcactccacacacgcaccgactccctggggccagggtcatcacgaggaaagtccatgcagatacgcacggctactccaggagggggcctggccctggccctgtgctcagcctcgctgtgttaaacccgcttctcagaggccccccacagccccatcagtcttctgagacagacccccacgggtgacactgggatagctctctccaccccccgccctccaccaggccctggggtcaggaagtggaaaggctcagctggtgtggcggcttttcccaggctcacgcccacacactggcctctagccccatcctgagcaagacttgaccccagttgggtgtgggtgtcagcaccgcccaaggccaggccattccatgcaatctgcctggcgccgggctaagcactgcctgcaccttattaatcaacaccagaggggccgggtgcggttgctcatgcctgtaatcccagcactttgggaggccgaggtgggcggatcacctgaagttaggagttcgagaccaacctgcccatcatggtgaaaccccgtttctactaaaaatataaaaattagctgggtgtgatggcgggcacctgtagtcccagctactcaggagcctgaggcaggagactcacttgaacccgggaggtggaggttgcagtgagccaagatcacaccactgcactctagcctgggcgacagagcaagaacacctcaaaaaaaaaaaaaaaaaaaaaaaaacactggaaggtggcatcatcctagaggtttccaggggaccagatggttggcccacgccccacagctgagccgggtgggctgggcttcacacccagacctggggcctgagtttgcctgagctgtcctccaggttggccctgcctgaagggcttatacctgttctagcttcaccggcatcttcttcgtagcagaacctttgggagcacgtggtgacaggctggggcacgcgggtgttagaggcaggtgtggagggcctggcctcccagcgccgccgtccatgactgggtctcctgggctctctccaccttgcaggaagcgggagaacagcctccaggaagacagaggcagcttcgttaccacccccactgcggagctgtccagccaggaggagacgctgctgggcagcttcctcgactggagcctggactgctgctctggctatgaaggcgaccaggagagtgagggcgagaaggagggcgacggtgagtgtggggccagggtgcaccagaagggacatcacacagagggtggctctcaccgagggcctctgggcacccggccctgtgcgagcgctgtgggaggaagatgtgcacagagtgcggggtggggccagctcctgccccgccggggagtgtgtccagacatggggagagaggaggggagagcccccaaaagaccacagctgctcccaccacacagggatgagaggacttaggccacacctatccggctcctgctcattccgtgttgggaggacctcactaggatgagggaggcagagaccctgtctggagttcatggagatccttctaggcctgtagtctcatgcctgtaatcccagcaatttgagaggctgaggcaggaggatcacttcaggctagaagttcaagaccagcctgggtgacacagcaagacaaaaaatttaaaaattagctgggcatcgtggcgtgcgcctgtggtcccagctactcaggaggctgaggtgggaggatctcttgagcacaggaggtgggagctgcagtgagccgtgatcatgccactgcactgtagcctgggcgttctttctagaatgttgtttgaggtgtgcccacgtggtatacgtgacactcctcactgccctgctgggatcactgccctgtgcaaaccccaggcagactgcggggtccttgccagaagcccagttagtgtgagtcctgtcagtttcccggttgcttgcttctgcgtccacttggcttgagctagatggccaacttgtcatctccacatttgttggagtcatggcgggcagctgtccaacttggaagaggcatgtcacccacgcttctcaccacaggagggtaacacaggggaccgtagcaaggtagaagattcttgacctggacttcagggtcctgacctggcagggggtctcccctgatgcttgggtgtgacatgacttccctccccaccaaccttcctgcagtgacagctcccagcggcatcctcgatgtcaccgtggtctacctgaacccagaacagcattgctgccaggaatccagtgatgaggaggcttgtccagaggacaagggaccccaggacccacaggcactggcgctggacacccagatccctgcaacccctggacccaaacccctggtccgcaccagccgggagccagggaaggacgtcacgacctcagggtactcctccgtcagcaccgcaagtcccacaagctccgtggacggtggcttgggggccctgccccaacctacctcagtgctgtccctggacagtgactcgcacacacagccctgccaccatcaggccaggaagtcatgtttacagtgtcgtcccccaagtcccccggagagcagtgttccccagcaacaggtgaagcggataaacctatgcatacacagtgaggaggaggacatgaacctgggccttgtgaggctgtaagtgtgtcagcacatttgccgcagtggatgtgtactgagggggctggaggcgaagggtgggagcatagcataggaacgctgcatagaccatggaggcctttgcgcagagagcagagaggatgacttgcggccaccaagtttctgtctccgcgggagtcccgtgcaagccatcagaatgttgaaatgagggtgaagagctcagatccctctctttggaaagtttagcctggaagcagttggccacactgtgtggagggcacctctctgtcccttccgtgtctcactgtctctggaagcttcagcccatgtgtgtcctggtgttcccagccccaccagagccccgtgccgggagctgacagctttcacgcttaaggcacgtgtgacctgggtagtcagacaccacttgagcccctgcccacatctgctggtttggggcttcagtggggagctgacagctgtgagcacaccactgtcccctcatccacctcggcctgcatggggcacccacttccttctgggtggggcttccatggtaagggggcctgcgtccctgcacactgcgaggactgccttggccacaggcccactccctacgacacgtgactcgttttagagctctgtcccagaggcgttcgtatgtgacccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattcccaccattatttaggttcacctgcaaaacaaaaatcttactccagcccctcaatgccatcctgacacactttatgcaaaaagaattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgcttttttttttttttttttggagacagttttgctcttgtctccccggctggagtgcagtggcatgatctcaactctcaactcactgtaacctccgcctcccggatactcctgcctcagcctcctgggtagctgggattacaagcacccaaccacgcccagctaatttttgtattttcggtagagacgggatttcaccatgttggccaggctagtctcgaactcatgacctcaagtgatccgcccacttcggtctcccaaagtgctgggattacaggcatgagccacggcgcctggcccccaaatgctcttgaaccggaaacccagggatgggagatgctcactgagctgctgcttttatgtgtgctggtgctatgtgtgttcatgtccgcggcagctgtctttttgctactataagggaattctggccaccctgggtggggtgtggtcggggtgagaacccaagcgttggaactgtagacccgtcctgtcgactgtgtgcccctgggcatgtgtgagcctcagtttcctcatctgtaaggggggcaatgatacctacctcacaggggtgttgtgaggattaaatgtgaggaggatagtggca

SEQ ID NO: 627 - DNA, 11066 bp, Homo sapiens
gtcacgtgggcgcggtctcagctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcaggtgggcgcgggccggggactgcggggctggggaccgggcggggtgcagggtgcggggccggggaccgggcggggtgcagggtgcggggccggggacagggcggggtgcagggtgcggggccggggaccgggcggggtgcagggtgcggggccggggaccgggcggggtgcagggtgcggggccgaggtcaggcccgcgatgcgagcgcccacccactgcgtccccagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtgcggcccggggccggcaggggaacccaggggaggagctctgagctccatgcgacacttccttttctgtggctgcaggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggtgaggtgaggctccctggctgaggtggagggggctcccggagcaaccagcgccctcattttcaaactcacgccccaccccccacccccagcacgtattccatggtcctgagtctggcctcctttgatgaccggatctgggcctgggtcccgcccctgtgcttctttatcagttgtcgctctgcctggcctccctagaccctctgtcctccgcagctgtctccacactgctggctcagcaccgtctgagccataggccgtccccaccccctgcactgcactctggctgcctccaggcttcagaaaccatccccttaaccaaggccgcaggggattctgtgattggcacagcgatagtccctggtcaggctcttcctccctaacctgtctgatgtgtgactcagtggaacacgccttccagaagagactccccctgctcctgtactgcttgccccacgcttccattttctttcctgcccggaagaaatttggttgtccttggtctttttttattttaatttttacttaggttctacagggttaactttttgctgtatgttactactattcaggctcctcttggctgtacctgtgctactgttttttactgaactatttgagagtaggttgtatccaacatgctttttttttttgtttagttttttttttttttttttttgagacggagtctcgctctgtcgcccaggctggagtgcagtggcacaatcttggctcactgcaggctccgccccccagggttcacgccattctcctgcttcagcctcccaagtagctgggactacaggtgcccgccacctcgcccggctaattttttgtatttttcgtagagacggggtttcaccgtgttagccaggatggtctcgatctcctgacctcgtgatccgcccgccttggcctcccaaagtgctgggattacaggcgtgagccaccgcgcccggccagtttttgttatttttaagagacagggtttctctctgtggcccaggttggagtagagtggtgtggtcatagcccattgcagcctcattcttctctgctcaagcgatcctcttgcttcagcctcttgagtaggtaggactacaggtgtgtgccaccatgcccagccaattttaacattttttgtagagaaagtctcactgtgttgcccaggctggttctgaactcctgggctcaagagatcctcctgtcttagtcccccagagtagctggcactacgggcttgtgccaccacacccgactaatttaaaaagctttttcggccgggcgcggtggctcacgcctgtaatccctttgggaggccgaggcaggcggaccacgaagtcaggagatcgagaccatcttggctaacacagtgaaaccccgtctctactaaaaatacaaaaaattagctgggagtggttgcgcctacctgtagtcccagctacttgggaggctgaggcaggagaaccgcttgaacccaggaggcagaggttgcagtgagccgagattgcgccactgcactccagcctgggcaacagatcgagactccatctcaaaaaaaaaaagttttttgtagagacagggatctcattatgttgatcaggctggtctcaaactcctaggctcaggagatctactgcctcggcctcccatagtgctgggattataggcgagagccactgtgcctggcccatcatgcctgtttattccttagtacttaactttttttttttttttttgagacatagtctccctttgttgaccaggctggagtgcagtggtgcgatctcggctcactacaacctccgcctcctgggttcaagcgattctcctgcctcagtcgcccgagtagctgggactacaggcgcccgccaccatgcccggctaatttttgtatttttagtagagacggggtttcaccatactggccaggctgatcttgaaatcctgacctcacgatctgcccatctcagcctcccaaagtgctaggattacaggcgtgagccatggtgcccaaccaatacttaactatttcttaagataatgaatattttcttatggagccacaagagttagtgagtttagaaaatgaaccctgttaacagtactttaattgagccgtctgtgttctagttctgtccagagcccccgccgttttcccctccagcacaggattcatttcaggatcatcacttgcgttatatgcccaaggggtccctctcttggtgtgtgggcagagccagagctgggaacaatgggggtggtgtgtgggttctgggctcaggcttcctggatttggcattggcctcctgatgtcatgtatcggctggaagactcaggacaaccttctgcctttctgagcctccgtttcctcaaacctgaagtgaggatgaaggcagcgtgcatggcttaggggcgttgggtgctcagcatcgtgcgtgagatgctgagtgttcaccactcagtattagccatggatgtctttttggaaatttcccacagccctccccacacagagtcaaatgtcaaaaacctgctgccaactggcacctggttctcacagctgctctctggggctctggggcctgtcagagccacctgtccaagattcaggattcagcacatcacctctgccccacccctaccggcagcattcctttcctacctgtccagcctcttctctgtccccagccacattccccactcctgcccccaaactcttggcctagaaggccctggcctgctccccaggcctcctctgctaagccttgcctacctgtccccactgtgccccccactgcctgcgcatctctggccagcacaggcgtgggaggaactatggctcttcttccttaggaagagtctctgacaagtaggactttgttttcttcccagcatgcactgcagtgcaggtgtcttaacccttggcgcacacacaggatgaaggcagagagccaactattgagggtgggaattgggaagcctcctgcctggatcatcttagaaactggaggccccttttcactcgggtctcccctgtgccgtgcacgccacctcttccagggcccactcaccctgggtggaattggatggccactttgccagaagcttcttcggtcttttgttgtcctgttctggtccattaagaccaccttctcttttctggggggtttccgcctgtcctttgctacggtacttggagacaggtgagctcactttgttctttgctttaagtctgttacctcctgagccaaggtgaggcacctccagggggcagccaggcccctgcctctggccccgcacaccctctacactttgacctttccggctgtttacctgcctggagtgtgcctcactcccctcccctcagttgatcttttactgtgctctctctatgtagcgccctcttgctcccttctaaaactccattctggaaaaactcagccattgtctttttttgtttgtttttttcctgttttaatctttagtgagcctgtgtatccatagggcttgtgaggaaaaacagcggccctttgccccaaccagcatccaccctagggacaatcactttcaactcagtggactcttggaatttgcgcccgtagctctaaaaactgtgctggctgcttctcagtctttcagctcagggcagaatccattgccttccaccaggagagctgaacatcagtgctctcgtggctccgtgagtcctcttagcccctttctctcctctcatctttcctggtagttccccataattgtgatgagaatacctgtgtaggtcagtcatcggagtggtgtgaagggatgtgtggcccagtgacatctcagctgccatttctgcttgctttgccgtgagtgttctttgctttgtttcttggctctaacccaattccaggcttcctcctgattgtttcactcttctctctggccacttatttatttatttttcgagatggagtctccctctgtcacccaggctggagtgcaatggtgtgatctctgctcactgcaacctctgcctcctgagtttaagtgattctcctgcttcagcctccggagtagctgggattacaagcacctgccgccatgccctgctaatttttgtaatttttagtagagatgggcttgctccatgttggcaaggctggtctcgaactcctgacctcaggtgatccaactgccttggccttccaaagtgctgggattacatgtgtgagtcactgtgcccagccaaatgttgctttttttttttttttttgagatggagtttcgctcttgttgcccgggctggagcgcaatggcacaatctcggcttactgcaacctctgcctcctgggttcaagcaattctcctacctcagcctcctgagtagctgggactacaggcgtgtgccactatgcctggctaatttatttatttttatttatttatttttttgagatggagtctcactctgtcacccaggctggagtgcagtggcgcgatctcggctcactgcaagctccgcctcccaggttcacgccattctcctacctcagcctcccaggtagctgggactacaggtgctcgccaccacgcacggctaattttttgtatttttagtagagatgcggtttcaccacattagccaggatggtctcgatctcctgacctcgtgatccgcctgccttggcctccccaggtgctgggattactggcgtgagccaccgcgcctggccaatttttgtatttttagtagagatggggtttctccatgttggtaaggctggtctcaaactcctgacctcaggtgatctgctcgccttggcctcccaaagtgctgggattacaggtgtgagctactgtgcccagcccagtgttcctttttctgccatcctattcttgtttcagggacagaagacctcttattggctggagggtgtccgtgatggcccttttccctgtccatctctcctcgtggtctctgcttccctgcctggccctgtcctcttttgttcgggctccttttcgaggcttgcccaggctgcctgctgaccttggtggtgtgctttctttcagaagaggtgtcagcaggccagctgggggcacccagcctgcaggaggggcattatgggggtactcgtaggttggggtccctggctcctttctcttgggctggctgggttccctgagaagagtctagcagtgctcagaggggctgggcctggctggcaccctgctgagcaccttgagaacacacatttcgcaagttcctgctgtgcccacacctacccttgccaatctgctctacttccccgggggcccgaccggcacactcagggcaggcactcttccgttggtccccacgtcaccctacttctcaaggcaccatcctgagcctgtgggggtcacttcccccactgcgtgcactcccccagacctgcccagtgtccctcttgccaagcctccaaagtctggctgtcttctttctatcatctgctacccccccaaccccgcccccaggtttagggctcttaaaagtcttaccgttggccaggcatggtggctcacgcctgtaatcccagcactttgggagactaaggtgggtgtttggtcaggagtttgaaactggcctgacctacatggtgaaaccccgcctctactaaaaatacaaaattagccgagcatggtcgtgcacgcctgtaatcccagctactcgggaggctgaggcaggagaatcgcttgaactcaggaggcagaggttgcagtgagccgagatcttgccattgcactccagcctgggcgacaagagggaaactccattccaaaaaaacaaaaaaagtgttactgttgtgtgggttggggagttcaggggagggtacaatccagccaccatcctcacctgaagctcttctctctgggaaggctcccccagcccatgcctgtgttggagagagggagtgtgcactggactgcctgcccacctgttagcctctgagatgtgtggtgtgagcccgtgtccccccgttccctgacacactcggtcttcctgatggcgtccagctccggccatggtgtggaccacacacagtgctgagccctggccatgcccacactgagctctgccccagggtccctgctgctcccaggagcctcctgcctcccagccctgctccctgggctgctgtgcccagggccaccctcagtgcccacaagcctgcccacatggccagggaccgctggcatcccacacacctatcatttcttcctgctcctgccatgggtccttcaattctgccggctgtgctttccctgacccctgtgaggggacaggcggccggggctgggctgggtgctgggctctgaactctgacctgagatctctggccttggctaggctgtggcctctgggaatgggctgtgggggacagggctttaacagctggttccccccaggttgttcctcagatccctgtgaagagtggtggtccccatggggcaggggtcctcggtgagtggctgacctcctccccgcccccaccctgggaggctcctgcgggacctgttggcagcccccacccctccagatgcccagctggtggggagggcaggtgataagggctgggtggggcagggacctgctggagccacttgctccctcctcccagggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctaggtgaggggccggctcggggtgggcctgcttgggggacctgggccaggtgcaaagtctgaatccaggtcccgcagggcactcagtggctgacctgcgggcggcagaggatgctgtgtggagcggagccaccttcatcacccacctcttcaacgccatgctgcctgtgagtgctatggggccccaggggcggggctggggtcccagcagcccctgctgtcgctcagccatcccttccctcgcccctgcccagttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccagggtaagctgcggcaggtggccaggacaggtaggatgactgggctagcaggttctgagcctcttctcccccagggctggtgctggtcaccgatgccatccctgccttgggcctgggcaacggccggcacacgctgggacagcaggaagtggaagtggacggtctgacggcctacgtggcaggtgagcgccctgacccactgggtcccaggtcccagcccgcatgccaggtggcccacgacccccccagagcctgccctctctgctctcaaggcaccaagacgctgagtggcagcatagccccaatggacgtctgtgtccggcacttcctgcaggccacaggtcagtgagcagcacgggtgcgggtttaggtggtctgtgagtggtgggtccccaaggggctggaccgggtgcccggactgtagcccaagctctgcccacaggagctcctgggcattgggtacttggtgactcaggcccagggtgacaggcagaccagcagggtccttgttagcctgctgcagagtccctgagacagggagtgctggtgtggttgggggctgttggcaaagccatgtgggcttggggactgtcacctagctgtgtcccccaagcaggctgcagcatggagtcggccctggaggctgcatccctgcaccccgcccagttgctggggctggagaagagtaaggggaccctggactttggtgctgacgcaggtgagggcctgtcgcagggtcaccgggcagcctggccctgcctgtagactctgttgttcctggggcggcctggacagggccagggagggtgggtcctccctagctccctcctctcaggtgggctgccggctgccagcctcagttgtagccccgtgttgccatcaggccgggctttctggtgttgcagacaaggccaggcaaggggttgcagggagcattgtccagtacctctgtccatctgtgatgggtcagggtgtcttgcactagtcgtgtccctgggcctcagtttccccaccagcgtcgggttgttggggagcagctctggggtaggtgggcggccccactcctgccccctactcattgcccggctctgtcccagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgccactgttctcttccctctgctgcaaagcccagttaaggaaatgtctccaggtccaaagagataggatggtctgggccccacctgttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctga

SEQ ID NO: 628 - DNA, 4245 bp, Homo sapiens
aggagcccggcgcgcgaaacgctggccggccggcgggaactaggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacggtgagccgcgtcccgcaacgcgcttcccacacccccggccgccctacctgcgttgggccgggggcactgaggccgaggagggccccagcgcccaagtccagggctgccccggccctggcaccgccagtagccgcggtgacaaagctgccattgtcccgggccgcgctgccagcttccgttttcccggcgggtgggggccgggtcaggagaggggagcagagtagggtctgagcctgcttaatccctctgagccccaggggtagggagcatggtgtccggcctctgtaatcccagcgccctgggaaccccctcccgccagcacccagccgggagatggtgttgactgcgatgaggagggcccgggaggagcctcccagcgccgccgtcctgacgcccccgccccaagccgctctgtcttggggctccgcctggtggcggctccttcttcccccaacaggcgtccggcccctcctccgcgccccgcggagctctgctgacacagccctgcccgtccttgagctgccccaggcgggcaaggggccctgagcggcctggcccagcctgggtgcctttcccgagcttttgccaggccacattctcacaagggtgggcagccttcggagccccgtttggcccctgggaggccagtactagaggccggcagggaggggtggagacctcccagaaagggctaggctggaatcaaactccccagggagaggtctggggagatgggacaagcccctcgaagcccccttcccttcattctggacttgtcttcccccacctggcctcacccctttatagaagataaaaaggcccagtgcctccatttgtctggacacttatggagaggggaggacttgggttgggaagagcaagccaagtggccccgggctggcatcactgctcatgtgtcctcttcacaactcaacttgaggtttcgctgccttagccttctcctgtgacctgcttgtatggggagagcagtgtgggagtgggacggcctaggcctgtcctctgccattgcttacctgctgggctcacccggggccggtcactcagcccctccaagtctgtttcctcacctgcaaagtggggatcatggtctctacttcccagaccatcctgagccatgataagtaaccagtgccaaaagccttttgcccagggcctgtctctggccaaggccaggccgccaactggatgacagcattacctggacctgtcttgccctgtcctgtgttgtgtctgaaccgtggtccccttgaggatgtgactgaaactatctggtagatgactgtctccctccctagggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggtgagtcagggcccaagggatgggagctggagccaccggcgggagaggcatggggcacgcatacaagccatgggtagggaagggcgggtggaccctcacaatgacatgccctctcctgttctctcctcttgtgcaggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaagcctt

SEQ ID NO: 629 - DNA, 7452 bp, Homo sapiens
gtggacaccacgtgatcctggggaggcttttgcctcttccgagggctctggctccagggcctccctgttccaggggctaggtgtgccttcctcaatgctgcttttggctatgagggtgacgggcccagggcttcagggccccagatcgcaccttgccatctggggtgtccgtcctttgtcccccacagcaggctgtgtttgcccattttctcctctgccatgggtggagatggatctgaagttgggtgttgaagcctctgaccaaggctgtatcttgttttgaggccctgcccggtttccagggaccacatctggggccaagaggaagaaccgaactgggactaggttagctgtgctgggtcagggcctgggcatgggctgtgaaagctggggactgggaccttcaggccctctattgagatctttgcagaagggggtggatttaggaagctactgggctgggccagggcgtggaaggcactgaagccgtagtgtgtcccagcattagagtcccagagtttagcttggcggggcaggggcaggtggtggggagaacaggaaataggccaggctctcggcggagtctggcagctttgagccttctctgggcttctggggttttccccaggctcctgagccagccaggacatttcttaatcccactgtcagccttccaagaagccccgcccactgggctcagtcaaggcaggagcgactgtgtgtcacccctttccctagaatccagccccactgccaggaaaagggagctcagggcatggaggtgaggctgggactctcccacatctgcttgttcctcatacccacctccttagctggcccctggaagatgacctcgaatgccagcccaagtgagctgggcaccagccaggggaggccaggtctggcagctcattaccatgggagggagggcacgttctctccgacgcccgtcttcgtgtctcctccctccctcgccttcctccttcctagctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggtagctcaggaggagagggctgggcacgggagacccaggggtggacaggtggtgttctggctcccctccccagggccttgatacttacagtttggagggggagcagggactgcgctagctgaaagaatgtcccaaggcagagacctctgaaccaagtctctgcctgtcacttgttttcaacgagtgaaaactggcagcagttggttctaggatctcagggaggaacaggatttgaggcccaagccccaagagcaggcattgcccaagggatggctgggtcctgagtacaggggacccgggggtacaagtagggtgagagtggggcccaagccacccctcaaagacttgggctttgtctcggcctcttgggcttggatagagaacagtgcccagtgtgactcccccaaatatctgacctcttcgtcctgctctgcctgaatggatgtgtgaccttgagcaaatcactgccccttcctgagactcagttttctcacctataaaatgagaacaataaaccccaccctgcccacctcccagggctgctgccaggtcagaggtgaagaagggctttgcacctggtgaagtaactaacccaaggtctggctttcattctacactgtcaggctgcatctgcagccaaagtctggggactctgcaggtgggacttggtccagaggggactggcaaagatgctttcagagctcccctcccacccccaccccgagctcttatgtgtgtctgcttcaactctgtctcccaggtcttggaagccctctggggaactgcagaccagagaggttgagtcacagagcacggcaagaaaggacagggttcagaccacctttctcctgccccagacactgccccttgctgtatgtgcatgggaggaggagcagggactgtggtccctggggtgactggagagaattggctgcagggtctaggaggaaacagggaggggcctccaagggttgagccctaactccccatgcttgagcaaccactgacctgagggagcagtctgaacccctagggaaacaatgactcccaaatactgctttttggcaggtgtggaactgagggtaatcacactgtgtgtcttctgcttcccctggagataagtgaggtctgacctcactacaggccagagagttcctagcctccttcctccttcccaatatttgccaggctcggagaagaggtcaggcctccactgcagcaggagagcttttggtagactcaaaggaggacatttgagcaggagtgagccagaggaaggttttctcatgtccagcttgggtccctcaaaatatagggatgcaggtatattctggcctggaggcaggacccctctgaagccccctgctgacctgtgttttgtcctgggacttctccccgctgagggtcttttctctacaaggctgagctcctgcaggctcatggagtgcagtgatgctggggaagaggaaagtcctttggggaagcagaggcctgaaggcagggacttcaggaaaatcttgagggactgtgttggtgtcaagggtcaaaaagcagagaagggacctggtgcagtagctcatgcctgtaatcccagcactttgggaggccaaggccagaggctcgcctgagcccaggagtttgagaccagcctgggcaacgtagtaagaccctgtctctattaaaaaataaaaaaagtagagaagggtgcaggttggggcctcaacctaatctctggccctagtccctgggcacccagctgggggaatcaaaaggagctcaggttttgaggcttctttcctggtccccaagacccagagtagagttcacccctccattctgcccttctaaagatgtcctggtccactcctctctctgggtaccccaggcaccccagatctccccagctgagcagccctgagagtctcccactctcatacccttcctaccatcagagaaacgtcttgctacagaacaggatcttctagatcccagaccagtcttgtcagctgtgggtcctcctcagccttctgggagccactcccagctgcaaggcctaggccggctgtccagggggctgccctttggtccctggggctgcatgtgacccacctgcgggagggaaagaggctctgggctgcctagatacagcactgaggctcttccctccttggcttctcactccttccaactcccttctctctgagcctctgttgttcctccagctccctccttttcctaagctcggtggagcttaagatgcataagtgggtcagatgggctgtatcccacccctgcctccccacaatgtctccttgctcctggcagctggctgagggccttcagcataggtggggtccttgaagagtgaggcccctcgctctcctgcacatgcagccccactgtggccccgtctgctacagcccctctccctttgttaggcctggggaaccttcagccctggatgcagggccttatcgcggtggccgtgttcctggtcctcgttgcaatcgcctttgcagtcaaccacttctggtgccaggaggagccgtgagtgctgcccaagggtccctgagcaggcagggtgggcccaggaccactgctcttgctctagtagcagtgagaagggcctcagaaaccctgtgtccaatcctccccctgaggctcaagggaagggaaactgaggctcaaggtcatggggtgggttggtgacagtcgggatgagggaatgagagcctaggcttgctggctcccagacctgggcactgtgggccccacagctctggtgcccactccctgtgagttttggggaaacggcttcgcttcttggagtcttggtgtttccgcagagccaggatagcggcccagcctgtgatgggggctgtaaggacctctagaaggtgcggtccctcctttgggtgggtcagctgtggtacagagagggcatgggacagacacacctcctgccctcacaggctcagactggagtgagctgtcagaagttcaagagttgctgctgagggagagcgcagaggacactgcagggcctgacctggtccggggtggccagagaaggcttccccattgcacatttatcccgaaacctgactaacgaggaggagtcactaccaggatagagtggcgtgggaagagcgctgcagttgagggaagggtacacccaggtcctgagttaggggcacggcaccagggctgctggggacagacacacacaggtgaagggcaggtgggctgaaatccagctcactctgcactcaccaggtcaggaccctcaggcaaggctgcctctgttcccaggggcatttcttcccagatctcacaaaggtggcctggtggcttgagtgctagccccatgcagggttgctgaggaaaccccagtggctcagtgggtggagacagggatggagacacctgagatgaggctggtgaggtgggcaggcccaggccaaccaggctcttgcacaccaatgacctgagctttggactttacctaagtgagcaggaatccagtgacaagttttttttttttttctttttttttggagatggagttttgctcttgttgcccaggctggagtgcaatggctctatctcggctcactgcaacttctgcctcccgggttcaagcggttctcctgccccagcctcccgagtagctgggattacaggtgcctgacaccacgcctggctaatttttgtatttttagtagagacaggtttcactctgttggccaggctggtctccaactcccaacctcgtgatccgcctgcctcagcctctcaaagtgctgggattacaggtgtgagccaccatgccctgcctccagtggcaagtttttaagccagtttcgggatgagacacggccttagcagaatgactctggctgcctcgtggcagatgcacggcagcggtggaagagtctccagtctgcaggcctggagagtggtgagggggtgggcatgaggtcaggagggggtctggactgtagcggtggcagagaggatgaagtgaagagacgagtctgagcgctgtctaggaggtgggcaccctgggagttggtcgtcacagacagcagcggactcgaggggaggaaggcaggaatggcatctaagtttctcatggcggatcactcaccgaggcccagaacacaggaggatgagcagacataggggcaactgctaagtttaattggagacatattaagtctggggtgcctgtgggatgtctaaggaaatgagcaggtgttcgggtccctgtaaccctcatgagagcagcttctgggaggcttcagggagagcccacactgcagggggtttaaacttgagtaagagacgagaaggttgttgttgaatgcccttcagatagactttctccacctgccccagctctgcctgaagggccaccaaccacatctgtgcccactgcccaaggcacgagctggggaaatttggggcagacactgcatcctgcagggcctgctgtggaggctgaactgagggcgtctgggacagagagaggctttggactcaggataaatcttttgcaaatatttggccccccactatggagtggggagaaagtgagagaccccatgggtggggccagtagccgcggctgacatgccctgttgcacacagctctgggaagggcagttgctagccttcgggcttgtgagaaccaggacccagaatagggtctgcttggacgaggggggccccactgaggagccccactgatgaatcccatccccagggagcctgcacacatgatcctgaccgtcggaaacaaggcagatggagtcctggtgggaacagatggaaggtactcttcgatggcggccagtttcaggtgaggtgcagggcagggctgcccggtctgtgctcccagggcctaaggagaatctcaagacaggtgctgctggggggaggtggctggggaggacggagactcatgtgggcaaaagctagtgaggcaatgggggctttgtgaggattgcagggctctgtggggaaaatgcagcccctgtgtggggcgagggctgcagaaggggacggagacttggtagggtagggttcagcgtaggggaggggactcatagggcagtgggtacaatggggacaaagggttcaatggaggaaggaacaaatgagtgagggactcagtgaggggaaggctcagtagaggatgcagctcagtgggggatgggttcactggggtatggactcagtgggggatgggttcactggggtgtggactcagtggggtatggactcagtggggtatggactcagtgggggatggagctcagtgggggatggagctcagtgggggatggattcagtgggggatgggttcagtgggggatgggttcagtgggggatggactcagcctcagtggggcatgggctcagtgggggatggactcagcagggtatggactcagtgggggatgggtttaatgggggaattggttcagtggggatggactcagttggggatggagctcagtgggggatgggtttagtggagcatggtgtcagtgggggatgggctcggtgggggatgggctcagtaggacccagtggtgcagcagtccacaggaggagggagataggtgtcagggaggggatgctgagaggcctccagtctcggatgcataagcccagatgtggtcaggacaatccccttctgggagtcaagtgtttattctggaagctattactgtcacaagtgcaggaaggggcagggagaaggggatagaatgggaggagcgatgacccatcaggcccatgccttcttctttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttcca

SEQ ID NO: 630 - DNA, 50622 bp, Homo sapiens
aagcccggcctggcggcggcggtggcggtagctgccgtggcggcctctgcgcatgctccgtcgcctgcccgccctggccgctcgccgcccgcccgcccgacggagacggtgaggagggggaggggtgggcgcgcgggcgcggggtggggtgggggcgggggggcgggcgcgggggccgcgcggcggccggcgagggcgggcgggcgcgcagggggcggggggctgctgcctccgcgggcgcctccccacgccctgtgcgtgccgccgccgccgccggggagcgagcggacgtcgcggcgccgcgggggggtggggggacgctgccgctgggtccgcccgagccgccgggccgcccccagcgcagccggccgcgccgccggggctcgggccccagaccagggcggcgggaaccggcgagtccaccactgggggggccccggcgcccccggaccgaggggcccggaagtactcggctcaggggccaggaggggccggagtgactccggactgagagggccaggcgcccaggaccccatcgaggggtccggggagcctggggtatccccaaaggcggggtccggggagcaccgggcccttggatgaggagctggttggaggcctgggtcctgcccagtgggagggggacgataggtgctggaagcccggatgcccgcctgggaggagaccctctcggagccttggcgggagagcaagagtacagagtgggttcttctgaggagagcagagtccagcttatcccgaggggcgcggtagaggcctcggccactcagaacaagggaaaaaagggcaggttttttccaaaggcagggaaggaagaggagctctaaggggaagtgagcaggcccaggtctccccacagatgagcgcgtggtaggaagactcctagagcctcctgaagtacgaaagagcagcgtccaaacctgaggggatggaaggtgtctaggtgcctcttgatgtctaggtggagaacaaagtaacccgctcggtcaggggatggagaaacctatctttttgagagaagcagagatcgttgaggaaagatgcttaaggtgttcccgctttctgaaatgacaggaattggccaggtgttatctaattgaggggcaggagagatgaaggcaaaatctcaacccgagggtctttggaggatgatccacaagacaagagggtgaagtcttgacctagacagcagagcaggcgcagccctggattctctcaagatgagagaaatctcaaaaccacttcctagtagacacagatggggccttgattggtgtctgtttaggccaatcaagacgggttttaggaaaagagactgtcagacataattctagtcttgagggattatcttcttcctccttgcctcttctaatagttaccaaagtgcatttggggaccctttttatttatttatttatttatttgttttttgagacggagtctcactctatcgcccaggctggagtggtggctcactgcaacttccgcctcctgggttcaaacgattctcctgcctcagcctcccgagtagctgggactacaggcgcgtgccaccacaccagccaattttgttgttgttgttgttgttgtttgagacggagtttcactcctgttgcccagactggagtgcaatggcgcgatctcagctcactgcaacctccgcctcttgggttcaagcgattctcctgcctcaccctcccgagtagctggggctacaggcgcccgccaccacacccagctaatttttgtatttttaatagagacggggtttcaccatgttggccaggctggtctcgaactcccaacctcaggtgatcccacatcctcagcctcccagagtactgggattacaggcgtgaatcactgcgcctggcccaaccaggctaatttttttgtgtttttagtagagacggggtttcaccatgttagccaggatggtttcgatctcctgaccttgtgattcgcccgcgttggcctcctaaagtgctggtattacaggcgtgagccactgcgcccggcgggggaaacttattcaatggttgcaccgtctcctaatttgagagccttatatcaaggatgtatatttaatatcttacttaaatgattttttttgggttcctatttacttcagcaaatacattgtataggtagcttctactcagcttcattgggtttattgtgggggcagtattttggtcttgccctaagccaaagtccaccggactgtagcgggatgactccaaataactcttatcccatcgctccctcaaacatctacataatagtctccagtctgtgacttagaatttcacctcctctggatacttccctcagtgtttctgcataatttacttgttgacctcattacatcttgtagcactatggatcacccactgaatgcatgagaagaaataaaggggatatcaaggagttttggcctcaagtaataataaagttttaacttggatttttccccccgttttaaacaaaactgtagtttagagtggaaatttcttttttattttatttttttgggggaacagagtttccctctgttgcccaggtgagagtgcattgcgggatctcagctcactgcaaactcgatcctctcagctcagcctcctgagtagctgggactacaggtgcgtggcactgcgcccgcctaattttgttagttttctggcgggcgctgtgatttatgcctgtaatgccagcactgtgggaggccgagacaggcggcctcccaaagtgagcggcctcctcggcctctctttagctcgagttccagaccagcttgggcaacatggtgaaaccccgtctctacaaaaaatgacaaaaattagatgggcgtggtggagctagttgcctgtggtcccagctactctggaggcttaagtgggaggatcgcttgagctccggaagtcgaggttgcagtgagccgagagcgcaccactgctctccggcctgggtgacagagtgagactatgtctcactaaaaaataaataaataaatatataaaaaataaaacgactacacagtcttcaaaagttataatagagtgtggaataaataaatattttgggctgggcgcggtagctcacgcctgtaatcccagcactttgggaggtggaggcgggcggatcacctgaggtcaggagtttgagacccacctggccaacatggtgaaaccctgtctctactaaaaaatacaaaaattagctgggcgtggtggcagatgcttgtaatcccagctccttgggaggcaggagaattgcttgaacttgggaggcggaagttgcagtgagccgagaccgtgccattgcactccagcctgggcaacaagagagaaactccgtctcaaaaaaaaaattaaataaatattttggggttagaaaatttcagaaaatctcgtactcatttttacttttttttttaacttttatttttatttatttatttatttatttatttatttatttatttttgagacggagtctcactctgtcgcccaggctggagtgcaatggcgcgatcttggctcactgcaagctccgcctcccgggttcacgccattctcctcctcagcctcccgagtagctgggactactctcccgccaccactcccagctaattttttttttttgtattttttgtagagatggggtttcaccgtgttagccaggatgatctccatctcctgacctcgtgatccgcccgcctcagcctcccaaagtgctgggattacaggcttgagccaccacgcccggcctacttttttaagtccccagaaagtgccaatattattattattattttttgttattatactttaagttctagggtacatgtgcacaacgtgcaggtttgttacatatgtatacatgtgccatgttggtgtgctgcacccattaactcgtcatttatattaggtatatctactaatgctatccctccccactctggcctgggtgacatattgttcctttttttttttttttttttgttttgacggagtctcgctctgttgccaggctggagtgcagtggcacaatctcagctcactgcaacctcctcctcctgggttcaagtgattctcctgcctcagcctcccgagtactgggactacaggcacatgccaccatgcccagataatttttttttttttgagttttgctcttgttgcccaggctggagtgcagtggcgcgatctcggctcagcgcaacctctgcctcccgggttcaagtggttctcctgcctcagcttcccgagtagataggattacaggcatgtgccactacgcccggctaattttgtatttttagtagagacgtggtttctccatgttggccagctggtcttgaactccccacctcaggtgatccgcctgcctcggcctcccgaagtgctgggattacaggtgtgagccactgcgcccagccagtattactcctttttcattactagttccaatgtccttccctgcaatcatgtgacacttgtccatttttcgtttgtttgtttttttgagatggagtttccaggctggagtgcagtggctgtggcgcgttcttgtctcactgtaacctccgcctcctgggttcaagcgattctcctgcctcagcctcctgagtagctgggattacaggcacccacaaccacgcctggctaatttttgtatttttagtagagacggggtttcaccatgttggccaggctggtctcgaacccctgaccttgtgatccaccctccttggcctcccaaagtgctgggattacaggcgtgagccactgcgtgcagcctgacacttgtccttattcaaacatagcatcttgccacattatagacattggattttcaggacacacaaaaatgaatttagagtgggtcagaaatcatttgtttagttttctggtggctatataagcagcgatgtgcttagtttcaaagtgttgtttttgtctttggaaataactacaggctgggcacagtcgctcaggtctttaatctcagcactttgggaggccgaggtgagaggattgcttgagcccaggagtttgacaccaggctaggcaacatagcaagacctcatgtctacaaagaagtaaagaaattaggccaggcgtggtgtctcatgcctgtcccagcactttgggaggccgtggtgggtggatcacgaggtcaggagttcaagaccagcctggccaacatgatgaaaccctgtctctactaaaaatacaaaaaattagccaggcatggtggcgggcacctgtaatcccagctactcgggaggctgaggctgagacagaattgcttgaactagggaggtggaggttgcagtgagccaagaccctgccattgcactccagcctgggtgacagagcgagactccgtctgaaaaaaaaaaaaaaagttaatgaaaaaaaggaaaacagaaatgagcagggttggtggttggtacccatagtgccagctactccagaggctgaggtgggaggatcacttgaggccccaaggtcggggctgcagtgagccaaaaacactgtactccacactggtctgggtgacagagggtgaccctgtctcaaaaaacaaaacgaaagaaaacaaaaacccaaaaaactacggaacagttaattttatttatttatttatttatttttttgagacggagtctccctctgttccccatgtacaaaggcacaatcttggctcacctgcaacctccgcctcctgggctcaagtgattctcctacctcagcctcccgagtagctgagattacagacatgggccaccacgcttggctaattttgtatttttagtagagatggggtttctccatgtttgtcaggctggtctcttaactcccgacctcaggtgatctgactgcctggtcctcccaaagtgctgggattacaggtgtgggccaccgtgcccggccagaatagttaattcttttttttttttttttttttttttttttgagacggagtctcgctctgtcgcccaggctggagtgcagtggcgggatcttggctcactgcaagctccgcctcccgggttcacgccattctcctgcctcagcctcccaagtagctgggactacaggcgcccgccactacgcccggctaattttttgtatttttagtagagacggggtttcaccgtttttagccgggatggtctcgatctcctgacctcgtgatccgcccgcctcggcctcccaaagtgctgggattacaggcgtgagccaccgcgcccggcctttttttttttttttttgagacggagtcttgctctgtcgtccaggctggagtgcagtggctccatcttggctcactgcaagctctgcctcctgggttcacgccattctcctgcctcagcctcccaagtagctgggactacaggcgtgcgctaccacgctgagctaattttttgtatttttagtagagacgaggtttcaccatgttagccaggatggtcttgatctcctgaccttgtgatccacctgccttggcctcccaaagtgctgggattacaggcgtgagccaccgcgcccggccccacaatagttaattcttaagcatttcacataaatttggcatatttcttttacatgtgttcacatagaattccagagagagatcggccggggtggctcactcctgtaatcccagcactgtgggagacaggcgcgggcagatcacttgagaccaggagttctgacaccagcctggccaacgtggtgaaaccccgtcactactaaaaataaaaaaagccgagcatggtggtgtgcacatgtcatcccagctgctactcggaaggctgaggcacaacaatcgcttgaacccaggaggcagaagttgcagtgagcggagatcccgccactgcactccagcctgggcaacagagtgagactctgtctcaaaaaaaaaaaaaaaagaaaagaaaagcaagtttaaattaaaaaaagaaaaaagaattccagagagagttgtatgatttcacaatgcatactccaaagccccgaacgatcaactcactcatcttgcctcaggagtttttgttgctgtaaacaagagctacttttccatttacactcagcttagagatgaccttgcatttagagttggtttcaggttacctgcaaggaatatggtatttagggtaatgagtgatacttaacccaaacttgcttctctaaagaaggtcagaattgccatgttgaatcagacccatgacttagagtgacattgagagatgtattgtggatgattataattatcctctctgataaactctcagaaggctagagaagaagccagaacattcctcttgggtactaatgtatggtgtgggtaaagagtaaaatgtgagttcctattgaggaaggtattaagaagttagtcaaccatctattcagaatgttgtagaggggacttagcttagggtagaaagttgaaattagaagcatccttctaaatctgcttctttaacaattaactaacccattttttttgcctaaggtattataggttgagtatccctaatctgaaaatctgaaaccccaaatctccaaaatctgaaaatttttgagccaacatgatggcataagtgaaaaaatcccacagattagtagttaacgcaggctctgtttcattcacaaaattattaaaaatattgtataaaattggccaggcgtggtggctcacgcctgtaatcccaacactttgggaggccaaggtgggtggatcacgaggccaggagatcgagaccatcctgactaacacggtgaaaccctgtctctactaaaaatacaaaaaattaggcggcatggtggcaggcgcctgtagtctcagctacttgggaggctgaggcaggagaatggcatgaacccggaggcggagccttcagtgagccgagatcagggcgctgcactccagcctgggtgacagagcaagactccgtctcaaaaaaaaataaataaataaataaatacaaataaagatattgtatgaaattgccatcaagtggccgggcgccatggctcatgcctgtaatctcagcactttgggaggctgaggtgagtggagttcaagaccagcctggccaagatggtgaaaccctgactctactaaaaatacaaaaagattagctagacatggtggcgggcacctgtaatctcagctactctggaggctgaggcaggagaatcacttgaacccaggaggcagaggttgcagtgagctgaaattgcatcactgaacagcagcctgggtgaaaaatcgagactttgtctcaaaaataaaaaagaattgccatcaggctatgtgtgtaagatgtatgtgaaacataatcgaattttgaattttgtgtttagacttgtgtcctatcccccagatatcacattatgtaaatatgccaaaattaaaaaaaaaaatctgaaatttgaggcacttctgatctcaagcatttcaaataagggatgcataatctgtaattttttttttcttttttttttggagatggagtattgctctgtcgcccaggttggagtgcagtggcacgatctcagctgggactacaggcgcccatcaccacgtctggctaattttttgcatttgtagcagagacagggtttccccgtgttagccaggatggtcttgatctcctgactttgcgatccgcctgccttggcctcccaaagtgctgggattacaggcgtgagccaccgtgcctggcccataatctgtaatttttgaaaatttaaagcacatttttggaataatgattccataagtttgctacttgccaaagtattacatcttttaaattaaatgtgttatagcacggtgcttgacaatgagtgctagctcaataaaggttagctgattcttttaattccgcctacatttttatggttcaaattttgaagatatttatgggttcagttattctaggattagatggtatttgtatgctttatcacattcctttttggccttttctagactcgagggtcttaattgttttggttctactgttggtagccagctgaaccagttcattgatttttattttatcttattttattttattttggttttaaggagtggagagtttaataggcaagaaagaagggagaagaggccgggcatggtggctcacgcttgtaatcccagcactttgggaggccaaggcaggcggatcacctgaggtcaggagtttgagaccagcctggccaacatggtgaactcccgtctctactaaaaatacaaaaattagccgggtgtggtggcaggtccctgtaatcccagctactcgggaggctgaggcaggagaattgcttgaacccgagaggtggaggttgcagtgagcctagatcacaccacaccactgcactccagcctggggtataagagtgagacttcgtctcaaaaaaaaaaaaaagaaaggagaagaaaggaagaagctccccttacagagacagagggaagggggctccaaagccaagagaggagacccttgattttcttttctagtgtttttgtttgtttgtttgtttgtttgttttttgagacggagtctcgctctgtcgcccaggctggagtgcagtggcgcaatcttggctcactgcaagctccgcctctggggttcgccattctcctgcctcagcctcccgagtagcttggactacaggggcccgccatcgcgcctggctaattttttgtatttttagtagagatggggttttaccatgttagccaggatggtcttgatctcctgagctcatgatccgcctgcctcggcctcccaaagtgctgggattacaggtgcgagccaccgcgtccgtctcttttctagttttatataattttattttgaggcagactcttgctttgtcacctaagctgaagtgcagtggcacgatcttggctcactgcaacctctgcctcctgagtggctgggactacaggttcacgttaccacacccggttaatttttgtacttttagtagagacagagtctcaccatgttgcccaggctggtcttgaactcctgagcttaagcaatccgcccacctcagcctcccaaagtgctaggtatcagccacggtgcctggcccttttctagttgttttttttgtttgtttgttttgttttgttttgtttttttgagacggagtctcgctctgtcgccaggctggagtgcagtgccgtgatcttggcccactgtaacctctgcctcccgggttcaagcaattctcctgcctcaacctccggctaattatgcctggctaatttttgtatttttagcagagacggtttcaccatgttggtcaggatggtctcaatctcttgatctcgtgatccgcccgtctcgacctcccaaaatgctgggatcacaggcatgagccaccacacctgaccttttttttttttgagatggagtttcgctttcttgcccaggctggagtgcagtggcaccatcttggctcactgcaacctccacctcctgggttcaatgaattctcctccctcagcctcctgagtagatgggattacaggcgcccaccaacacactttgctaatacttatatttttagtagagatggggtttcaccctgctggccaaggtggtctcgaactcctgacctcaagtgatccaccggtcttggcctcccaaagtattgggattacaggtgtgagccactgtgcctggcccctttctagttttaaggcttcaagttgcaggagttcatattctgtactgtaatatcttgcagttaattttttccctgcatatccaatagtgtcatgtatctcttttccttctgtagtttctcaagagcaggtattgttgctcctcatatctaaggaatctaactctagctgatgtgaggtagagactcaatataatatttgttgaactggccataatgatgagccataagctgtatagcttagcctagctgcctaagcaaatttatatccctcccagataggaaggcagaaagttctagaaggggccaggcatgatggctcacacttttttttttttttttgagtggcagtttcactcttgttgtccgggctggagtccaatggcacgatctcggttcacccaccacaacctctgcctcccgggttcaagcaattctcctgcctgagcctcccaagtagctgggattataggcaagcgccaccacgcctggctaattgttttgtatttttagtagagatggggtttctccatgttggtcaggctagtcaccaactcccgacctcaggtgatccgcctgcctcggcctcccaaagtgcagggattactggcgtgagccacccctcctggccagatggctcacacttgtaatcacaacactttgggaggccaaggccggatgatcacttgaagccaggagttcaagaccagcctgggcaacatagtgagatcctgtctctatctttaaataaatacatataaaaataaaaaagaaaattctagaagtcttttaggttgagtcactaattggacaaaaatgtattgcatatctgctgtgtgctcagatttgtttacaaaggtttagataagcagttttgtagataaaatgtaagtctgatatttgaaaaccatttattacactcctgtcctgggcactgtggtagccttgggggaattgctgaataagaaaagcaatcctggccaggcgcagtggctcatacctataatcctagcactttgggaggctgaggtaggcggatcacgaggtcaagagatcaagaccatcctggccaatatggtgaaacccagtctgtactaaaaatacaaaaattagctgggcgtggtggtgcgtgcctaaagtcccagctactcaggaggctgaggcaggagaatcgcttgaacctaggaaagggaggtggtagtgagctgagatcatgccactgcactccagtctggggaacacagcaagactccatctttaaaaaaaaaaaagaaaagcaatccttggaatccttggccaggcatggtggctcatcccagcactttgggaggccgaggtgggcagatcacctgaggttgggagttcaagaccaacctgaccaacatggagaaaccccatctctactaaaaatataaaaattagctggacatggtggggcatgcctgtaatcccagctactgtggaggctgaggtgggagaatcacttgaacccagaaggcggaggttatagtgagctgagattgtgccattgtactccagcctgggcaacaagaacgaaactctgtctaaaaaaacaaaacaaaacaaaacacaatccttgcttttccaggacgtacagactgaggaggaaaagccaacaaagtgagatgatggttgtgacgggggtactgcaggtgctgagagatcaagaacacaaactcaaacctagtgaaggaattcacagaaggcctccccaaggaagtgatgtttcaagtaaatcacaaaatggttagcagggactagccaaaaaggaagggaaagagaattgcttgaacctgggaggcagaggttgcagtgagccaagatcgtgccacagaactccagtctgggcaacggagcgagaccgcgtctcaaaaaaaagaaaatagtttagcagtggctttgtggagaagtgagctttgaactggactttgaagggagaagatgagggagaaaggcattaaagacatttcaggcttaaggaataaagggcaaagaaatataaaggtacattatgctatgctcagagtacattaggtggctggtatggtattaggacttaagattcttggggtatgatagttgcaggtaagaccagatgagtattttgggaccattgagggaattcagagtgccgtgcttaagtatgtgtgttttaggcaaacaagtgctgtgggagaggtgagatgtggattagatcttctgactacactttttttttctttgagacggagtttcgctcttgttgcccaggctggagtgcaatggcatgatctcggctcaccgcaatctccacctcctgggttcaagcgattctcctgcctcagcctctcaagtagctcagattacaggcatgtaccaccgcgccaggccaattttttgtatttttagtagagacagggtttctccaggttggtcaggctggtctcgaactcccaacctcaggtgatccacccgcctaggcctccaaaagtgctgggattacaggtgtgagccaccacgcacggccctgactacacgttttgtactcaaacttgcatccattgtgtgcctactctgtttgggcacagtcgtagtcatctttacatactcatatattaaaataaatacagtgctcttacctatactctcttaagtgactctctcttttcaactgtgaagactaataactgcagaatatcttggggtcctctgagttttcattaagattgggacaatgcttggagtaactttagagtcaaggagcacatggtgctggacgttggtttcctcactaactctgcaagggagatactgggcaagattatctctccattcagtctgaggcaaagagttattaagaagtcccaggcgtggtggctcacacctggaatccagcactttgggaggctgagacgggtggatcatttgaggttaggagttcaagaccagcctggccaacacggtgaaatcccgtctgtactaaaaatccaaaaattagctgagtggtagtggcgcacacctgtaatccaagctacttggggagggtgaggcaggagaatcgcttgagcttgggaggcagatgttgcagtgagccaagatcatgccacagcactcgtctgggcgacagagtgagaccctgtctcaaaaaaaaaaaaaaaaaaaaagtcttagaggtcatacaggtgaattcagcatttattaagcaactacatgataaaagtcatcttccccttcccatgcagctcagttcagtctccctccacagatactgagtattttaaaggatggagaacttgaggcaaaatggctgtttgcacagaaagtagatgtgattcctaatttccaagagcttcctgtttggtgtggaactggtaatgtgctacaaaccaactctctggaaaaacaaaatactctgatttgtagtgcttgtcaatttcgggtctgtttacgcccagcatcgctgatttcaagctgtcaacttagtgtcactaaactcgaagttggaagagatatgtgtgcacaatgggttctcaggagctgttagagcttgctgcagaacaccatgggatgagtcacacgtactaagaaaacctatactagcaagtgactgttgaggcgtttctggaaggatcagagcctgtgatagcccatctcacagttcccatcctttttagaggcccatggtctctagggtgctctaggcattatcttggcagtcctttcatatggttgacttcttttcttttcttcttttctttttttttttgagacggaatttcactcttgttgcccaggctggggtgcaatggcatgatctcggctcaccgcaacctccacctcctggcttcaagcgattctccttcctcagcctcctgagtagaggggattacagatacgctccaccacgtacccggttaattttgtattttagtagagacagatttctccatgttggtcaggctggtcttgaactcccaacctcaggcgatccgcctgcctagctaggcctcccaaagtgctgggattccaggcgtgagccaccatgcccggcctgttgacatctttttaaaccagattaagttattggtgcttcttgttcccgacagcagtcccagctatctgacttcatgtgaaagatggctaatgcagaagtgagtgtcccagtgggggatgtggttgtggtacctactgaaggaaatgaaggggagaatcctgaagacactaaaacccaagtgattttgcagttacagcctgtgcaacaagggtaagtggctagagatttgggtattctgaagtattttgggaagcttcaagggtggggaaattataactttatggttgcttagcacaatggaacatttaacatcaatcagagctggctcagttttcatctgtataatatactgtattgcgtgctgtatttgtcattttaatacttattaccaacagttacttgtttccttgtatctgcttctcttctccaccttgagctccttgagggtaagttgcatggctccctcatcttattttattattatttttcttgagacagagtcttactctgtcacctaggctggaatgcagtggtgcgatcatagctcactgcaacctcgaattcctgggctcaaaagatcctcccactttagcctcctgaatagctgggaatataggcacataccactgcacctggctgatttttcttttgttcttttttctttttttattttcataacatattttatttaacccaatatacccagcacattatcatttcatcatatactcaatttaaaaattccaggcctggccgggtgcagtggctcacgcctgtaatcccagcactttgggaggccgaggcgcgtggatcatgaggtcaggagatcaagaccatcctggctaacatggtgaaaccctgtctctactaaaaatacaaaaaattagctgggcgtggtagcaggcgcctgtagtcccagctacttgggagggtgaggcaggagaacggcgtgaacccgggaggcggagcttgtagtgagccgagatcgcgccactgcactccagtctgggcgacagagcgagactccatctcaaaaaaaaaaaaaaaaaaattccaggcctacatggatggagctggaagccatcatcctcaccaaaccaacacaggaacagaaaaccaaacactgaatgttctcactcataaatgggagttaaacaatgagaacacatggacacagggaggggaacaacacacactggggcctgttggggggtgagggggtgatgagagggaacctagaggacgagtcaataggtgcagcaaaccaccatggcacacatatacccatgtaacaaatctgcacgttctgcacatgtatcctagaactttaaataaataaataaataaaaattccagttctaatcccactcttacacagttatgaatcttcagcataaccatgaaggcatgatttacttcagagttcaaatgttgacttttttagtttttgtagagataggggtcttgctttgttgctcagtttatctgcactatttacagaggctccttatgtgtttaccaaaagactgtgtagctagagtcagaggatatcaggcaaggcaacgaccataaattctctgaacccccatggaggggaaattatcaagctgagtctagcacctactacaatacaatgtattatgaaggtgttggaaaaagataagatttaaaaaggggttctttttttttttttcgttgagatggagtctcactgtatcgcccagactagagtgtagtggtgggatctcagctcactgcaacctccgcctcccaggtttaagtgattctcctgcctcagactcccaagcagctggcactacaggctcttgccaccgtgcctggccaatttttgtatttttagaagagatggggtttagctgagatcatgccactgcactgcagcagtaggtgacagagcaagactctgtctcaaaaaagaaagaatacaataatgtagacttaccttttaagctctagtaaacataatgatgattcgtagggaatgtcaatatcttatgatgccttaacgttttgaacatatttcgtgacttttgactatggccatagtagatatagagaattaagctcaatccatcactatcctgagttactttagataatttttccctgataaaaaatcttgtttacggccagtcatagtggctcacacctgtaatctcagtactttgggaggccgaggtgggcggatcacgaggtcaggagttcgagaccagcatgaccaacatggtgaaaccctgtctctactaaaaatacaaaaattagctgggcatggtggcgcatgtctgtaatcccagctactcaggaggctgaggcaggataatcacttgaacccgggaggcggaagttgcagtgagccgagattgtgccattgcactccagcttaggcgacagagagagactccgtctcaaaacaaacaaacaaaaagaaatcttgtttacttgtaaaaatatagactacctcctacttgccaccgttaagtgcaatttactggttgttgaaattacttggctgggtgcagtggctcatgcctgtaatcctagcactttaggaggccaagatgggaggatcacatgagcccaggagttcaaaaccagccagggcaacatggcgagaccctgtctctacaaaaaatttaaaaattagctaggcttggtggctcacacctgtagttccagctactcaggaggctgagctgggatgatcacctgagcctaggagattgaggctgcagtgagctgtgatcatgccactgcactgtaacctgagcaacagagtaagaccgtgtgtcaaaaaaacaaaaaaaaggccgggtatggtagctcacacctgtaatccctacactttgggaggctaaggtgggcagatcaggagttcgagaccagcctggccaacatggtgaaaccccgtctctactaaaagtacaaaaattagccgggtgtggtggcacgcgcctgtaatcccagctgcttgggaggctaagggaggagaattgcttgagtctgggagatggaggttgcagtgagccgagattgcactactgcacttcagcctgggtgacagagtgagattctgtctcaaaaaaaaaaaaaaaaaaaggacattattcatacatgagaatgtattcttttaagagatttttcacatagtggtcaacttaggatgagtttaccagtcttatttgaagcagtggtttctcatgtttatcacaatcctcattccctgaataaccatttattgggtgctttgccatgttccagtcagtcaactacatgctgggcatacaaaattgaataaatgaataagccataatctgtgcacttggggacctcttagcctgtgctcaaggggagacagacagataaacaagcatacattgtgataggtgttatgacaaaacccaacgtacagctgggtcacaaaggaggaagtaagtgattatattgaagggattaggaaggaaagaaaagcatcctagaggctacttattaaaagacagataggagattggtgcagtggatcatgcttgtaatcccagcattttgggaggcagaggcaggaggatcacttgagtccaggagttcaaggccagcctgagccacataggaagaccctgtctctataaaaaaatagaaaaattagccagatgtggtggcatatgcctgtagtcccagctactcaagaggctgaggtgaaggattgcttgagtcagggaggttaaggctgtagtgaactatgatctcaccactgcattctagcctgggcaacagaatgagaccctatctcacacacacacacacacacacacacacacacacacacacacacacacacacacaaaaaaagacagtggagaataatgttctgggaagtggcagaaataagagaaagaaggtataagaaagatggcacttttgggaaccacaaatagtttggcagtgccggggcctggattttaaggtgaggtttgggaagaattgaaaccaggggccagatcttaaagaagcttaaatatcatacaaaggatttggagctttattttaacaatgaggagagagggtgtttgagggattttaaggaggaaatcacatgattaatctggtgggaatgtagaagattagttagatgcaaggatactagtctagagatgatgaggcctgaattaaggcagtagcagtggagatagagacagggagggaggatggatagtgttaaagtgatgcatctagcaggatttggtgactgactatgtggagttgtgaaggaggaaatgaaacaaatctagtatgattcctagatttctgtctacagtgtgctgagtggtgctattaacaaggatggagagtataggaagaagaatagtttgagggtgggtgggaaaagggaacttgatggttattttagacataacgaattcgacaaagtcctgtgggacttccaaatgtatttatttggctgggcacggtggctcacgcctgtaatcccagcactttgggaggcggaggtgggcagatcacctgaggtcgggagtttgagaccagcctgaccaacatggagaaaccccatctctactaaaaatacaaaattagccagcgtggtggcgcatgcctgtaatcccagctactcgggaggctgaggcaggagaatcgcttgaacccgggaggcagaggttgcagtgagccaagatcgcgccattgcactccagcctgggcaataagagcgaaactccgtctcaagaaacaaacacacatacaaatgtatttattcatttagcagttggctgtgtttgaatgtgaaattcagaagggaggtctgtgctagaggtatcactgtggaggtagtcattgatacaaaggagaatattcaggcagtgctttcaagtaacaagatgcaataattagcacatcagctttattacagaaattaaataaaggatgttgattgttgatatatcaagttacattatctgagcccataaatgtagagatatcttggagagatctgcattatataaccttctctaagtggtgcctctagtcactcctagttactttggatgtagtttctctcttacttttcttccactaggctttgctcgtgtcaatagtttggttatggtaccttaaaagatgctaaaatgctaaaaacaaacaaacacccccccaccacccaccacccccagcaaaatacaccgtttccagcaagggacatcagctttttagtcagcgtggttcttcctatctcaaactatctgctggtactactttttagtcttttcagggtaattccataatatgaattagttgtgtacttgtagcaatactatgccatgggcatttaaagttttttttttcttttttgagacagagtcttgctccatcgcccaggctggagtacagtggtgcgatttcagctcactgcaacctccgcctcccgggttcaagtgattctcctgcctcagcctcctgagtagctgggattacaggcgcgccaccatgcctgactaatttttgtatttttagtagagacggggtttcaccatgttggttaggctggtgtcgaactccacacctcgtgatccgcccgctttgtccttccaaagtgctgggattacaggcgtgagccaccgcacacagcctaatttttttgtatttttagtagaggtggggtttcaccacgttggccaggctggtctcgaactcctgacctcaggtgatctgtccacctcaacctcccaaagtactggaattacaggtgtgagccaccatgcccggcccatttaaagttatgaaaggagctgggtgcggtggctcatgcctgtaataccagcactttgggaggccgaggcaggcggatcacgaggtcaggagattgagaccatcctagctaacacagtgaaaccccatctctactgaaaatacaaaaaaaatttagtggggcgtggtggcgggctcctgtagtcccagctactcgggaggctgaggcaggagaatggcgtgagcctgggaggcggagcttgcagtgagccgagatcgcaccactgcacttcagcctgggtgacagagcgagactctatgtctcaaaaaaataaataaataaaaagttatgaaaggagtggacatttatttttattcagttttttctcaaggtgaaggtaactgtttgtagatgtcctagagaaatattgtagctttctgttcaccctttgcaactaaaaagcatggactgttccactactgagatttaaaaaataaagttatgaagggaaaagtctggtgtaatacagtagcaagtggtggtataaataaataagtagcaaaaattactttcctttgaggtgaggagagttgtggattcattttcatggtagaagctgctaagcaatcctgggaggtttggagtttaaatacaatgggaaactagtcagagttataaagtatatttattttatttcttttgagatagtttgaaacaaatttcttaaccccatgctgtgaatattaattttttcatgatttatgtagtttgtttatcgatggacacttttacaacaggatttatgaagctgggtcggagaacaacacggcagttgtagcagtagaaactcacacgatacacaaaattgaagaagggattggtaagggtttttttgtgtttttttttttttttttttttgtcattctaatacctttgactttagcttccttggttgagttttcttgccatctgtgccttatgtttttctcccatccctgtgtgccctaccagtactacagccctcgattttgatggtggtacatcttgagacaccactgactaagatgctagggtcgtcagttggttggttaatgtcaatttggaagggtaactgaaaagactttttgtcgataaaaatcccatatagaaattggagcctcaaagttgatccctgtcattaaataagttgttgatgatgactgatgaggtattgtctagaaggcagtcagtggaaagaaactggaaagaaaccgaaatttaacaaaccttagtttaaatcccaatttctcatctctaaatgtgtccttgggaaagtcagttagcctttctgaagcccatatacttacatttaacacctaggaaacaattaattaattaatttaaaaaacatctggtcgagcgcagtggctcacgcctgtaatcccaacactttgggaggctgaggcaggcggatcacctgaggtcaggagtttgagaccagcctggccaacatggcgaaaccccgcctctactaaaagtataaaaattagctgggtgtagtggtgcgcgcctgtaatcccagttactcaggagactgaggcaggagatcccttgaacccgggaggtggaggttgcagtgagccgaggtcacaccactgcattccagcctgggcaacaagagcgagacatcatcctaaaaaaaataaataaataaaaccacctacaccaggcgaggtgactcatgcctgtaatcccagcactttgggaggccaagacaggtggatcagttgaggtcaggggttcaagaccagcctggccaagatggtgaaaccctatctctactaaaaatacaaaaattagccgggcgtggtggtgtgtggtatatggttataatcccagctacttggaaggctgaggcaggagaattgcttgaacccaggaggcagaggttgcaatgagctgagatcacgccactgcactccagcctgggtgacagagtgagactccatctcaaaaaagaaaaaaagaaaaaaacacctaggaaacaatcattgcctcacaggtttgttgtaagaactaaacaagattatgtgtgtaaaatacatagtatggtgtctggcacactgtgagagcttgggaagagatagctcttaggccaaacttcttccagaggattcctaaatgataccagcaagagtgaagtattagtcccttagaggaaccaggagactagagattttgaatttcagctttggggaagagttgtttgataaataactgatattttttctgttttcagatacaggcactatagaagcaaatgaggatatggaaattgcttaccccataacttgtggggagagcaaagccatcctcctctggaagaagtttgtatgtccaggaataaacgtgaagtgtgtcaaggtaattgtcttttccatgctgaagccaaatttgggactccttgttctcaaagggtgtgagttccatgcatcctttttatcttccactatatcagttttatttatttatttatttatttatttatttatttatttatttattttgtggctattgtcctaatgtgtcacaatagaaaaaataagaactttgggttgggtgtggtggctcatgcctgtaatcctagcactttgggagactgaggtgggaagatcacttgagcccaggagttcaagaccagcctgggcaaaatggtgagaccttggctttcttttttttttttttcagacagtgactttctgttgcccaggctagagtgcagtgacatgatcttggctcactgtagcctccacttcctgggttcaggtgattctcctacctcagcctcctctgtagctgggaccacaggtgtgcaccactgtgcctggctaattttttgtagagatggggggttttgctatgttgcctaggctggaaaaccttgcatcttcaaaaaaaactattggctgggtgaggtggctcatgcctgtaatcccagcactttgggaggctgaggtgagtggatcacctgaggtcaggaggtagagaccagcctggacaacatagtgaaaccccatctctactaaaaatacaaaaattagctggacgtggtattgggcgcctataattccagctactccggaggctaaggcaggagaatcacttgaacccgggggcagaggttgcagtgagttgagattgcgctgttgcactccagtctaggtgacagagtgagactctgtctcaaaaaaaaaaaaaattattagattgactagccaaaaaaatacatgattgataaaaatagaattgcttattctgtcttcattagggctggatagattatttcagtttatttgaacagcctttgtttgccacactagacctgattccaggcataaatggattttagatatttattaatatatttatctctgatctctgcatgtattctgtggctttgtaccaggaattgagactatgctcagagaaggatcgtcttctctaacacaatagtacaggaggttggataatacaaggcttaggatgtcatctgggtattttttatacaaatgatgtagagttatcatttcattatttcccctcttggcctgcctaagttgacattagactctttggacttttctttttacttttagttcaatgatcagttgatcagccccaagcactttgttcatctggctggcaagtccactctgaaggactggaagagagctattcgtctgggtgggatcatgctcaggtaagctctaatgtcaagcacatacctttcaacaaactttggggcacataatcatgctagaatctgggcttttctctttaggttgacatttttattctttctgaagaattggcttgagcaatccgtgcattatttgactttaatcaacttaaaaatcctgggagacgagattgatttttttttttttttctgagatggagtctcactctgtcgctcaggctggagtgcagtggcatgatcttggctcactgcaacctccgcctcccgggttcaagcagttctctgcctcagcctcccgagtagctgggattacaggtgcccaccaccacgcccagctaattttttgtattttcagtagagacggggtttcaccatgttggtcaggctgatcttaaactcgtgacctcatgatccacccatctcggcctctcaaaatgctgggtttacaggcatgaaccaccacgcccagcctcttgtttgtttgtttttgagacagagtcttgccctgtcacccaggctggagtgcagtggcgcgacctcggctcactgcaacctcggcctcccgggttcaagcaattgtagtttttagtagagacggggtttcaccatctcggccaggctggtcttgaactcctgacctcgtgatccacccacctccgcttcccaaagtgctaggattacaggcgtgagccactgtgcccggccatttaattctttttaacagggaaaacaaaaaaaggataacatttttaaaaagaaataaaaaattaaaaaataaaaataattatttttaaggaatctctttcaagaaaaatccataatgcttgtagagattcaagcataaagatgtttattacattatttattaatgtaaaaattatagtctgctttaatatatagtcaaaagacttctaaagtcaattatggcttgtgtaaatttatatgagtatatactatggaatattttgcagtcattaaaatatttctgaagagattttacatggaaaaatgcttatgacaatttgaaggaagaaaaatataaaattcattaaactgattttggctgtgttaagacatacatatgtaagtaaaatttagtagaagaaaatatgctaaaatgttgacatggtctgtgtgttgtaggatttttttttttttttttttgagacggagtcttgctctgttgccaggctggagtgcagtggcgcagtctcggctcactgcaacctctgcctcccgggttcaagtgattctcctgtctcagcctccccagtagctgggactacaggcgcgtgccaccatacccagctaatttttgtattttttttttaatagagacggggtttcatcatgttagccaggctggtctcgatcttctgacctcctgatccacccgccttggcctcccaaagtgctgagattataggcatgagccaccatgcctggcctaagattttttaaaaagagcaattgaaaaaaaaaaaagcccatgttctgtcactaaggctggagtgcattggcatgatcagcctcaatctcctcagctcaagcagccctccaaagtaggttggactacaggtgtgagccagtgtggccagctgaaaatgctaaatattttcttaacataggttttttttttttgagttgggatcttgctgtgtcgcccaggctgcagtggcacgatctcagctcactgcaacttccgcctcccaggttcaagtgattctcctgcctcagcttcctgtgtagctgggattacaggagcacgccacctcgactggctaatttttgtatttttagtagagacagggtttcaccatattggtcaggctggtctcgaactcctgacctcttgatctgcccacctcagcctcccaaagtgtggggattacaggcgtgagccaccgtggccagcctttttttttttttttttttttgagacagagttttgctctgttgcccaggctgaagtgcagtggcatgatcttggctcactgcaatctccacctcctgggttcaagtgattctcatgcctcagcctcctgattagctgagattacaggtgcgcgccaccacacccacttaattttcttgtatttttagtagagacagggtttcaccatgttggccaggctggtattgaactcctgacctcaaatgctctgcccacctcacctcccaaagtgctgggattacaggcgtgagccaccacaccccacttttgttgccaaggctagagtgtaatggcgtgatctcggctcactgcaaactgtacctcctagattcaagcaattctcctgcctcagcctcccaaatagctgggattataggcatgcgtcaccatgcctggcttattttgtatttttaggaaagatggggtttctccatgttggtcaggctggtctcaaactcccaagcttaggtgatccacccgccttggcctcccaaagtgctgagattacaagtgtgagccaccattcccggcccacatcatttttttagtcagagacacagaaacattatttgtgttctttttgtttttatttaaaaaatttttaaattattttactcctgtacttccaacaaaacattattttaaaaaaattttttcggccgggcgcggtggctcacgcctgtaatcccagcactttgggaggccgaggcgggcggatcacgaggtcaggagatcgagaccatcccggctaaaacggtgaaaccccgtctctactaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaattttcagatgatttgtatgcagaaattagtaatccaatgaaattgggaaggaatatctttatttttattgtttgtttatttatttatttatttatttatttatttatttttgagacagggtctaactctgtcacccaggctggagtgcagtggcgtgatctcagcttactgcaacctcagcttcctggctcaagtgattcttcagcctcatcctcccaattagctgggactacaggcctcagctaccatgcctggctgatttttgtattttttatagaaatgtggtttcaccatgttggacacgctggtctcaaactcctgagttcaagtgatcctcctgccttggcctgccaaagtgctgggattacaggcgtgaatcactgcacctggctgaggaatacctttaactttgagttttgttgttcttggcgggttttatttacccagaaggacaagcatatgccaattttccccaaatgtaaaagagtcaggatactaaaaaatctttagtgaaagccaaatgacattataacatagaatttactataattaaaataccccatggttttgctcatgtcctataacgttttgtggatccaattataaggacattttccagagtgggtttagtatagtgaacttttttctgtattcctaggagagttttttaaaagactgaaactttatgtctgtgaaagtggcaccagatcttgctgcaatactcataatgaataaactacagagggaggaggaatactggtaaatgtgggcaggaccagtgaaaatttaaagccccaattagaatttttgcaacctaatgacttctaacactattaggtttcactaatctacacagtaggctcagcagtgttgtccctatttttccctgaggcctagttcccactagatgaagtataggctgaactggtacttcttgtctccctttgcacaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagggggtaggaaaccacctgaaaacccattgtgtttttcagcagaactttcccccttatttctcccttgtgtgtacatatatatatatatatatatatatatatatatatatatgtatttttttattttaattttttttgagacagagttttgctcttgttgcccaggttggagtgcagtagcgtgatctcagctcactgcaacctctgcctcctgggttcaagcgattctcctgcctcagcctcctgagtagctgggattacaggcatgcgccaccacacctggctaattttgtatttttagtacaaacagggtttctccatgttgatcatgctggtcttgaactcccaacctcaggtgatccgcccacctcggcctcccgaagtgctgggattacaggcatgagccaccatgcctgtccccttgcatattcttaatttcaattctcatgaacattgatgtgccttgttgtaaagtatggtaatcttggatgggattccatgctttggaaacatgctttgttttcttcccaatgattcctattggtcagacctcctcctttgttttttccttacaatgcattgtaggcattagaaaggtagttcagtagttacaatacttacataacagtttcactttggtgccacttggcatattaaggttgaattaggctgttttgaaaaatgctctgcaggctaggcgtggtggctgacgcctgtaatcccagcactttgggaggctgagggaggcagatcatgaagtcaagagatcggccaggtgcggtggctcacgcctgtaatcccagcactttgggaggctgaggcaggcggatcacgaggtcaggagattgagaccatcctggctaacacagtgaaaccccgtctctactaaaaatacaaaaaaattagccaggtgtggtggcgtgcacctgcagtcccagctgctggggaggctgagacaggagaatggcgtgaactcgggaggcggagcttgcagtaagccgagatggcaccactgcactccatcctgggcaacagagtgagactccgtctcaaaaaagaaaaatgaggtcaagagatcgagaccatcctggccaacatggtgaaaccctgtctctactaaaaatacaaaaattagccagacatggtggcgtgcacctgtagtcccagctacttgggaggctgaggcgggagaattgcttgaacctgggaggcatgggaggcagaggctgcagtgagccaagatcattccactgcactctaacctggcaatagagcaagactccgtcttaaaaaaaaaaaaaagaagcctgggcatggtggctcacgcctgtaatcccagcactttgggaggccaaagcgggcagatctcaaggtcaggagatcgagactatcctggttaacacggtggaaccctgtctctactaaaaatacaaaaaattagccaggtatggtggcgggtgcctgtagtcccagctactcgggaggctgaagcaggagaatggtgtgaacccaggaggcggagcttgcagtgaggcaagatggcgccactgcactccagcctgggcgacaaagcgagactccatctcaaaaaaaaaaaaaaagaaaaatgctttgcagctgtgctttggctcacgcctgtaatcctagcactttgggaggctgaggcgggaggatcacctgaggtcaggagttcaagaccaggctggccaacatggtgaaaccctgtctctactaaaaatacaaaaattagccgggtgtggtggcgcatgcctgtaatcccatctacttgggaggctgaggcaggagaattgcttgaacccaggaggtggagtttgcagtgagccgagatcgtcccatattccagcctgggtaacagagcaagactctgtctcaaaaaaaaaggaaaaaagaaaaatgcttgctttactagtggtcaacacaagaggtagattagaatgatgagtggttttcacccattatactgaggtgtatcaaagacaatgtgattggctggacaggactctggataccccactgtaatgattggagttgtctgcttggaggggctcctgattaccaagttgaggcttcccacagatgaaacagatgagcacacttaacttcagtattgttgagtttggtactagggctccttaccatccaggaaagatgtaactgtaagattattattaaggatttagttagtccagctggagacttactatatagttggataaaatgtatctcaactactgttacaagacttacaaatatgcctgagaaaagtcacaagaatgctaaaggatctaaaaggttagggacatacactgtgcttgtaaattgacctctttttttttttaagacagaatcttgctttgtcacccgggctggagtgcaatggtgcaatcttggctcactgcaacctccccctcccgggttcaagcaattctcctgcctcagcctcccgtgtagtgagattacaggtgcccgccaccaagcctagctaattttttgtatttttagtagagacggagtttcaccatgttggctaggctggtctcaaactcctgacttgaggtgatccacccacctcagcctcccaaagtgctagagttacaaatgtgagccaccatgcctggcccttttttgtttttttttttcttttttgccttgtcttacggtgctgaaaaaatgacctcttaatggctgggcatggtgggtcacacctctaatcccagcactctgggaagctgaggcaggaggatttcttgagcccaggagtttgagaccagccttggcatcttgtcgaaaacccatctctacaaaaaataaaaaaattagctgagcatggcggtgtgggcctgtggtcccagctactaaggagactgaggtgggaagatcacgtatcagtgagctgtgattgtgcctctgcactccaacctaggtgacaggagcgagagaccctgtctcaaaaaaaaaaaaaaaaaaaaaaagatcttggccgggtgcagcggcccacgcctataatcgcagcactttgggaggctgaggcaggcggatcatgaggtcaggagtttgagaccagcctgaccaacgtggtgaaaccccatctctactaaaaatataaaaattagctgggcatggctgggcgcggtggctcacacctgtaatcccagcactttgggaggccgaggctggcagatcacaaggtcaggagatggagaccatcctggctagcatagtgaaaccctgtctctactaaaaatacaaaaaaaattagctgggcgtggtggtgagcgcctgtagtcccagctactccggaggctgaggcaggagaatggcgtgaactcgggaggtggagcttgcagttagccgagatcgcgccactgcattccagcctgggcgacagagcaagactccatctcaaaaaaaaaaaaaaaaaaaaaattagctgtgcatggtggtgcatgcctgtaatcccagctactcagaaggatgaggcaggagaattgcttgaacctgggacgcggagactgccgtgagccgagatcatgccactgtacttcagcctgggcaacaaagtgagactctgtctcaaaaaaaaaaaaaaaagatcttttggtcagttctaatattctgtgtgtatccagtgggtgaatagaggccagaatccttgaaacctaaatccctttcaggaaagtataaaatatctggcggtttgaatatttggacacttgactctttcacttgaaaagtgaaaaatactgtgaaatgctatttacagttggcccttgaacaatatgggtttgattggtgggggtccacttttatgcagctttttttttcccaaccaaacatggatggaaaatatggtatttgcaggatgcaaaacccgggtctatgaagtgttgagttttactttttgtatatatgggttccacggggctgactttaggacttgagcatgtacagatttggttatatatgcaggtggtccaggaatcaatccctcatgtatactgagggacaactgtacttcctttttatttggctaaaagtcttttacttgattatcttttgcccgatgattgatatcctccagtgtgtagagtccgtactttcctatattgctgtttggatcagtttggtttttcttgattctctttgtttaaaagctgtctttttttttttttttttgagatgatttcgctctgtctcccaggctggatggagtccagtggcgcgatctcggctcactgcaagctccgcctcccgggttcacgccactctcctgcctcagcctcctgagtagctgggactacaggcacccgccagcacacccggctaattttttgtatttttatagagacggggtttcaccgtgttaaccaggatggtctcgatctcctgatctcgtgatccgcccacctcggcctcccaaagtgctgggattacaggcgtgagccactgcgcctggccaaaagctttcttgttttttgagacagggtcttagtctgtcacccaggctggagtacagtggcacaaccatggtttactgcagtcttaagcccctgggctcaggtgattctcccacctcagcctcctgagtagctgtaactacagatgtgcaccaccacacccagctagtttttatagaaactgggttttgctatgttgcccaggctggcctcagactcctggactcaagcaatctgcccaccttagcctcccaaagtgctaggattacaggcatgagctaccacgcccagtcaaaatcttactatacaagtaatagcaaagggtatttttcccctctgtgaatctgctatacatgaatctcttatctgatttttatggtctccatttcttttactttctctttataggctaataaataagttagatgcttagcatcagacttgcttgtagtagagctcttgggaaagcactatacctttctcttaaattatttcaagctttcttcaccctcagtaagtctggggctggcaggctagtaggggctggcaggctagtagtaatgtctatcttcaatctctttcaaaaacatacctacctaggaaacacattgctcttttgtgattttgtaagttatctttcactttctattcaaagtaagaaagcattttcctttgcaaggcaggttttctttagaaaatccaatattcatcctagcttacctaagagtctagtttttaaaatagggacctgcagccaagaggctagaatgttaaaataacaaggtctttgtagctattgagtatgagatataggatagctataactttttcgttaaattcactgttctcacctctactggactgtttttaggtagcatcacgcagattgccatctcagaagagagcatggaagaggcagggctggaatggaactcagctctcaccgctgctgtcaccatggccacggaggagggtgtaaagaaagactcagaggaaatttcaggtattcttctatagggctcagatgtcttgcagggtcttgtgagccttatcaccattatcattatggacacggaagacctcttaattactttcgctggattttctcatgcacgtaaatactaactatagctacaaacatcctactttaatccatgcaatagccctgcatagtcacattttacatacaaagaaatcagaattggccgggcgcagtggctgacgtctgtaattccagcactttgggaggccaaggcaggtggatcacaaggtcaggagatcgagaccatcctggctaacacagtgaaaccccgtctctactaaaaatacaaaaaaaaaattagccgggcgtggtagcaggcgcctgtagtcccagctactcgggagcttgcagtgagccgagatcgcgccactgcactccagcctgggcgactaagcaagactccatctcaaaaaacaaaaaacaaaaaacaagaaatcagaatttagaaaggttcagcaacttgcctaagaccagtcacaaacaagtgtcagagctgaatttagctgtttgactatgtagtctatgcttttcttctgatcagactgcctccaactttggcacatttcttagatagactaagttttgagatattagaaggaaaaaataggtggcaagtgttgtagagcatggtgattaatgatgattcacttagaggggaccaggagaggcttcacatcaccctccaattatttattcatttaataggtatttattattgcctatttttagttggcactgttgttagatgctgggtgcgtagatgaaaagacagaccaggtgcggtggctcatgcctgtaatcctagcactttgggaggccaaggtggatggatcacctgaggtcgggagttcgaggccagcctgaccaacatggagaaaccccgtctctactaaaaatacaaaattagcctggtgtgctagtgcatgcctgtaatcccagctactcggaggctgagacaggagaagcacttgaacctgggaggtggaggttgcagtgagctgatatcacgccattgcactccagcctgggcaacaagaacgaaactctgttctcagaaaaaaaataaaaataaaaaaataaaaaaagaaaagacatagccaccaccctcagagagcttatagccccatctatccaactgttttgttttgttttcttaagtataggactagagagagtatatcttaattaatatttcatttctttactatttaacttttatgatattaaatatctcgtttttaaattaaattaaaattaaataatatgtaatgttaaatatgtttaatgtttaatatttttattggaggaaaatgactattctttgtagtgagaactatgacaaattgagagaatgacaaattgaggcaatcatcccaagcacctatgctgctgaaggggcgacataattgggtgcccactcagggaagcatctagtattccaaagcttattcccttttttcaggaatggcccaataagaaatcattttgagttaaaataattttgaatttaacgttgtagagatttgcctaagtatctaggtagtgtctcttttttaccctctgtcttatccttcttgtgccagaggacactttgatgttctggaaaggaatagctgatgtagggctgatggaagaggttgtctgcaatatacagaaggaaatagaggagctactcaggggagttcagcagcggctcatccaggctcccttccaagtcacaggtaagtgcactaatcctaacagtagcagtgatttattgaatactcacctccgtaggcaggtcctgtaagccttgcaaaaaccctgatgtataggtattattatcttaattttacagataaggaaactaaggctcatataagttaagtcacttgtctaaggttcataactaggttttgaactcagatctggccatgcttttccacaggtaatttttgtctttataaatggtgccagtagtctgggcaacatagtgagatgctttgtctccacaaaaaaaatttttttttttttttgagacggagtctcgctctatcgcctagactggagtgtagtagcgcaatctcagctcactgcaacctccgcctcctgggttttaagcaattctctctgcctcagcctcctgagtagctgggattacaggcgcccaccaccacatccggctaatttttgtatttttagtagagacagggttttgccatgttggccaggctggtcatgaactcctgacctcaggtgatccccccgcctcggcctcccaaagtgctgggattacaggcatgagccaccgctcccagcctacaaaaaactttctaaacattagtcaggtatggttggtagtgggtgcctgtagtcccagctacttgggaagctgaggcataggagaatcacttgagcccagcagtttgatgctgcagtgagctatgatcataggactctactccagcctgggtgacagagcaagaccttgtctcaaaaaaaaaaaaaaaaaaaacacaggccaggtgcggtagctcacgcctgtaatcccagtacattaggaggccgagaccggcggattacttgaggtcaggagttcgagaccagcctggccaacatggtgaaaacctgtctccactaaaaatatgaaaaaaaaaaaattagctgggtatggtgcacatctgtaatcccagctacttgagaggttgtggcacgagaattgctgaacccaagaggtggaggtttgcagtgagccaaggttatgccactgcccaccagtctgggtgatagagaacaagactccatctaaaaaaaaaactgacagaaagcatcctctctcgcgcgatatatgtattttctttttttttttttttttttcctgagacggagtttcactcagtcacccaggctggagtgcagtggcgtgatctcagctaactgcaacctccacctcctgagttcaagcgattctcctgccttagactcctgagtagctgggattacaggcgcatgccaccacacccagctaattttttgtatttttagtagagatgaggtttcaccatgttggccaggctggtctcaaactcctgaccttgggtgatccgcccgcctcggcctcccaaagtgctgggattataggcatgagccaccgcgcccagccgatacatctattttcagactctctgtatacattcattatgtggtatgtccactatgtgtatgtatagagaaagagtctgaaaattggagaaatccacttgtttttagattattctcatattcggccgggcgcggtggctcacgcctgtaatcccagcactttgggaggccaaggcaggcggatcacgaggtcaggagatcgagaccatcctggttaacacggtgaaaccccgtctctactaaaaatacagaaaattagccgggcgcggtggcggacgcctgtagtctcagctacttgagaggctgaggcaggagaatggcatgaacccgggaggcagaacatgcagtgagccgagatagcgccactgcagtctggcccaagcggaagagcgagagactccatctcaaaaataaataaataaataaataaataaataaagattattctcatatcctattaatttaaggctttctgaacttgttgtgttcacttatagctgtttctgaatactttcagggtgctgctgtgcagaatgtaaaatgacgttctaatctaatagaaatggggttatgggccaggcgttgtggctcacgcctgtaatcccagcactttgggaggctaaggcaggtggatcacctgagatcaggaagtcaagaccagcctggccagcatggtgaaaccctgtctctacaaaaatacaaaaatccgcgaggcatgatggcgggtgcctgtaatcccagctactcaggaggctgaggtgggagaatcgcttgaacccggcaggtggaggtggcagtgagtggagatcacaccattgcgctccagcctgggtgacagagcgagagtccgtctcaaaaaaaaaaaaaatgggattatgatgagatgagaccttgtgtattcagtgaattcttatttatttatttatttatttagagacggagtctcactctgttgcccaggctggagtgcagtggcgtgatcttggctcactgcaacctccacctcccaagttcaagtgattctcctgtctcagcctcctgactagctggaattacaggcaaataccaccatgcctggctaggttttttgtatttttagtagagatggggtttcaccatgttggccaggctcgtcctgaattcctgacctccggtaatccacctgttttggcctccaaaagtgctgggattacaggcgtgagccaccatgcctgtcctccagatttggtttttttttttttttttttttttttgagatggagtcttgctgtctcccaggctggagtgcagtgatgcgatcttggctcactgcaagctccacctgccaggttcacggcattctcctgtcacagcctcccgagtagctgggactacaggtgcccaccaccacggccagctaattttttatattttttgtagagacggggtttcaccgtgttagccagcgtggtctagatctcctgacttcatgatctgcccgcctcggcctcccaaagtgctgggattacaggcgcgagccactgtgcctgtaaaattttaagagatttaaaattttaaatctcttaaaaatttgtatttttaagagattgttctggttgctgtgtggagagtagactcttatggggaaagagtagaaacaagaccagttgggaagctcttaaaggaattagtccaagcaagagataatgtatcatggattagagtgggtagcggtaaagttaggaagaagtgattagattgagaatgtattttgaatgtcgaactactaagtcttgctgatggattggaggcaggatgaaagagaaagaaagataccgggatgattcacacatttttggcctgagctgtgagtggtgatgccatttactgagatgaaggccactgggagaggaacagttttagagaggaaataaaaattagttttacctcttaaattgagatgactattagaccatcaaatagagatgtcactcatctagatagaagtatgaatgtggaatacaggaaagaggtcagggctggagatgtacatgtgggagtgctcagcatgtgtgtgttatttcaaaccatgggaccaagtgaggtgactgtggaagggaatgtaggtgaggttgtccaggttaaggaagcaattaacacaaatactgacaatttttttttttttttggagacagggtcttgctctgtcatccaggctagagtgcagtgatgcagtcacagctcactgcagcctcaaccacctgggctcaattgatcctcctgcctcagtctcccaagtagctgggactacaggcacataccaccacacctggctaatatttgtagtttttgtagagacagggttttgccatattgcgcaggctggtctcaaactcctgtgctcaagcaatccacctggcttagcctcccaaagtgctgggattataggcgtgagccaccacacctcgctctatcacccaggctggagtgcagtggtgcaatctcagtttactgcaagctccacctcccaggttcacaccattctcctgcctcagcctcccgagtagctggtactacaggtgcctgccaccactcctggctaatttttcatatttttagtagaggcggggtttcactgtgttagccaggatggtctcgatctcctgacctcgtgatccacccacctcggcctcccaaagtgctgggattacaggcatgagccaccgtgcctggcccaattttgtttttttgagacagagtttcgctgttgtttcccaggctggagtgcagtggtgcaatctcggctcactgcaacctctgcttcacgggttcaagcaatcctcctgcttcagcctcccaagttgctgggactataggcatgcaccaccacgcctggccaattttttgtatttttttgtatttagtagcaacggggtttcaccatattggtcaggctggtaatccacccacctcggcctcccaaagggctgggattacagatgggagccaccacgcccagcactctgggaggctgaagcaggtgaatcacttgaggtcaggagttcgagatcagcctgggcaacatggtgaaatcccgtctctaataaaaatacaaaaattaggccggtcgaggtggctctcgcctgtaatcccagcactttgggaggccgaggcgggcagatcacaaggtcaggagatcaagaccatcctggctaacacggtgaaaccccatctcttctaaaaaatgcaaaaaaaattagcctggcattgtggcgggcgcctgtaatcccagctactgaggaggctgaggcaggagaatggtgtgaacccgggaggtggagcttgcagtaaactgagattgcaccactgcactccagcctgggcgacagagcaagactccatctcaaaaaaaaaaaaaaaatacaaaaattagccaggcatggtggcgtgcacgtgtaatcccagctactcaggaggctgaggcagtcaaatcgcttgaacctgggaggcagggcttgcagggagccaagattgcgccattgcactccagcctgggtgacagagtgagactccatctcaaaaagaaaaaaataataaaaataataatcttgcatgccagtccccatgtttgacacttaaaatatatttctaatcttcatgtctattttgcagagtaagtgttattaatcccattcattttagatgagaaaagtgaagagtgaaatgacttaccaaaggttgcacatatgggaaatagcaaaactgagatgaacgttaactctatctagtacagggaccatgttttcaaaacctaaagtcagaactataaacagatgcaagatattaaaaaaaaaaaatttttttgagatggagtctggccctgtcttccaggctggagtgcagtggcacgatcttggttcactgtaacgtctgcctcctgggttcaagtaattctcctgcctcagctgcctcccatgtagctgggattacaggcacatgccaccacaccgagctaattttatttatttatttatttatgattattattattttttacccagctaatttttgtatttttgttagagactgggattacaaatgtgagccaccgctcctggccttaaaattttttcaaattggccgggcgcggtggcttgtgcctgtaatctcagcactttgggaggctgaggtgggtggatcaaaaggtcaggagttcgagaccagcctggccaatgtggtgaaaccccatctctactaaaactacaaaaattaggcaggcgtggtggcaggcacctgtagtcccagctactcgggaggctgaggcaggagaatggcgtgaacccgggaggtggaggttgcaatgagctgagatcatgttactgcactccagcctgggggacagagcaagactctgtctccaaaaaaaggaaaaaaaaattgtttcaaatttatgtaagtagagacaggggtctcactatgttgcccaggctggtcttgaactcctggcctcaagcaatgctcccgccttggcctcccaaagtgttgggattacaggcatgtgccaccatgcccagcctgatctttgtatttatttatatggaaagatttacaaaaatataacaattaaaccagtagtcattatacatgtaataaatctttgttaaaaatgtgttaaaatgcagttaggagagtcccataatttctggttgtttcatatttataaacagcacaatggagagtggtggaacatatctgttttaactggacaggcatgtcttttgttttaaatagatgctgctgttctcaacaatgtagcacacacatttggcctaatggacacagtcaagaaggttttagacaacagaaggaaccaagtagagcagggagaagaacagtttctctatactctgacaggtatgtataagttatcgctcttcttcggtgatatcatgctaatattcttgtcttcccattttcttgttgacttttgttggggtaacttttttttttttaaatagtatcagattttgcttttaaaaataaaaaaaaaagccgcagatgaggtggattgatgagaaacaaaagaggcacaaaggaaaaaaaaaggaagctgccatcatagtcccccttctgtgtcttgtggaggattaagatgtctcttagattgctccattaattcaataacattggtggcagaagacacaaattggtctttgtcttttttacattattgatactgcatcttttgatagatataaatttagcactttctccattatttgtggtaatcagaaattttgtgtaatcccagcactttgggagactgaggcagacagatcacgaggtcaagagattgagacaatcctggccaacatggtgaaaccctgtctctactaaaaatacaaaaattacctggatgtggtggcgcgtgcctgtagccccagctactcgggaggctgaggcaggagaagggcgtgaacccgggaggcggaggtttcagtgaaccaaaatagtgccattgtactccatcctgagggacaagaacgagactctgtctcaaaaaaaaaaaaagaaaaaaaaacctttaaaccgtcagaaaactggtttttgttagaaatacaggcttttggtcccttgtgtgtattatttcttcagatatttttaatcattgtatacataaagttttgttttctgctttttttcaccatgacatatttttctttttgtttgtttatttgtttttgagacagggtctcactctgtcactgaggctggagtgcagtggcacaatcacggctcactgcaactttgaccttccccgagctcagggtgaccctcccacctcagcctcctgaatagctgggactacaggcatgtaccaccgtgcccagctgttttgtatttttggtagagatggggttttaccacattgcccaggctggtctcaaactcctggactcaagttatccacccacctcagcctcccaaagtgctgggattattagtgtgagccattgtgctcagccctattagtatttttcaagttgctactcagtactcagtatagcacagaacacttctgtaatcagatgtgtaggggtttttctgcatataccgagcaatcaactctccagtggacactgactgggtattatataattcagttcaattctgatactatccccctggagatagcatcagatcacacaggtgaggctcagtcccaaaagactgcctcccattcagccccaggttgtgacctgtgctttttttttcttttttttgattaattgttgaaggcaaactgcaaatgacctgtgcttctgaccaactggctataaattggggttcccacaatcaccttcttgcgtttgattaatttgctaaggtggctcacagaactcagagaagcagttactcaatgtttattgggtttattataaaggttattacagaggatacagatgaataaccagatggaagagatgcatgggacaaggtgggaaggagagtgggacttccatgcactctgtagtcacgccactctcaggaacctccaacaatctgaagctctctgaaccctgtacttttgaggttttatggaggcttcattacataggtatggttgattacttcattggccattggtaatcaacctacagcctctctccactccttggaggttcggggggagggctgaaagtcctagtctttaatcatgcctggatctttctggtgaccagcccccatcttgaatctatctaaggattccaagataccagtcatctcattaagatataaagacatttatgccgggcgcagtggctcatgcctgtaatcccagcactttgggaggccgaggtgggcggatcatgaggtcaagagattgaaatcatcctggccaatatggtgaaacctcatctctactaaaaatacaaatattagctgggtgtggtgttgcatgcctgtagtcccatctactcgggaggctgaggcaggagaatcacttgaaccaggagaattgcttgaacctgggaggcggaggttgcagtgagccaagatcgcgccatcacactccagcctggcgatagagcgagactctgtctcaaaaaaaaagagatataaagacatttaccacgctgggccgggcatggtggctcacgcctgtaatcccagcaatttgggaggcctaggcgggcagatcacgaggtcaggagatcgagaccatcctggctaacatggtgaaaccctgtctctactaaaatacaaaaaaaaaaacattagccaggcgcggtggcgggcgcctgtagtcccagctactcaggaggctgaggcaggagaatggtgtgaacccaggaggcagagcttgcagtgagccgagatcgcaccactgcactccagcctgggcgacagagcgagactccatctcaaaaaaaaaaaaaaaaaagacatttaccgctctggagatccatgtgttttaggagctgtgtgccaggatccaggggcagagactaaatatgtatttcttattatatcacaatatcacacatagggagcaaagtgctctacaagtgtaattgattctttcttgggtgcttatcaggtactaagtaataggttccattgtagaagccaacttaccagtggtcacctagggttggactggtcacttgggagagggatagtgataggcgtactataatgcaaaagcaaccaagttgaccattgtcctggcccaatcttcataaccttaaattagtcattttccctctctggatccctgtcaaaatgaatttgtttgagctcttaagacctcttttagttctgtaatttttagggacttcttctataactttctgtagaccttcctaggcaacaattgtaaactgtggctgtttgagtcaccagcaaaggagttttccagccaatgcagcaaggcattcttgccttgaaggatagtttgaaaatcactgttttttggagtggccattgtagctcctttgtaggtgcatgagagttccaagggactgtgccagctgggtgcactggcttatgcctgtaatcccaacactttgggaaggtgaggtgggtggatcgcttgaggccagaagttcgaggctatagtgcgcaatgatagcacctgtgaatagccactaccctccagcctaggcaacataacaagactctgccccccaaataagcacaagaaagaaaacaatgtcacaacttgcctgaagctacttagtaacaaaaccagacagagacaccaggtctcctgactctcagtttaatgctcccaagattttacttccctctacacaaagtcttttctttttttccatagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctcctcctgtccagcagcctcagttcacagtcatctcacccatcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggacccttttttaaaaaaaaaaaaacaaaatcttattgttgtaactgaaaatgttgggttcttcccactccctcattgaaaaatggacaaaacaagctgcccttccagaagttgagagtaggtcattcaatgtcctaatcatcttacaccaagaaagtaatttcttttaggggaagtgtcaagataacaagtaaccctgtccagaaagccatttccaggctcgtctgtgtgtgtaggcatgtggttttattcttgtaaagatgcattgaccaaactctggaacacagatctgacactggaaggcaacccactcgcatgtggatgctgaagggcactttattttgtatcctgaaaagggcctacagaggccagtacaaaactctcaaacaaaaggaagttgactctgctttgaggggaaggtggcatgccagcactagcttaaaaagggaagtgctagccgggcgtggtggctcacgcctgcaatcccagcactttgggaggccgaggcgggtggatcacgaggtcaggagtttgagaccagcctggccaacatggtgaaaccccgtatctactaaaaatacgaaaaaaaaattagccgggtgtggtggcgggagcctgtaatcccagctattcaggaggccaaggcaggagaatcgcttgaacctgggaaggcagaggttgcagtgagccaagatcgcaccactgcactccagcctgggcaacaagagcgagactccatctcaaaaaaaaaaaaaaaaaaaagtgctttggcaagtatggggcagggaaatcatcttacttccagaggtgcaactgacgcctctggagatctccaaaagttagtaccgtgagtgccattttgagaagaaggtggtaataagtggaaggtacatctccacagagcaagtggcagcagtggcctgtggttttgcagaaatggaaagccaaggccgggtgcggtggctcatgcctgtaatcccagcactttgggaggccgaggtgggtgaatcacctgaggtcaggagtttgaggccagcctggccaacatggtgaaaccccgtctctactgaaaatacaaaaaaaaaaaattagctgggcatggtggcacgcgcctgtaatcccagctacttgggaggctgaggcaggagaattgcttgaacctgggaggcggaggttgcagtgagctgagatcatgccattgcactctagcctgggcgaggagtgaaactccgtctcaaaaaaaaagaaagaaatggaaagccaaggatgctgcagctgtgctttggggttcaaggtaatagcttaccttgttccacactttgtcaaagcactcaccctcctaagctaggaccagtccattcatttgaaactgtgcaatgtgatgtaaatggctctggttcttagactgtggctgtcacagggatggggctccaaggccatcattttcattgcatggctccaagagcagggagttcctcaatgaaaccagctgccttttttggtggggccatttttttggctttggaacccaaagcagccactcatttggtgcttcctcttgttctgccctccatccctcaactcttaatggcatctgtctcctagaacccacgctcttcagctttttggctgatttggagaacagtgacaggtgcctgcctgccttcgtccccttttagattcatttataccacagatgtttctgtgagatactgagatcataaaaagctttaggcttggcagagaggactcaacacccccaggctttcctgaggcaccaactagatgtctcttgagtgagctggactccctgggaaagaagcattgtctgcaacattatattataggaaatgtaccaggaatgtcaataataatgctttgggggggggggttattttgttttgttttgtttttaatgttgtttgtatatttagagctgggccattttccgtgctgcgatttcttctctttgaccctcttcagtgtttggggcaagagtggaccctggtttttatttctttgattgcattgtttactgcactaggaaaaatatagagatacagggaaactacagacaaatttaaggaaaaataggtcaaaaaagaaagcacacaccttaagagtgggaggaatatttttattaaaaacaaaacttggacctgtagtttttttttttcttttttatttttaagaaggcacctttcagaagccatgtttcttccaacagatgttggaaaccccatcgagcaagtaaaagttgcattctccatccctcagatggctgtatgtagtcaaagaaaccctgtaacatggtaaggttgctgttttttttttttttttctttttgagatggagtcttgctctgtagcccaggctggagtgcaatggtgtgatctcagctcactgcaacctccgcctccttggttcaagtgattctcctgcctcagcctcctgagtagctgggattacaggctcccaccaccacgcccgggtaatttttgtatttttagtagagacggggttttgccatgttggccaggctggtcttgaactcctgacctcaagcgatccgcccgccttggcctcccaaagtgttgggattacaggcatgagccaccgcacccagcctgaaggtgactcttaagaatgagatttatgaactccatacagttgtagatttcagtttttaaatagtctggggttttatttttcttttcaaaatatctaatagacttagcaatcaatttagaacaaatatttggcccttaatatatctttagtgagggaagtagcttttatttcctgcttgtttaggttttctgttggtacataaaaacaaaattgctgtctcagactgaatctacttgaatctaggaaggcacatctcatccctattgtggtttttagggacacttttctctttcccagagatgagaggaccaattcaggacagaagagccctcgtgaataccaacgtgctagctcaggttcccttctttcctccatcagagctattggtagggttttaaggtcgtgtgtgcatcatgcttccaatgtcaagagatttcctcaaacagcctgtttactagatgaattttccagctggtgaaatacatgagctttgttgttttcctggtcttccaatagcctgtcattattgttagatattatggcacctgttgttgaatgtaggttcccttacagccctggtctagatgatcctagatggggtgagacatatgcaagccattggtatgtgcataagcagttgcaatgaaccttaggctgacttggtagtaggcatttgtctttctgttcatgcattgaataaacatttttaagaaccatctatgtgccaggctttgtgctaggcactgacagtagagagatgaagacatagtccttgcacttaaggaattcatactccagatgtctggagttaagaaatacatatttcagccaggcatggtggctcacacctagaatcccagcactttcagaagctgaggcagaattgcttgaggccaagagtttaagactagcctggtcaacatagccagaccccatctctataaaaaaatgtaaaaattagtcaagtcttgtggctcgcacttgtagacacaattactcaggatgctgaggcaagaggattttgcttgggcctaggagttcaaggctgtagtgagctatgactttgccactgtactctagcccaggtaacagggcaacatccccagctcagaaaaccaaaactacacatttcattataattgtttttttttgtaattttatgtattttatgcattgaaaaacattatttaagaattggttcataggtttcagcagactgccaaaggcacaaacaagcagctctcctttactgaggtactgaaacagatcctactgcgtaagtgctgtgtgtgatagggctattggctaggagctgagagaacaaagcatgaagtgcctaacccagcttagcggtgtagaggtggggtcagcaaataagggagatcttcctggagaaggcatatacctaagctgatttaggagagaccacttttggctaggtttattgtactacttgattttcaagtaattgggcttatttattctagagaaaaagtcttcagtctcttgcttctgcctgcaaagcaaggcagagtcagcaacatgggcagtctccccactggagaacgctgagtcatgcatgggcttctccaagtttccatcagatgggatccagtgttgaatccagtgcaggactggagtctagctggcaaagggtaaatgcccccaaagccttcctgccatatggtttccacgaaggcctgagagtcagctgtacaactgtcttgtcttggccatgtccctgtttggtccctgccttgttctcttccctttctcaatttccaagctccacccactcctaaaaacaccagtcattctgaagtaaaaaatggacaataaacatgaatattcaagattcaaa

SEQ ID NO: 631 - DNA, 33086 bp, Homo sapiens
gcggccgcccccggcatgggcaccgcgccgcagggggcctgacccgccgcccgctccgcccccgcctgccatggcggcccgcgcgccccccgccgcacctgcggccgaggagccggggaacccgggcggccccccgcgcaggaagaagtcccgctccggcgcgtccggcctccgccgcgccttcagctggctgcggggcaagcggcgcaagaagaaggcggcgggggccgagggcgccgaaccggccgccccccgggccaagaaggcggaggacaaggccaagagggccaagggcaaaggccgaggtaaggcggtcggcacctgggctgagcgcgggggggcgtcgagggtgcggccgagggggctctgccgggggtccgcgcgcggcgtgttggaggggggtgacccccaggagctggtgctggaaagcgaagaggccagggctgagtccgaacacttccaccctgcgctgccttccgcagtttccagacccagtcctgccccgctgtgaggggaggggacccccggctggggcagggatcccctggcagagcaggaagtgctggtagcccgactccagggcggtgaggcgattccccctcccccaggctcaccgaggttctgccctctgctgagtcagggggtcagagacttaacgctggcctgtggccaatgggagagacaggtggccttgggtctctggtggggaccctctgggtctggaaggtcaaccgcactcacaaagagtttcagctccagctggatctggatttccagccccacaaaggacctcacatggagcacagtgtgccctgccttagcttcttaacagtgctggcttttcccacctggcctccctcaacgctcacctgggccaggccacaaacatcacctcctggggtagtgagctcaccaaggtgaaccaacccgcccctccctatcactccttcttccagccctggagaaacatgccagtgtcggaagtgtgcttacagatgggggaaactgaggcccaagctcagtggagaggctgtacctgggctggggtgggtacttaaaattcaacagctaattctcagtctttctgaatttgagtccctgggctcctcctctggcctggacgggcagcctgaaaggcggggaagccgacctggcccatccctgctggggtcattttcagttcctttcttgggccttccctcattttccagtttctgtcttccttttgatggggagggcttgagtctttgcaagagggtggagctcccttggggcttgctgtcctgggaagtccacctttcctagactgctgctgcagtgctggaggtgaggaaatggctgggtgtgcgggcccatcccattctgcctgtgtttaccctcccagtgtcctttaaccacctcttctgggagagttagaaggaacactttaggggtcaggaagagggtggaaagcctcatgtgtgattgtatccggcttgatcttccttttggataagggccctgcttccctgcggcacagccacacatagaagtgagggtgctggggctggggtgactgggccaaaccctgagggaggactggatttgggtgaggggtgtttccaaagcctctgcagtcctaacaggacatggagtctgtcccagggctgccccactgggattcagtctgaagtcatccccgtctcattcaagagggcattgcagcaggatgtattgtggtcagactgtcaggattggcaggcagaaggctagtggactagcagtgtatactccagggcaatggacctttttcctctgggagaccagcctggaaggcagggggctggaaaagctgagcctgtaggtcactgctccaacagcctgggtttgggttcattgggtcagtggccaggcctccctcttgccttgtgtttggtatcaggtggctctgggctttctgggcagcatgtcggcctgatttgagcccacgtgcatgggtaacacctccttgcccctggctgttgtttctccaggtctggaggtggccctgggtatgactggaggaagtcctgttcccttttactccagcctcctattattgcaactgtttccttgtcacctgcctggcccaacttcttttctgtttattaagagaaataaatctgatcccactaatctccactggcaacgctggccaggaacgggaagcctgcagaaggcttaactctttcagggagaatgttcagaatggagattgggagaggtggggaggagggatacacaggagattcctgggaggtcagggatctttgctggggaagtcattatctcctccattccaatctctggctcaaagacctatgagaggcaggtcttgattcctctaatctgactctcctactttaagatggaaaaactgagcttgtcatggagttttgagcaccagtcttccatgattcccttgctgacctcactaccctgcacaaacttagaagaagagaggaagtctgacatttattgattagtctgaatatgtcaagatcttacttgcagatgaaaaaattgaggctcagggacagtgagtgactgatttgaccaaacggatttaaactcaaatcacctgcctcaaaaatcgggactgttttcatgactctcccaaggacatagagcagcaggtaaggcttgaagatcttcttgttcaactcactttacagatgggaaatggcccagagagagaagtgagggaacttgatagagtggggagagtatcagaatcaggccaatgagagtttaaatcctggcccagctactagcaagccccatgatgtaggatgagcaacttctcagtgggctccctgattccaccactgtcttgtggggaagaaagggggaatcctctggctggacattgccttgatgggctgtgacctttctgtctcaccaagattctcacaagagagcatatgaaaattatattaaaggctgggcgtggtggctcatgcctgtaatcctagtattttgggagaccgaggcgggcagattgcctgagctcaggagttcgagaccagcctgggcaacacggtgaaaccccgtctctactaaaatacaaaaaatttgccagacaaggtggcgtgcacctgtagtcccagctacccggaaggctgaggcaagagaattgcttgaactcgggaggcggaggttgcagttagccaagattgcaccgctgcactccagcctgggcaacagagcgagactcagaaaaaaaaaaaagaaaaaaaaaagaaaattatattaaagagaagtaaccatagaaatgcaaggggttgctatgcctgtgtttataagtttagtcacctgagctctaacgacccagtctggaaggaatgggctctgggcctaagaacaactttgcttgactgggcgtggtggctcacacctgtaatcccagcactttgggagtttgaggtgggtgggtcatgaggtcgcgagtttaagaccagcctgaccaacatggtgaaaccctgtctctactaaaaatacaaaaattagctgggcgtggtggcgcgtgcctgtaatcccagctactcaggaggctgaggcaggagaatcgcttgaacccgggaggtggaggttgcagtgaggcgagattgcaccactgtactccagcctgggcgacagagcgagactaggtctcaaaaaaaaaaaaaaaaaaaaatggacaactctgcttccctggtctgcccctctcaagctacaagatgctggcaggttattcacccctccaagcctcagtatccttatctgtaaaatagggataataaatcctagctttataggggcctttccaggatcaaatgagctaacagacatgcaagtgcgttgtgaactgtggagcatggtgcagctggcagcaggtttctgctgttgttatgctgctgaggacttgagcattagttaagttcaccctgatccatgtttggaaaacagcccatgatgatgatgattattgagggggattcacagaggatagagtctcacctttgtcccacaggaggactcagacataagaaaaagttaaaaaaacaggccaggcacggtggctcacgcctgtaatcccagcactttgggaggctgaggcgggcggatcacaaggtcaggagattgagaccatcctggctaacatggtgaaaccctgtctctactaaaaaatacaaaaaattagccaggtgtggtgtcgggcgcctgtagtcccagctacttgggaggctgaggcaggagaatggagtgaacccgggaggcggagcttgcaatgagccgagatcgcgtcactgcactctagcctgggcgacagagcgagactccagctcaaaaaaaaaaaaaaaaacaaaaaagaacaagttaaaaaaaacaaaaacaaacaggaatccatatcttccagaaatatcacctggactctagacaagtgtgtgggtaggaagtgtttctgggacagatgccaggattggagcccagcagataatcaggggaggctttctggaggaggcgagcgcctatggaaggagggcagggtcctggctaatctgaatgggaagagaagtaacaggaaggctgctatgtgctatatataccctggccaggcattttcatcaaagtcttcctatgtccttacagcaacctgggaggtggacagttaccaccatttgtaggtgagaaaaaaggggtgagagtaagtagcccgaggtcactcagcttcatttatttgaagaggacatattctttactctggagtgtaaggcactgttcaaggtgatgtgaatgccagaggaccagacaggcaaggtccccatctatgtggaagtgaggttcacagcatcacaatgacggagccactcagtctgcctccagaggccacactctacaaagaaaattatatgatgatggctgtgtttctgactctggaggcaggtaacctctctagagttttagacaaaaccagttttggggaaaggggtatgtagtcctcctgagggtttctcttgtgcagtgggcagcggctgaggggtgggagtaggcatggctctgatactgagaatttgagagctaccctgccaggcctagctgacttagccccatgttaactccagtcagttcactgtggcctctccaagttccctctggccactcagggaggactgtcctttcatggtgtggagttgtggagagaaccctgagtttgagttctgctctgttgtatgaccttgggtaagtcctgcccctctttggaccagacatgccctgtcttgacaaagatggttttttttttgttttgttttgttttttgagacagagtctcactctgtcgcccaggctggcgtgcagtggcgagatctcaggtcactgcaacctctgcctcccaggttcaagcgattcttctgcttcagcctgggactacaggtgagtgccaccgtgcctggctaatttttgtatttttagtagagatggggtttcaccatattggccaggctggtctcgaactcctgacctcatgatccgcccgccttggcatcccaaagtgctgggattacaggcgtgagctaccgcgactggccgacaaagatggggtttaatggcctctgagactcttgctagttctaggattctgtgagtttgagaatgggctgagggagcaagcctgtaggggctgggggctaggcatggagatgggagctgtgtccaggaaaggagagctgacctccagccagccagataagacactgagacccagtggcctggatgtcataggaaggggagtaaggtggctgggcgtggtggctcacacctgtaatcccagcactttgggaggctgagacaggtggatcacttgaggtcaggagttcaaaaccagcctggccaacatggtgaaaccccgtctctactaaaaatacaaaaatcaaaaattatggccggacacagtggctcacgcctgtaatcccagtgctttcgggggccaaggcgggaggggatcacctgaggtcaggagtttgagactagcctggccaacatggcgaaaccccatctctactaaaaatgcaaaaattagctgggcatggtggcatgcatctgtaatcccaggctactcgggaggctgaggcaggagaatagcttgaacccaggaggcagaggttgcagtgagctgtgatcacgccattgcacttcagcctgggcaacaagaacaaaaagctccgtctcaaaacaaaaaacaaaaattagccaggcgtagtggcaggcgcctgtagtcccaggtacttgggaggctgaggcaggagaatcacttgaacccaggaggcggaggctgcagtgaactgagaccacgccactgtactccagcctgggcgacgggagttcaactgggcaacagtttcattcaaaactcaaaaaaaaaggaaggtgggtaaggagagtccattatgaacaatgtcatttctctctgctgaggaaggggcctagatagttccaaagcagtcagagtcaagtctctggggtcgtgggcgccttgcccttctgaggtcaggatggtgtctgtttgcccgtcagtcaacactcccatgtgttttccccttctgtgtcagttcctgtgctgcttctcctgcctggaatgtgctccccttcactttgctatccagtgaactcctattcagccctcagggcctggtgtcagtgtcatctctgtgatactcccaggggaaattattgtccccagaccctagagcaaggtgcttaagagagttggggttgggcagtatatgcttttccagccactttcttcttgggtaaagggcacctcagtgtccttacctggggcctggaccaatgtaataggggcggagttccctctgctatgggatacctccaataggggagtggtttcccagaggagtttggggtttctcaataagaatgtgacattttggcttcccagaaatgtaaaaaataaagagtgtgacagggtggctgctctgtctcccccagacccctgtgagaggatagacattgttttcctagggtccagacgggagagggagcctcactcacttatttcacagatatttcctaagtgttatataccaggcactatcctcgggatgaataagagagacaaagtcctgggcctcatgaacctcacgatgagtgtgtgtataggggggaaaatacgctgaacaagtaattaagggttaacaagtgtgacaaggggaagcacagcaatctctgagggaggtcagggatggcttccccagggaggtggcgcttgagctgaaatggaaggatgaaaggaagctgggattgaagggtttgtggcactggcctcaggcaaagcacgtgctagggacttgggaccagctggctatctggggttccgtgggatccagggattgctgtacctcactattttgaatacccgaagggcagagactgggttgacagactcttccctctgccctggccagcacaaggcctggctaagtggccttggatgataggtaatgctccagtatgggcccccagagatgggcatctccggatcctagactctcagagctcatggcccgagatgtcatagggagccctcatggtacatacagatggggcagctgaggcccggaggaggaagtgacttgctcaagttcacatggccatctagtgtcagaggcagaagaaaagcccacaactgccaggccttcagcttcttcactcctttcttcagacttcaaatggaaaatcgcatcccagagaggtgcctctgctaggggtgtgaagagctgagaaggaagcaaggccaagggagtcttccctgccctcccctcaacaccttcaggggctccttccagctctctctccctcacccttctcttggaaattccccttgggcctgaaaggggctctcaatcagtgtgctctccccatactgtaccctccctgcagtccctgaagcagggctcctagcaagggttgaactgtggtggccaagccctgtgaccccaaaaatctgcattctcttgtcagcagagggcagagtgagagcctcccctcagcacttgctccttggaaatccctctctctccagaccctcaaagctgtctcagctgctcatggcctgtcacatgctaaagaaaacgaataagaggaagcattgtatgttatttgggccacagtgaacatggtggggttggaggagcagggacacacaccttccttgtgcggacccaaaggccacctctagcccgttggcagacttggggaagtcagccaagtccctgcagcttccttggttaggaggagtgaaatctctgtccgcctcccccatcgttagttataccccactgtactctatgcccttgtactccactgtcctgaggggctgattcattaaaagactgtcagcccactcacagggtgcccatctctgtgcttggcatggaaggggcgatagagacagctcagctcacagaggatttaaaccctgaatcttgtagcaaagtgcgtgattcccaggaggctcctggtagggagattactaagtgaggcctcctgtctgcttaggacaccccctcctccaagtctagccaagtgaggtcttccccaccattttcatttttattttttgagacagagtttcgctcttgtttcccaggctggagtgcagtggtgcgatctctgctcaccgcaacctccacctcctgggttcaagtgattctcctgcctcagcctcccgagtagctgggattataggcgcctgccaccatgcccagcaaatttttgtatttttagtagagacggggtttcaccatgttggccaggctggtcttaaactgctgaccttgtgatctgcccgcctcagccttccaaagtgctgggattacaggcatgagccacagcgcccggccccttttatttatttatttatttttttgagacagtctcgctgtgtcacccaggctggagtgcagtggtgtgatctcagctcactgcaacctctgactcccaggttcaagcgaatctcctgcctcagcctcccaagtagccgggactacaggtgcccgccaccatgcctggctaattttgtatttttagtagacacggggtttcaccgtgttggtcaggctggtcttgaactcccgacctcaggtgatctgcccgcctctacctcccaaagtgctgggattacaggcatgagccaccgtgcctggccttccccaccattttctaagagggtcacgaggcattccagctcattcttgtggttcctggagttctggtccatatgccttccataccacctacttcttcccaccagtcctagcctagcctgtcctgtgttcttggcagtgggcagtactcctcccacaggatcctggagcaagcactgcctttgcagtgaaagtatttatgcgctatcatcactacctccgtcagtatgcaagcgtcaccgttgctactacagctaatctacaagccccaccatctccacctccaccagtttctattaaacacataggtacacctactatgtgctgagcctggggttactcaaaggagtcagacaatcactgctcttcaggaaactgttctggttggaaaggcagacactaaaactattgtctgaaggcaagttctgggatggtgaacacggggtgcaggggagccctggggtgtgatcagtactatatcagaaggcagcactaatgtctgtggggccttcattaaggaagcactgagctgggggaagagggggtgcaaggaagacttcatggaggagcagcatgtagagcagggcattgagaatgaaaaggcacctttcaggccaaggtggaagaggggatggcaggtgtgaacgcctggagttgtgtgctggagggtggcaagcagttttgtgtggttgtagctctgagaagaagattctcatctcagagatgaggtcggagatgaggctgaactggtgggcaggggcagctcctccaacgcttcttgtgaaggccaaggaacctgccacacttcagaaatcctttgagcctcttcacatacctgtcctcacttaattcatgccaagaaatttagactttatccttgggtattccctctactcccccatactaactgttctttttatgggccccagtttccctatctatataaattcagggaattggctagctgatctccgaggtctttttcagctttgacactaggaccattttctctgtgcaaagtgtacacgcagcttggtacacagtgtatgctcaatgaatattttctatgggtgaataacttgccagcctttcaaggactgcactgttgtcaacctgagactctagcaagagaagggcctcagagagagttgggtttagctttgactctcacattttgcagggagggaagagggtttgctggagccatcgggcataagaggtagcacggtatagtggaggggcttgttctggtggcaggaaggataagccatgtggggtctagaactgagggctctagacttccagcccagtgctctctctgctctaccatgttgcctctagttggagagacagggcagaagtgatggtaaagaagagttattgcccaggcaatggggccctgggcaggtccctcagcacaaggacacctgtgatgaggagacagaggtgggagcgccaggcagcctagaaggcttttcttctctctgtttttaatttttcactctgtcacccaggctggagtgcagtagcgtgatcttggctcactgcaacctctgcctcccaggttcaagcgatcctcccacctcagcctcccaagtagctgggattacaagcatgagccaccacgcctggctaatgttttgtgtttttagcagagatgaggttttaccatgttggccaggctagtctcgaactcctgacctgaagtgatctgcccgccttggcctcccaaaatgctgggattacaggtgtgagccacaatgcctggcgtttttaaagaaaaaaaaaacatgcacacacacacacacacacacacacacacacacacacacacacacacacatatatatatatatatattttggtttttttttttttgagacggagtcttgctctgtcacccaggctggagtgcagtggtgtgatcttggctcactacaacctccacctcctgggttcaagcgattctcctgcctcagccttctgagtaggtgggattacaggcatgtgccaccaagcctggctaatttttgtatttttagtagagacagggtttcaccatgttggccaggctggttaaaaaaatatttaacaggccgggtggtgtggctcacgcctgtaatcccagcactttaggaggccaaagcaggcatatcacctgaggtcaggagtttgagaccagcctgaacaacatggtgaaaccccgtctctactaaaattacaaaaattagccgggcatggtggtgcgcacctgtagtcccagctactcgggaggctgaggcaggagaatcgtttgaaccgggcaggtggaggttgcagtgagccgagagcgtgcccctgccctccagcctgggtgacagcgagacttggtctcaaaaaaataaaaaaaataataaaaaaaggacctaccttacacaattgtggataaaatgaagtaatgcatgaaagcggttagcacagagcctggcacatagtaaacactaagtaaaagggtgctactattttgaacactgtaactacagaaatacagtcagttcgatacatttgtacacacaggcacgtgacagtcacggggaggtggctggtgggctctagcggcagcagggctgcggatccgcgttctcccagctccattgcactcctcagagcggtagcctctgggctgagagagtgggcaacccgcctgccccacctggactggccaggccttcccctgtgcgccctaggctgggcggctcagccggtctcccaggtcccgggaggggcggagccgacgggatgcgcgccaggccccgcccctcctccgggcccgcccccggcctggccattggccgcagagctcgggggcgtggtcgagctggggctgggggcgcccgcggtgcccgcccgcgagtctcgctgcctccctcccggggctgcgggcccggcggccgggctggctgggccgcgcttgggttcccgcgccggctcccgcacccgcaatggggaactcacaccacaagaggaaggcccccagcggtccccgggtccgcagcttctggcggttcgggcggtcggcgaagcggccggcaggtaggggccggggtgggggcggggcaggcagggaggagggtccctactgcggtcgtcgccaccgctgctgccccctcccggggcttggagggtgtgagtgtgggggggtcgggaatccccgcgcagaccccacccctcacaggcacacggagacacacgtacacggtaatacctacgggcgggcacacgtacatgttcgcagtttacacagtcacacgcacaacacccactcaaatgtacggacacgcagacacaggatcacatacaccatcacacccacactctcgtaccatcgcagtaggacgcacacagcctgagacataggtacatgtatacctatgcatgcggtttacacagccacacgaactacacccacgcgcagatccagacacacaggcacacagtcgttcacacacatcggtcatgtgggtacagttgcccagcgtcttaggcacacagatgtacacacaggttcataactgcacaaccaaccggactcgcattcaggctcacagcagaccctaaggcactcggacacacacgcttatttcccagatcttagcccccaacaggctgaaggctgaaagtttgtaggagggaggggagacaaaggtggaagggagaagctggaaacccggggctggagtctggggaccgcctccatctggcgcgatcgggagtcggactggttttcttggctccctccctacccccacccgcgccaccgcgacttctccccgcctccccccctcccccgtccccacggtccccgaggtcgccgccgcatctccccctttcaatgcagccaccgagctggaacgcagcccttgccggctgctgcgggatccctccgcgggtcacattccaggctccaatggggaggggagggaaaggggaaggcctccaatcccaagagatgggattcctgtttcccccaacaagtgcggcagttcagggtatccccgaggggcgctgaaggaggggctatcgagagtgcctagttactggtgaatccagagatgggggaagggcagggtgatggtaccattccctcctccccaagatagagggtcttcaacataggcaggcactttagcgatacctgttggtctgggggagtgaggaaatcccagaggaggtggagtgaagggggccctgctgtggtgggagaatctacgggtgtattcccaggatggcccacattcctagagattccgaaccggagcttgatgatctcatcgctccatggagggggtggtggaaagagcctgggctgggaagtgggggacctctcctctcaatgaggctgtggaataggccctggtgaccttgagcagattcctttcacttgtctggaccactctggctcctacaggggttctgtctgtgaaatcaggggccctaggtgacttcttgggacacttactgttctggctagccatttcatggatgacgagactgaggtccaggaaagagggacttgtccaaggtcatttgcctgtggtggtttgaggtagtaatataatcaaaatgacaataagaaaagggttaactaagttcagttaggctctttgaggatttctcagaaggtaggtgttgatgagaatctccaggaccttccagcactctccctgccccagcagtcctgaaagccctgtctgtgcctacctgtctctcctagaatctgcactaagggggcagggctggggctcttcatctgtcctctgatggtcgctcggatctgatggtttcctaggaactaactgtgggcccagacttgtgaccatttgtgatggaggagagagaagataagaaggctgtgtttatagtctcttgcctactggcccttgaggaagtggcctggggcttccagcaacacttgtgagcttccagttcctgctgcaacttatgggtcaactcaagctttaaggcgttctgaaaaaaattagaaagcaatgtcaagacaacacagaaattaagtgtgaggggctaggaaatattctaggcaatatatcaaaagccttctgggttggggtcagctttagaaaactgaggagatggtcctaatttgtctttgaagtaatcacaggattgaaattagtcctaaattgttggttaaatgagagaaccagggatttgtttcagctgtggggtatggccgtgagtaaaggcatggagttgaggtcaggcgaggtggtttatgcctgtaatcccagcattttgggaggccgagatgggaggataacttgagcccaggagtttgagagtagcttggggcaacatgacgagaccccccccccccgcccatttctacaagaaataaaacagtatctgggcgtggtggcacatgtgcctttggtcccagtagcttgagaggctgaggtgaggggattacgtgagcctgggaggtcaaggctgcagtgagccgatcgtgccagtgcactccagtctgggtgacagagtgagaccctgtctccaaaaaaaaaaaaaaaaaaaaaaaagaatgggctggatgcagtagctcacacctgtaatcccagcactttaggaggttgaggtgggtggatcacctgaggtcaggagtttgagaccagcccagccaacatggtgaaaccccgtctctactaaaaatacaaaaactagccaggcgtggtggtgggcacctgtaatcccagctacttttgaggctgaggcaggagaatcacttgaacccaggaggtggaggttgcagcgagccgagattgcgccactgcactccagcctgggtgacaagaactcgactccatttcaaaaacaaaaaacaaatggagttgagactgagcatggaggtgggagggaaaagtagctgagggtcctcttgaggttccattgtgaatgtaaacctcggtacctttggttttacttgtgctgaggatcctaagtcatcctcggcctcagcctctgctgtgacaagcccagatggggactggagcttgagtataagtactcaagtgccagtataagtactcatttcattagtctgtgagaagaggaaggagagaatacaaggcagggagagaggtctggagtctgcaggccacagggagccagtgaaggtgtttgagcaagggaggagtctacaaaagtggggtgttaggaagatggctctagggtgggggcaggtgcaggcaggacaggttgaggggtggggtggtgagagtggaggctcagagactgttgcagtaatccaggggagaggtgatgaggtgagggctggggacagggtgggggttgtgggagtggagaggagtggcagctgcagagacacttcggaggaagtggctgaattgataagacctgggattaaccagatgttgagagtaagggccagagggagctgtgtgggcttctgtgcttgaggctgcttggctgggagatggtagcagagataaaaataagtccctatgctgtccctttacatcagttaattcatttgtcctttgtcctccaacagtcccacaagccacaggctattctcccattttagagatgaggaagctgagttcggagaagtgaagtcactttctcaaggccacacagcaaggagatggctgaatctggattaaaactcaagcctgtcacattacaaagcctgtgcccttaatcagtttaggaatagaagggtgtcatcttatgacaccctgcacgtcctctgggcagagaaagcctgcggccccggccccgggggatttggactatgtaaagaggactagtggaggaagcactgtggggagggttaggggttgaggactaagcattaaagcctccaagcgcttagagaggaagcaagtgggaaggggaaatcaagactcaaggaagcgttgatcccgcagatcaaatgcccttgtaaggtagagaagggtgaaggtgtatgaggtgaggcctcctgactgctggaaagatactgtaacctgccgggattgtttggtcttggcactcagggatccacccaactctccccttcccaggctagctgagcactcggtcctgggtaggttggggaatggtggtggatgtgaattggtaacccaggaagacccgccctcttccttttcccatgcgttgcactgtcaagctcacacacatggccctccttctggttggatttattgttcccattgtgcacatggggagactgagggaagggactgctggagtcagaccatctggaattcttttcatccttccccctgcctgtagacctggaggtttaacttcttggagtctggggtctttggtaggttccacagctggacaaggctccctcctccattccccccatgtctcgtcccctttcttgtggggagacttgtgatcaactgcttgggtgacttgcttgtgggagccccgggcttccagataagaggctggtccagctctctctgatcccagggatctgagataagcggaatctccttgctgccccaggccccgactcaaggaagggaagcactgaccccccttccttctaggggcaaagtcatccatggtgagggctctttgaagatcatctctccaacccctgccacatctcagatgaagaaactgaggcccagaaaagcacagtacctggctcaggatcatgttgcaattaaggggaaatgaaagctccaacctaggaatcctcactccagggcagtgagatctggtctgggcctggaattcccttccttcccaaactgaggggttagggctgccacatggaggggtgtcactaaggagagatagggagctgatgtcaagtgttccttatcagaccttatcttaatggtccttaaccttacttgagatttgaagagagctggagtggtggggagaggaggctgctggtggcataggaagaacatgattttgcagccagtcagagttgggctcacatcctgcctctgccatttctagcagtgtgaccttgggcaagtctctgacccttggggtcagggtttacactagattgtgtggctttctttaaggttcccaggcactctgtgatgtgggtgttagtcccaccttacagatgaggggactgaggcccagagaggccaattccttcatccaaggcctggaatccagacctcctgattcccagctctttcttctccttactctgtggtgtctgcctctggcatccataagatggggataatcatgccttgaaggaactaaggaaagggctgtggaaagttagaattgcgccttggctgaaagggattattatgtcattgctgggagcaaatactggcccagaaactcattaggacatttattaatattatcgtagctaattcctccgtgcactactgcctgttcccccagggcaccctgtgggatgggctcctcccctccctgctctgggcactccctgccccccattatttaccttagaaccggcctgtcagctctgtccctgctggggtggggctggacaccaagggaaggaaggagagggattccggcacaggtggggtgcagagcccctactttctttgggcagagattgaggtcgtgcccctcccccaactgcccttacccattaactttctcagacttaggatcactaaggttgttggagtgagacccaggttcaaccactccctggttgggtgaccttgagcaagttagtcactttcccttgagcctcctggtgctcatttgtaaaaaggaaaccactcctgccttttaactttcttgttaggtgttctgcgagacagtagaagagaaagtgttttgagaaccgtaaagtgcctccacctgaaagtttgttatgctcattttcctttgtcttgcctctttgggaataaaatctacattctggtttctgcttctgcttctagaatgtgtaatggttggggagcgggggccttcgtttgtccacctgtgcagtgaggggttgaggctaagggcctctgaacacccagcattctggctcatgggctggccagggacagttcagacaggagtagggagttgggggctgggttggcttcagagggttcggcctcctgagcaaggccacctggacagctgtgccctcccccttcattcctctcccctgagtcaggcctgcctggctgtgggcgcgccaccacccccgccccttgctctggaatggggcaggttgaggcctcaccccatggaggatgttgccaagacagtgcgtgcgcatgcgcgtggccttgggaggcagtggctccctccccgattcttccctttccccaggcttaggaaagcccctgagtaggggctacacacacctgtttttctgtacacacagccccttggcaggccctgtgtgggtctgtgcggtcgctcatgggtgaggaaggcagggactagggtggcttaggtgtgctttatgggtgtgtgtgtgtgttttttttttttttttgtttgagaccgagtgtcactctgtcacccaggctggagtgcaatggcgtggtcttggctcactgcaaccttcgcctcctgggttcaagcgattctcctgcctcagcctcctgagtagccgggattacaggagctcgacaccatgcccagctaatttttgtatttttagtagagacgggctttcacggcgttggccaggctggtcttgaactcctgacctcgcgatccacccgccttggcctcccaaagtgctgggattaccggtgtgagccaccgcacccggccatgtgggtgtggttttgagagtgcccacctgcggaggtggccccagtgggacgctgcctgctgcctgagtctctgccctggtaaactgtctctgagttgaggagcccgcaggtgtgcttcccggtgtgccctccgtgctgggggcgtggccaccaggagcaaggtgtcttctcagatccaggaagcctcctcccccaggcatgttggggatgggggtgtggtatgggatgcttccctcatggcctcagccctaggctgcacctctggactgccaggggcagaaatccctggaacaaggactctaagcgtggctgtgggcaaggtctttccactctctggacctcagtttctttgtgaagtacccctcccagtcacctgagactcaggttgctgagcccctccccaagcgagccacaggtgtatagatctggggtgactcggagaggctgcgagctctgacttgggtggggagggggaggggtgtcgctggggcaaccagatgttatcaagtgtaagcccttggatctctgggaatttgcagctgtggccctgactgccagctgtgggcctgggaccttgatgagctgatgttcctccacccccatcttggcaggagctcagcccttagtttccctggttagagggtagctgaagatgactgtcctgtgtggtgaaaggctccagttttagagccagccagagttcaggaagtcacttagctctctgagcctcgcaggcccatgatcaattactaggaaagtaccttccagtacctgcctcgaagaacttttgtaagagccatgaggacagagactacgttttgcctttcaccacgacctggcatggtgcctggcatgaattaatcaccctgcaaatgtcggtctactggtcttttctgtttgtgtgagactgataagaagagtgggtgggtgggtggatctggcctaagaggggaagagtggggaaggtaggtggtcgagaaacctccaatttgtagggatgatggggtcccatgaccctttttcagaggggagatcaggtttgtagctggcacagtgcacagaacgtggcttttggattcaagttgttctgagtgagaatactgctttgccatttacaccatggaggccagagagggcagctttataatgcttgctccctctggtttccatttcctcatctataaaatgggaataaaagtgcctacttcttaggattattgtttagatctcattgatttgttgatgtgactattcagctccacaaatgtttgttctctggagagcaagatctcagcttgtacttgagtagtctccaagaggccagtgttagggtggcagcaactggggaaggaactgcaggggggtcgtgttgcttgggagcctctgtgaatttttagttccctagggactcagagagaaagatgctatgacagagaggtgtccttaggcacggctggtgggatactgcacagatacatatatatagttcacagactctctttcacagtctctgctatgttttttagagttatcaggggaatcttttttttttttaagctttatttttatatatttacttttttttttttagagacagggacttactgtgttgcccaggctgtagtgcagtggtacaattatagctcactgtaacctcgaactcctgggctcaagcccagcctcccaggaaatcttttatttatttttttttttgagacggaatttttttgctctcttgcccaggctggaatgcaatggctgcgatctcggctcactgcaatctctgcctcccggattcaagcgattttcctgcctcagcctcccaagtagctgggattacaggcgcccgccaccgcgccttgctaatttttgtatttttagtagagacgggctttcaccatattgaccaggctggtctcaaactcctgacctcgtgatccacccaccttggcctcccaaagtgctgggattacaggcatgggccaccacgcccggcccggtcttgaactcttgacctcaggtgatctgcccacctcagcctcccaaagtgctaggattacaggtgtgagccacagtgctagcctggaattttttttttttttttttttgagacggagtctctctctgtcacccaggctggagtgcaatggtgcaatctcagctcactgcaacttctgcctcctgggtttgagcaattctctcacctctgcctcctgagtagctgggactacaggtacacaccaccaccatgcccggctcatttttgtgtttttagtagagacaaggtttcaccatgttggtcaggctggtcttgaactcctgacctcaagtgatccacctgcctcagcctcccaaagtgctggggttacaggcgtgagccaccgtgcacggccagaatattttttaacagtgtcactacccagctgaaaccctcaaggcttatggggcccagcctgacctgtcgcctgctctcctctgattccgtctcctaccattctttccattgctcaatcctccagccatactggcctcctctctcttccttgaaatccaccactcctgcctcaaggcctttccacttgctgtagcctgtctagaagactcttccccaggtacctgccctgactggctcctcagtattcaagtgtcagttccaatgtccttttctgtttattttattgtattttatttatttatttttgagacagagtctcactcttgcccagactggagtgcagtagcgggatctcagcttactgcaacctctgcctcccgggttcaagcgattctcctgcctcagcctcccgagtagctggaattacaggtgtgtaccaccacgcccggctaatttttttgtacttttagtagagacagggtttcaccatgttggccaggctggtctcaaactcctgacctcaggtgatctgcctgccttggcctcccaaagtgctgggattacaggtgtgagccaccgcgcctggctgattttattttttaaagatgcctgtcactcaggcgggagtgcagtggctcaaacatggctcacggcagccccaacctcccaggctcaagcaatcctcctgtcttagcctcccaatatctgggaccccagctgtgagtcaccacgcctgggtaattttcaaagttttttgtagagataggatcttgccttgttgcccaggctgatcttgaattcctgaccacaagccatcttcctgcctcggcctcccatagtgctgggattacaggtgtgaaccaccatgcccagcctattcttttcttagaggggcttttcttgacaacctaactaaaccactctccccgccccccggccccaccaaagcttcctgttacagctctggagtcttcactacccaaaattacattgttagtttacctcatccatgtattcatcaaatattttttgaactcaactcataacatgttccaggcactgatttagcctctggggataaactggtgaacaagataaagttcttctccattaactatagtccctagtactaggttaacacatgtttgctgatcaagtgaatggatacaaccatcttgtttttttcttttttttttttttgaaatggagtcttgctctgtcatccaggctggagtgcagtggtgggatcttggctcactgcagtcttcggctcccaggttcaagagattctcctgcctcggcctcccgagtagctgagattacaggcatgcaccaccacaccaagctaatttttaattttaattttagtagagacagggtttcaccatgttgggccaggctgatctcgaattcctgacctcaagtgatctgcccaccttggcctcccaaaatgctgggattacaggcgtgagccacagcaatcttaaaaagaggagttattagccttattttcatatgagatcgtgacttgtgtgatggagctggatttgaacctcgacctgacttcttttccagtacttctccacctcacctccttttttactgccttcacccatggactgtttcttggctaattctgttctccctgcctggtgatccaggacagaatcactgacagcgtggggccaatgtgaagaattccaggctaggggagaaggaggtctgctttgaagtctagcctctgcaagattaagtgtgatcttggagagtttactgtgtttctctgggcttctgatgtcacattgccaaagtaggaagaaagtcctttggaaagtgtggggctgaacctatgtatgaggggctgtactgccagccactgtggttctgctctgggcatctccctggcttcccaggactgtgtcctgggactggcccctgcccctctgggggcctctgcccacagccttgccatcccactagcagctctgggctcctgcctggctgctgcaggctccgagctctttccccagggaattacgctaggcagccaggaggcttgcaggtgggcaccctgccaagtctagtctggtagcccctccacctaccatctggcagctgggacccctgccttaactctggacttgcaggcagggtgagtgatctgctgctggattgagtatcttcggtcctcctaatcatactctactggagcagagcacccacggactcctggcctcagttgcctttctgtgcccctgcaccccatttaaggggtggggtcggcagatgggcgggatcagtggcgaaggtgggaggaggacatggagagcagcccctccccctcctctgtctggagccggtgctctgcggcggggcgggagggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctagggctgtttaagaagaagggtgagtgggtgtggcttggggggaggggagggatgctcgatgcctccctttcccagacccttatgtagaatgaggaatcaaggctgggcaaaagtaatggggtggggctgggggctgataatgaggccagaatctcccatccggctgtgcttttgtccagccgctttgttgctgcctttgtctgggccctgcttgtgggttgggaggatggatccaggtgtctctgaccttgaagcctgcagccctcccgtgagacttgcctccctgccggggtacccacactttactgggtacagcctcccagtcaagatgtactagcctttcctagtgtgccggggaggatgggacgtgggcggcccagaagagaggagagtagtaccactggaagttgggaagcctgctcagtgaaatcctgtttagaggcctgggaatggagaagttttggagggaggggcctgttcctccttccttctcctaggaattgggctttcagacctggattaagacatagggacaagagtttattggacttttgagggttgggggcccctactctgagtgtgatccgggagtcccctctgggaacctggagttgagtccagggtcagtctgactcctactgctgggtgaccttaggcaaggccttgcccctttgaaccgtttccccacttgtaaaatctggggatctcgggcactggtctggttggatctgttgggggcctcctagctctgacctgtgggattcctgcagactccctagggcaggagctctggctgttgacgaatgggctgagggaggaggaaaggcaggtttctgaactgaagaccctgctcctggagcatggccctttaaagggcttgttttgttcccgtccctttataaggtgttaccaaggtcacatgacccttccagcgcttttgcttatgttgtgggtttcatttaaagggggggctggggctgcaaagtgctgacacagccccccatccccaggattagatggccagcccctccacaggcggggcttgtaacaggatcctttgtaatggatccctggctcctctgcaacaggggccagggccagggccagggcctccaggagagggggatacctgggactatttccccaagagagactggagctcccttgggcgggtggaggggcctgggtctttcttctcccctcccctgcccatccttccactaaggggcagccacatgggtgagtaggggacccaggaggctatctccttggtctgcatcccccctaggattttctgggaatatggttgtaactcatgccagctgtctctccttcctgatttcccgtgatatcttcttcctggacctggttcaagtggtggcatgaaaagagtggtttgttttcctgtgaagtggggttttgggtatggaggcgagagcaatgtatttactatgggctatgtgtatactcgggatgttttttgtggggctctgagtgacgtgtgagtacatagtcgtgtgtatacttggttactgtttgtgtatatacagagcagggactgtgggtgttgtgtgtttacgtgcgggctgggtgtgcttggtgtgtgtacctatgtgtgtttatactcggatgccctttgtttatatacatgaatgacatctgtgagtgctgtgtacgtacacagtagacctgtgtacctgtgtgccctgtgtgtggggccttatatggggccctttgtgtggtgtgggtactcagatttatgtacacttgggtgtagtttgtgtatatgggggctgtgtgtgttgagtgtttactccagaactgtgggttatgtgtccagactggggaagggggcattgcttgtatatgcaatggccgtgtgcagtctggggaccatgactgcccttgccgtgagacctgtgcccctgcagggcccagatgcctttacctcatttcccttcctcctccctcctactaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaaggtaagcttcctctccactcccctcccctctcctccctccagtgctgcactgtcagctgtcaaggtcaggggcctaacccaacagacccttctggtgtcttccagagaaacagaaactgaacaagggtggctgggaccatggagacacccagagtatccaggtgagccctgcctccagctcagtcctgactcttctctacctgcttgacccctggcaaggatgtcttggaacatttctgggtctcagtttctttatcacaaagggctacactaaatgaaccctgagggctagttcagggttgctcagtgctaggtgatgctggaggggatctgtgactcaaaagttcgagtgggaggctgggcgaggtggcttacacctgtaaccccagcactttgggacgctgaggtgggcggatcacttgaggtcaggattttgagaccagcctggccaaagtggtgaaaccctgtctctactagaaatacaaaaattagccaggcatggtgggagggtacctataatcccagctgcttgagaggctgaggcaggataatcgcttgaacttgggaggcggaggttgtggtgagccaagatttcgctactgcactccagcctgagctggatttgtctcaaaaaaaagttccaatggggagccttgaggagacagccccacccagatctccttctaccctgatagtcctcccggacggggccggatgaagacaacatctccttctgcagtcagaccacatcctacgtggctgagagctccacagcagaggacgcgctctccatccgctcggagatgatccagcgcaaaggtggattcatgggcaggggagagggacagtgggctccattgggtcccagcatctgtagcttcttttcctccttatccagtgtttcaccaggctctctgattcaatgaattcgggaaacacagtaccctgtgtcctcttgcacattcgtgatacacactaactataaagcagttaagagttagaaaatcttggcggccgggtgcggtggctcacgcctgtaatcccagcactttgggaggtcgaggtgggcgggtcacgaggtcaggagatcgagaccatcctggctaacacggtgaatgaaaccccgtctctactaaaaatacaaaaaattagccttgcctgatggcgggtgcctgtagtcccagctacttgggaggctgaggcaggagaatggcgtgaacccaggaggtggagcttgcagtgagccgagattgcaccactgcactccagcctggtcgacagtgtgagactccatctcaaaaaaaaaataaaaaaagagttagaaaatcttaactgttggaagcctggtgtaactaactagtgccagctgtgtgaccttgggaaaacccttaacctctctgaacttctgtttgatgttctataaaaatgaggataagtaccctattggaatgaatgccaaatgtttagaatgacgactaacacgtaataatatgtttactaaatagtaagctatcactaaagggaaattaccatcattgacttagtagccttagtcttacagaaagaagcctctagctttgtttaacctagccttgcccatacctacttgactgtggaaaccatttctcgcagagctcttattacaaaagtagtgccctgcagaatgtgcctggagtcctttgctctaacagtttttctcccacgactggcccccaggctccaccttccgaccccatgactcatttcccaaatctggaaagtcagggcggcgtcggcgggagcggcggagcactgtgctgggactcccgcagcatgtgcagaaggagcttggtgaggcctgggttaggagggcagtggtggggtgggtggggagccttggtcatcccctctctgctgaccccacctcctccctgtcccttccaggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcaggtacagtgggcagtgctagggtgaggtcccattgctgatgatgggaagtaggaatctgaagtcccgccatgggggatttgttcttggatctttaacttttctggtctgagaatgcctgggaagggcaagctgtcacccttgctggggcccagaggagaatggtgtgtgagtgtcaggcctactgtgtttgaattccaactttgcctctttccctacccttcctagctacattgtaaagtgtggggcagtgacacctacattatagtgtctgaacatgtgtagggtgtccagcccagtgctgcgggcactgtcagtaaatcaaagcggtaagaaggttgggtgagggtatgctttgttgggctcctagtgccagaaccaagccaggaggccccttgctaagtgtctcttatttttctcccccagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 632 - DNA, 13237 bp, Homo sapiens
gtttttaggcctttgccacgcctcgggagcgccacgaactcaacagccgcccaagccgccttccggctcgcggtctgcggacgcgctcggagttgggggccttcgccaacagctgccgtaccgtgccgcgtcgcagccgcacgctagcggggtcaacggcgcggcaggcgcaggggtcctcgccaaggttcggaagaggaccttgaaaatggcttctgggcatgcgccacagcggccgttacgagacgcaaaaccgacgccttggaactgagagcctagagggacggagctcggcgcaccatgaggctcccggggcccaaggccgaccgtgagagcgcacgaggttggcgagccccgcggggaggccgaggcgcgggtgcgggcgccggcgtagccgcggcggtagcgtcacgcagcgaggccgtgcgtgcgcgggcgtcagggcggcgctgagttgaggacgctggcggctccgcgacgagctttgttttttcggttgggcatgctgcttaccgcaggatgatggaagcgacggcccgtacaaagacagaagcgttggtttcagtgagcagggtttctttttctttttctttttttttttttgagacggagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccagggtttcttaatacaagttggtgactaacatgttgcctagattccagattaaagtctagttgttggagacacatgtgcaatagagaactaaaatttaaattcaagttcgtgagtgaattgaatagatgttggagcatctctagtttatcaaggacactttttttccccctcgaaatttcattttgacgatgtgtggaaaaatttttgaaaaaatttgaagttgagggtcttagcaatgaaatgggcagaactcctaagattgctccgtttgtatctagttgaactattcatgatagtaaagggaaaggatggctgttttcgctcttagtagggtttgacgtagtgaaaagttacgctttctgagcctgtttgcgaatgtctgaaaaaatactggatacattctgtggattaaatggtagtccacatttaatccacagattggctattgtgaataatgctatgaacttcggtgtataaatatctgttcgagtcctgctttcgtgtttttttttttttttttgagtactcagaggtgaattcattatttacttttaagcgttctatttaaattatatactgtagtaaggagtaagaaagaggctttcgttcttcccttctgaactaggcagctatttctttcaggtatcgctttacaaaaacggttttgtatttattacagctgagtcagtgctgattctctcaaatagagcttgaaggataaatcttcatttttgtttcaacaaaacttcgaaacaaaatggaagaaaataatctacaggtaatgccacccttcttagctgcgtctttgactcttaagaattatcacctggatgtattgtgagataattgcaaacaaaattgatcacatttaggtcctagcatttcccggggtgttggttgaggtaaacaagggtatacatagatgaaagagtcacatttggtgtatgtaagtaaaataaatgtttttacttttatcactaggtgttaaagtagcaaaatctattttaaaaacactctaagtagtgttccccaatgtggttgtgtatatggatcacctggggattttgttaagttgcagattctgtttaaggaggtctagggtgaggcccaagcttttgtgtttctaaagtttctaggtgaagatgccactggtttggaaaccacattgggagtacctagggtgtagctccctgctgtccagtagctacacatggcaagtgggcacttgaaatgtggctagtggaattgaggaaccgaactttaattttttttttttttaagacagggtcttgctctgttgcccaggctggaatgcacttgcccagtcacggttaactgcaacgctgaccacctgggctcataacttcatttttaattttaagtttaaaattggatatttgattacattattggaaaaaagtatgtttggaataacttgggtatgtgcatgtatattttaaatgtaaagtttttaaatccaatacagacaagtatttctgatgaaggttttggaactgagacgcagaagtacaaaatatgtagcacactggattttgaagacttaatgtgaaaaacaagaatctaaaatctcttatattgattttatgtaaaaattatattttcgatatattggtttaaatattctaattccgattataattccaattcttgggctacaagaaagttgcctacttgtattttatctattggacagtgctacatcagatatcaaataccctttggactacttttataatactgctgtataggaatagtaacagctattacagattaatcttataaattctgttttttcttggggtcatgttaaagaaaaaattagtctgactttattgaggactgttgcaataagaacattgcaaagatgaagaatttgaccagatagggtgatcagatatcaggggtagaagattctgtctaaactgacttagaagtattcttattaaaactgggctaggcagcccaaagataggattggggccagggtttgaggtctattcaagaagatggctcagaggaacctgactgaagtttggtcagtgagagagtcttttgctggtgtgttggaatgttcctacagatgcccaactactcaggaggccgaggccagaggattgcttgagcccaggaattttaaaccagcctgggcgacatagtgagatcctctctctctcttaaaaagagtgttggctgggtgtggtggcttacacctgtaatcccagcactttgggaggccaaggcgggtggatcacgaggtcaggagttcaagaagagcctggccaacatggtgaaacccgtcactactaaatacaaaaattagccaggcatggtggcgcatgcctgtaatgtaatcccagctactcgggaggctgaggcaggagaattgcttgaattgagggaggcggaggttgcagtgagctgagatcgcgccactgcactccagcctgggtgacagagcaagactccgtcttggggggaaaaaaaaaatatatatatatatatgtgtgtgtgtgtgtgtgtatatatgtgtgtgtgtgtgtgtgtgtgtgtacatatatatgtgtgtgtgtgtgtatatatatgtgtgtgtgtgtaagtgtgtgtacatatatgtgtgtgtgtgtgtgtatatatatgtgtgtgtgtatatatatatagtcagtcattataaatattttccagcctcctgcctacttggaccacaggctttggcgactcactccacaaaaggtcccttatggttaggagtcatctaattgttttcattgaatacattcattggtaatgttcccttcagctgaaactaagctatagggagcatacagctagattctctcttgttaaaaggcatgagaggatgcttacatgaactgtggaggaaatgcagtgctacctaatgattttaggacaaagggtatgtgaaggccagtgtgtttttcaaagtgattgggggaaataaagtttttttttttttgccccttatttaatttctgaagtcatgcatgatttagaacctgtctttttttgtttgtgaacttcagtgcagtagtgtggttgacggtaattttgaagaagttcccagggagacggcaattcagtttaaacctccactatacagacagcggtaccagttcgttaaaaatttagtggatcaacatgagcctaagaaggtaggtatttctctttccaaacatttaattattaagactagtagactagtcatatgaggtgttttgtcaaatggattagtatggagagacttttcacaggggttattgcaatagggagaatgccgtaaccacaagatctgcaggtgtctcaagagttaagcaaaaggggtttttcttttactggagaagtgaacaaagctagaaactagggaggtgggatgagagggtggtttgaaaggacagtggaatggggagccttaaggagggggctgtttcctcaggctgtagtgcagggccctgggggaagaagtaaagtttgaataaagtatggttaaaaaaggaattttcttcccattgatcagtggggacaagtattcatgataatcatttgaggcaaagaatggaaacacaaggaatcttatctaagttttatggaggagggtggttttttgcagtgagccctttcctggaacacaaagcacaggtggattcctttagcagatgccagaaacacagggctcagacagaattcagcattgtcaggttcaaatgtgaagaaaatcttaagattttatagttggatgtgatcttgtaggtaccgtacttctagagcatttagttagaatatcaggcaaactggtattgtagccacaggtattgtggttcttttaaaattagatgataatgggccgggtgcaatggtttacacctgtaattccggcactttgggaggctgaggcaggtggctagcttgagaccagcctggcaccatagtgagaccctgtgtctacaaaaaataaaattagctgtgcatggtggtgcgtgcctatagtcccagttactcaggaggctgaggtgggaggatcccttgagcccaggaggttgaggctgcagtgagctgttatcacctgcattccagcctgggcaacagagaaagagcccgtctcaaaaagaaaattagatcataatgaacctactcggttaacttcagagtaaagtcataattgcatataatctacatccatccatccatacctggttactatactaatggattggatgtgaattagatgcgggtaaggtgaatttctagatgaaagctttctttttctgcttgatgttgaagactcagtgaagattcctgtgtgtgaaggtttcccttaactccaccactactgtttctacacttggacacaaaggcgtaggtattagtttatatctttgtagccatctaggcatgtgtattcaggtaaagcatctaaaattggctttttggcagctcagagttcagtatggaatttcagatggtttgaggtaattgtttaatcaaataaatgtgtgaggggtgaaagctaagttttagaaagctttgtttgctgaaatatgctgagaatatttgactccaaattctgattctgaatgggaaaactgtgtgtacgtaattgtttctcattagttcaatatagacaataacagttgttctggaataggaatggacctttctattttagtgtgatcaaatagaaatttgcctatgggcttataaagtttcaggttagtgtgtgtgtgtgtgtgtgtgtgtgtgtgtgtgtgtgtgtgtgtagcatcttctgccaaaaagatccttccatataatactttcattattttattactgatatatactccactctctcctcctcaaaaaaaagtttttgatcatacttctcttgctataaatgtctttgaaataacattctgtctcatctacaggttgcagacctgggatgtggtgatacttcactcttaaggctgctaaaagtcaatccatgcattgaattgcttgttggagtagatattaatgaggataaattacgatggagagggtaatacttagtttctgaaagaattatgcgttaatctaaaactaatggcattattgagtttagagaaagtgttgattttatatttgttttaaaagattggggccattagggatcttcaactcactgaataatcaggctttgccataacactaaaaatacctgcattttattgctaccaacttaaagaatagcctcaattaaatgattataataatcaaagcattgtaaattaaaattcagatagcaaaatctcatcactttaatgctggacactatgataatttatagcagaggatttaaaatgccccagaacactgaggccaaggctccaggccaccgcctgcattttgaaccatagcatttctcctatctcttgtatatatagtatatatacattagatttccacagattgcttcaagaatattctttttctaaagaacaaaaatctcaaaatcactgaatcaaagtaagctggaaaaccaaaagtattacaaatgaaaacaatataacaatattaaatattcagtctttttttcattggccagtaacttcccactgtgagaggaagtttccccatgacctggtctttaatatgtcaagacaaggaaaacaggctgtgtcagacttatatcaatagaggtagaagataattatcagaggatctgagttctgtagctggtgagaatttttaaatagataatgttcagaaagtttcttcaataattattttgcagggattcgttagctcctttcctgggggattttctgaaacctcgggatctgaatttgaccatcacattgtatcatggctccgttgtggagagagactctcgtttgcttggatttgacttgataacgtgtattgaattgtaagttttaaactgatacactgtataactgttcatttgaaaagcctgaataagtctcagtgatcttagtgtcctaaatataataggtcttgattattgtaaggaaaactgctcattggttgggaatatctttttactctgcttttccaacattttacttagaaatttcaagtatacagataaattgccacaaatacatagtaccaagaatacctatacccccctttatccagatgttaacatctcactttttaaatcatttgtacattgcaccctccctctcctgttcacccctcctccatctccctttagagttattttttttcctgaatcaattaagggtatacacatggccttttgcctctactaaaaaattcagtttaaaagttggaggcctcacactacttgacttgaaaatgtactacaaagcagtagtaataaaaacatcgtggttctggtataaaaacagagacatagaccaatggaacagaatagagagaacccagaaataaatccatgcatttacagccaactgatttcaacaaagacaccaagaacatacattggcaaaaggacaccctcctcaataaatggtactgggaaaactgcatatccatatgcagaatgaaattagactcctatctctcactgtatacaagcatcaactcaagatggattaacgagttaattgcagacctaaaactatgaaagtactggaagaaaacaggaaatgcttcaggacattggtctaggcaaagattttgagtaagactacaaaagcacaggctacaaacagaaatacacaaatgggaatatatgaaactgaaaggtttctgcacagcaaagaatagagtgaacagaacctatagaatgggagaaaatacttgcaaagtattcatcaagggattaatatctagaatatacaagaatctcaacagcaaaaaaaccccaaataaaaagtgggcaaaggacctgaacagatatttctcaaaagacatacagatggttaacaagtagatgaaaaaatgctcaacatcactagtcatcagggaaatgcaactcaaccacagtgagatatctcaccccatttagaatggctgttattaaaaagacagtaaatgctggcaaggatgcagagaaagggaactcatataaactggtgtgaatgtaaattagtacagccgttattgaaaacagtgtggaggtttttcaaaaaactgaaaatagaactgccatgtgatctagcaatcccactactgggtatttatccaaaggaaagaaatcagttatattgaagagagatgtgcaccccaatgtttattaacagcacagtagccaggatacggaatctacctaaatgtccatcagtagatgaatggataaagaaagtgtggtatttaggctgggcatggtggctcacgcctgtaatcccagcactttgggaggccgaggcaggtggatcacctgaggtcaggagttcaagagcagcctggccaacatggtgaaaccccgtctctagtaaaaatacaaaaaaattagctgggcgtgataatgggcccctgtaatcccagctacttgggaggctgaggcaggagaatcacttgaaccttggaggcagaggttgcagtgagccaagatcacgccattgcacaacgagcaaaactccgtctcaaaaaaaaaaaagggatgtatatgcacaatggaatactattcagccctaaaaaaggaatgaaattgtcatggatgaacctggagggcattaagtgaaataagtcaggcatagaaacactgttgcctgggctggagtgcaatggcgcgatctcggctcactgcaacctctgcctcctgggttcaagtgattcttttgcctcagcctcccgagcagctgggattacaggtgcctgccaccacacctggctaattttttgtatttttagtagagatggggtttcaccctattggccaggctggtcttgaacccctgacctcgtaatctgcccacctcggcctcccaaagtgctggtattacaggcgtgagccactgtgcctggctggtttacaattttcttgtgaattgcatagaagctcagccctctgtgaagcatttttgtcaatgtctagtttgcttaggacacactgacttagatgggatggcagcaagactttgtcagacccggttttggtaacatttaattgttatataattgcaaatttacagaagttgcaggaatggtccaaggaattctcatctgttctttacctagatttaccacttatttatatttgatcctatttactgtgtctttttccctaaatataactttctacgtgtattttttatctgaaccatctcagagtaggttggatacactgtgtcctgttaccctagataccttggtatgtatattctgagaacaaagacttcttaccataaccatgtaattctatcaggaaattgaacattgatacagtacgattacctaatctaagtccacattcagcattcatcatttgttccagtaatgtctttctatagctattttaaaatttagctataatttaaaatggcccaagatcacacaatgcatttgtcacgtttgcctgggctcctttaatctgaagcaggtctgtgcagcctttctgcctggtcctatttgcccttgatatttctgaagaatatgtgctattttctagaatgtcgctgtatctgagtgtctcctcattatcagattcagggcatgcatttttgacaagaatatcatagaagtgattttgtcctccttgatgcattatatcagggaggtataacctcagagacttttttttagaggtattgataatgaggccatagagcacagcaaaggaccttggttggataagggagccatcatagatggagttggggggtaggaaaggatgagaatatatgaataattgttctttttccccctcccctcccctcccttcccctctcttctcttctctctctttctctttctttctgtctgtctctctctctttcttttctttctttccttccttccttccttctttctttttcttctatctttcttgactgagttttgcttgtcacccaggctggagagcaatggtgcaatcttggcttgctgcaacctctgcctcctgggttcaagtgattctcccgcctcagcctcccgagtagctgggattacaggcatgcaccaccacacccagcaaaattttgtatttttagtagagacaaggtttcatcatgttggccgggctggtctttaactcttgaccttgggtgatccatccaccttggcctcccaaagtgttgggattacaggcgtgagccactgtgcctggcccgaataattgttcttaggtcatataagcattattacatattcaaagaagggagaaatcgatacacagatggaaattgtttttgataaatcaattagaaaaataggtgcaagtgaagctagattttattatgtctttctcattaaccattttagaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctggtaagttcagaagggtttttgtttatttgggatcctgttggagtttaaaatcttaggaaataaatattgatatacatacattacctaaattgttttgtactttcttccaataaaattgattccaatgtgtgacttagtatgtaataagatcacaaaggaaccattgcatttgggcaagtgtggaaagggggtgtggttactgggcaccttttatgtgaaggcatctgtagtactggcatggagatgaggaacaaaacagagggaaggtttgggacagtgagaatgagcctcatgcccctccccgggatatctcctgaggcttagtcatgttttctggtgtaattgcaaacccaaatgggtagttgggttgagcacttgttgcctccttgtccacccctacaccctgcccataattttcctttcgtcttccatattcttagggtaaattggaaactgacactatatccttgccttgacttctcttagaaataaatacactggtggttaggaatttgtaacttagaagtatttatgttcattgtatttttcatgttctcttttactgctgaccagaaatggttccttatttaacagtagctctacatttagaaaaatgattgctgtcctcgttttggtttcagggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtgagtattctttgtgagatagctatcagggctagagatacattaggatggtgaacttttttggggagtaagaatccccaaagtagagatgagtgtaaatgaccttgctttgtggttcactctaggagaattcttcaggccccatgactactgtccgagttagcctacggtgtcctttgagactgcctggccttttggtgtttcaaggcatgttaaagggaatgatctgctggggttgtcttagaatacttcaaagtagctgggtacagtggctcacacctgtgatcctagcatgttgggaggccaaggtagaaagattgcttgaacccaggagttcgagtgcagcctggacaacatagtgagatctcccatctctacaaaaaaacacccagaatacttgaaagcaatagttgagcaacctctttttgtaatctgttaggattatcagtagtaaaaaggaaagccagcagcagtttctccccagcttggcttaggacattactctttgagcctacaaacttctcagacccttttggtttaaagagagaagaagaagaaacacttcctccccctctttaaaaattttatttaattagggacagggtcttgttctgtcaccgaggctggagtgcaccggcacaatcatggctcactgtaaccttgaattcctgggcacaaacgatcctcccacttgagcctcctaagtagctaggacgacaggcgtgcaccaccatgctcagcttttttttgttttgttttttgtttttttttccgtagagacagggtctcactatgttgcccaggctggtcttgaacttccatcctcaagcaatcctcctgccccatcttcctaaaatgctgagattacaggtgtgagtcactgcacttacccacgttttcccttttaactgaaccatttttcatttttttttgcccttgcccctgtaatatcaagtagaaatactgggttcatgtgacttggtagaaacctggctgggagacattgggcattagcattagaaagcaaatcggatagttaatttctatgtgtcagtgatttgattcccattataactgaggcatttacgattagtaggatctgacatatattcaatatgtacatttattcttacatggcaaaaaagttattgatggctttgaaaatttatgtatgtttatattattatacacttgtaagtgttttgttttttcccttcaggtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaatatgttaattttg

SEQ ID NO: 633 - DNA, 9326 bp, Homo sapiens
ctattcgatctacaggggagcggagtcgcttcgtggccgccagcccgggaaggggcgccagccagctggcggacgcacggcttagaggggcgtctgggcagagaggtttggggctggggagagatgcagtgagcttgggagagtggactggtagcacaaataatgtgtgcataagggttagaagaggaggtcctggagctttggtcttctcttttccccctgcaattgtgcatttcggagggactcttgctgcaagctcggtaggcaatagcatccgctccaagactacacttcccagaaggctgtgagtgggtggggggggggggggcgcggggaacaggcaacctgtgttgcgcttgcgcaaagactgcgctggaaaggcaggtggggaggaggggaggcgtgcccgcgacggggcgagggggagggggccgcgcggcggcggcgccagggcgggcgcgcgtccgcggcggtgatggcggtgcgtgaacgcgcggcggcagcaatggccgctctggagcggcgggtgccgagtctcgatgacttcgcgggacagagctggagctcgtgggtggagcgggccgacctgcccgcggctgacggtgagtaaagccaccctaaagtccggggaccccatcactatctcccctccccccttccgggcccccgccagctgaggggagccgccgactggagccgccgtccggctccccggccccccaaacaaaggacccgccgggtcctagtgcccgcccgctccgtcaccttcgcgcctccgggtcctagcgcctgctcaccgctcgcagcccaccctgccaacctctgcctctgccagtcgctaatacctgcccccatataggcttgcctttatctttctccttgcctgctgcccctcagctcgcgaccctcctgcacctgcctccagctttccctgtccgcaacagtcctccacgtgtttcccacgcaccccacttctgtgcccccttcctcaccccccttgttccttcgccttttgccccacacctcctgctccttttcggcatttgcctgcagctgcagtgcttttagacccccgccctctccgcgttagttcgtccgtccatccatctatcctccctccctccatccttcggtccatccatccatgcctccaacccactgtcctttcccaggcctcttgccctgcctcttggctctctgctcttactctcaccttctctaggcccctgagtgccttagtgagcgggcctacagccccttcttctgatctttgtcttctgggccccagggagcacctggcctcgtggcctttcggggtgacagcaggcatcacgcccctgaagaagtttgcaagtgagaagaggtggaggaggagactgcacggaggggtctctaatgacacttgttctcctctgagacatccgactcccagtttcgttctatccatcattccccgcacttgcatttaacggacttagagtgggagctgccccttgtctcttgcgtgcctaacccacgacccctcataatctggatattatataagattgtcaacaatcttctcatcctagaaaggagcatatctgttaatgggcatcagagagcagacctaagtgggagcccaggccaccctggggctgccccatgctgggtgggcaaagatggggccattgtcagggtctgggtgcattgagaaccggaaatggagtcagacgggtttggtgactcagaattgattttttttttcccaagggacagggagggggcgtagaggagggaggggggaggagagaggtagggggatggggaaaaagctgctttgcacagctaagatgtttttgtcattaacccagaaactgaggtacaagggcaacccctgcccaaaggccctctaagaaggggagggacttgcatagctgaccaaggagactttgaagatgctcaaggaccaaagacagcagtttctctgctctgtgaccatcctatcagtgcaggacctgagaagctgggtgtaactttgacaatgctatggtaacccaggtggagcaaaattgagttcatgggggtggggacctgggagagtatctatttgggatgccacatagtagcagaaaggacccatcgagaaatctcaagaagagactcagggacttatagaaacattggttaaggacggtttcccctttaaatggggaagcaggcccagaaaagagatgatacttacccacaatcacccaactagttagcagtggaaccctaaactgcaccttgaagtgaagggtcccataagaaaggtggatggattcttcttagtggggccatcttagtccagatgcagcaggtgaaggaagatgggcatttgagaatggacccactgaaaggttccccaagtggtcctagcaccaggagcttgtcacggagtgtgggcttcatactgttgagctgcaggccctgcttggggcttctggaaaggggacaacctctgggttgtcttctgggaagaacagtctctggtaaggagaggctggagactctctaaaactggccctgacccttctgagctgtgtttctcctctaggggctgagctggaggagagtagcaaaaacacgaagaagttggatgccatgaccctcattaaagaaggtgggagtcgacacacattagggctgggacccagggcagacaggaccacgctccacttttccaccacactacagaaggaggtggctgcttgaagcagctgtctggggaccctcattttgataggtccgagtcggccggttgttctggctcctgtgacctgtcgttggagatcataatcataggtgattgcccactcacctgaaagcgtataccctttgggactgcttagatcgaactctggaagctggaagcattcagcatggagcttgttatatcagcggggaggtgaagtgccttctgagtgtggggtgggagtgctctccgatcttccagagaaaccctgggatcttcagccccagtgacatgggcttctgtcattgcagacatgtccatcttcgggcactgccctgcccatgatgacttctacttggttgtgtgtaaccactgcagccaagtggtgaagcctcaagctttccagaagcactgcggtgaggggagccctagggaggagataaagggacaggggaaggtggagcatggaactctgaggacagggtcagttgggaggtctcgtagggtaatggagggtggtgttgaggataggaaggttgtgggggtggcttcagagcattgtggggagtcgggttattgtttgaacaaaattctagcatccagtggaattacgggaggagttaagacattcaggaagctgggtcttgaattttgagtcctaaaggctcagattcaaatgggaaggaggcatgtttacaatctaatttatggaaactcagattctctcatgtgagtctatggacatggttaggttggggaaggaagtggtgataccactcaccttgattattctttccacctcctggtgacagaaagaagacatgggcccctcagcaagctttatggccgggccccacccccacctccagcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctggtaaggagaggctggaaactttctaagactggccctgaccctgacccatggatgggctgacatcaatacagacagccctgggtcaaggcatactcctcacagcaggaggcagccgtcctgtctgcagcttccttccatatattccagggaagatggggtctcctcttcccgtgtttcacacccctgctggagcccacccaaattccagggctgggaaagagatggctctgggctagagtccaggccccaggcctcgcctcccctcccctccctcagccaaccccctctctctgtgtgtagccttttcgtgcctgtggtgaatctggagaagatgtccagtctcccgaagcctgatggacatggaatcagggtggccccaccctctgcttttctcagccagccagggggcctcaccaaggactcccctggaaaacctcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcgtgagtagttgtggtcttgggggtccagaatgtagagtggggactcctttgggctgctttgtccttgggctggatgaggaggaggtcaggtttatgggcctggccatcacaggttgtagggtataggagccccgtcacctcttgacctgcttgcttcctgggaagcttctctccatcctgtgtctcctgatcaaggctgagggagcccatgcccaggaggtgaagttctttctcactcttttctcacctagatccagggcgccagccagacacatctcacagctggcttctctggcctcccagatgcccatggctgcttttgtttcttgatgtgtgttgccctgctttgggcttgaagtcccaaaaggcgcacctgaaattgggatagggatggttctcacacccagcaaggagatgttgatgcccagaagtttatctggaaggtacagccccaggctgagggctggagtctcttctgccttagtaccagttctcaggcccttggcaggaagcggccaaatcctcctgtaaactcctggaaatggtcttgaggttcattggaagtgctttccccacagggaaggagtgcgacctcaacaggcagtgtggggtaataaatccagagaccaaaaagatctgtacccgcctgttgacctgcaaggtaacccccttcccactgcacggtgagggaggacagcacagggcttgcccactccttccctgggcaaagagaggaatgtcgatgttactgaaggtccagcttaagggagggcagttaggcccacccaagggaaggggagatgggtatgcccctcctgggcagaaggtgggaacagtgggaaggagggagtttccagattcccccatcccaaaggagggttttggccccatgggggaatgaaacaaagacacatgaacacagctgcaaatatgcccacctctctccctgccccccaacttgcccgggccaaagcaccctgccgtccctcaccccttctcagttcatacctactccccagctctccactctgctgtattctagatccactcagtacaccagcgccgggaagtccagggccgggccaaggactttgacgtgctggtggcagagctgaaggccaactcccgcaaaggggagtctcccaaggagaagagcccagggcgcaaggagcaagttctcgagcgcccctcccaggagctcccctcctcagtccaggttgtagcagcggtggctgctcccagcagcaccttctctgttcgtgccaagcagacctacccatactgtgcactgcccaggtacgtctagaatccaacccctacctcacctgggggtacttggcccctaagccatcaggggcccctggaaacaggctcagggagtgtcctggaagaggcactccctcagccctgagtgtgggggtattcctggggctcctgacagtggtgtggaagcaggagactcccctgtttccaaccaggcataccacagcaccccagcctctcggcagtgtgccagatccaacactcaggatatgaacattttcccagctgcctccaacagaccgaaacttgtcactggggagctgaaagggtcacactcctgggcaaggcagccctatgtgtattcactcactggccccttcgcgtgcagaggctatgccggaccccagggagagcctgacttgctgaaggagacacacatgcatctctgcctgtcacacaaggggcagacacgaaacacaggctcagctcacagacaggctcacaggaatatgtgatgcaagaagggggttgagcgagttgactgggctgaccagagctgggtacagttttaactgtgaagattttctggaggaggcggatctgcagcagattatcccctgaggaggaaggggctgggaggtgaaggggctggggagagaatcccttgggagcagtctctctgtctcttactctgtgagctgtgtcgttccctcctgtccttcccttccctctgtcctcttctgattgccctgcagggtgtctgccctggtgccctgctctttgagctcggcaggttcaaggatgcccctactctgaccccacaacagtcacattcccctggcatcccttttggcccttccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcggtaaggacctggaataggggcctatggagggggtggcccagcactcctggccaacaacatggggaggaggccagatcctgtgtgcagatgctgtctgtgcaccccagaccctgccaaccatgcaccttccttctgcctttagttctgcacctttgggagccggctggtgagcccaggatgctatgtgtttagccgccggctggaccggttctgctcagcactcagctccatgctggaacggcacctcagcacacacatgtggaagtaagtctctcggacccagaatggaagttctagaatggaaattcctaggttccagacatacttgggcttcagaagccctgatctttcctgtatacccataggtgtgccttggctatttgccagcaggaccccagatagggagtagcatgaaaaggaggtgggaaaacttggcagcctagagtttggctaaggcagggcatggaagggtggtctgggggtgaatctagactttcatccatcacttccagtaccttttgggtaactagggataggggatgcccaaaccaagatttaaaatgaagttcctagtgggctgcctcctagttagtaggtactagctaattcctctccacaggcacccctgtgtcttcttcctaaccctcagttccagcatctcccagcagatggcagcaactctggggctctgctgaccatttctaggtggggcagagagactggagtgtgtcttgtgttgggggaagctgtcttgtttcttggcagtcacagtggggctttctttttgctgcaggaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaaggtaccagccaggctccctgaagattgatgagggtggggcacacagggggtacctgatacagagaagatgctacattggtgtttgtgcagggaaagggaggaaggggaagttgagagagttcctggactgttttctttaggaagaggtaggtcagttcttagcaaagtgactccagctttttgcctggtgaaccttcccctatccctaaccctttcccttgggctgaggagatgcggcacccctccacccctgcttttgctataatcaaagggctacttctttctgaattggctgtgaccctcattccaggtactggagctacctctgttccctgaaggaaagggagtttgagtccctgggtcacagcctaacatgccgagcagcaaggtgggtgggctggtctcactggtttttcctctgggcatcagggccttgaagggcaggcacacaaccccatgtccacttatgcacatgtgcccacctccaggtgtgcaggtgacaggcaagttctccagggtttccagtaaagcctgcagccagttttatttgcctcttctggtgggagccctggtgtagtgtgctatgtgctctccatatgatctctgccaggagggacttactggaggtgggacgggggtgctctcctgggttagatgtgggcctaatcataaaccctgtgtgttctccagcttcactacccaggctgcccctggtgagctggcattcatcttcccccttgctcagttttactcaccaggccagcagaaggaaatcaagctttagcctctgtagtgcacacagttcactgggtaggacagctggtaggcccccaccctgaccctttctctcgcctcttgtcttcctgcagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaagactgtctccctgttctgttgctgctatgaaaatataaaaacagaaacatagaaaaggaaggaaaaaaaa

SEQ ID NO: 634 - DNA, 146171 bp, Homo sapiens
gagaccttgggggtgcaaatcgatgagagatgcctgtatatgatggatacccgcgggactgtcctcgtggaaagccgcatccgcgagccctaggtgctctccatttgaggaagttggctgggggagggggcttgccttgcggctgcgtcctgctccccgcgccctgcccccacctcccagcctctgctgccgctaaaccccggagagcggagcgtgcacgttgagattcctcggcgggtaggcagcggtgctgggcatgctcagtgggcaggacccgttagagtggcgagtaaggaagcgttggctcttctccgggtctgccttccccggttcaggccccggccctgggcttttgtgtgcgcgtagctgcagccgccactgcctcctcgcggggctgcccgaccccagatgccgtcaggcctgtccggtttccgccgttaacctcgccgcgcggccgggaggaggagcggggcggggccggcggcgggcggccgggctggagggccctgccgggggtgggggtgggtgcggggagccccgcggggggtggggggcgggggcgggcgcggagtcacgggggtggggtcactcgcggtggctcggggaggccagctgggaggggagggggccgtgggggcggctcggcggaaccagccccggctgggcagcagcggggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggtagggccccaggccgccggcccgcccgccgccgtcgccgcctggccccacgcccggccggccgaggtcggcggcccggccccgcggcggcggcgggcggggaagagggcgcggacgggccgccgggcgcggaccgcgtggggagggagcgagccgaggccggcctcgccgcctcccccacccgggcggcgggcatcccgcgccggcagcccggggccggccggcctcacgctctccggagttgggcgagagggagagttgccgcctcggcagcctgcgccctccctcaggaccaggctcgaggaaggaacgtgctcccggaccccagccgacttgtcgccgcctctggcttgcaggaagcgtgcggccggccgctgccacccccgggaaggacggtgtgcccggcgccgagccccgcttctccacgccgcagggcagcgaccctccgccctcttgccgagccagggaccctttcctttcctctcccgtcttccctgccctccccgctggcggtccggggagtgccctcgcccagagggagttctctcggtctgcccccgagcccccgcgcccgcagccggagaggaagtcttctcgccccgtgcctctggtgctggagaaggaggcagcgtttccccgcacctttaaggggctccgctgtcttgcagggagtgaagggtagcacttttttacgttaccagactacagacgaggtctctgcatggggagatctgtcagaggagggcctttcagggatttgtcactttgtatgttggggctggggtggaagtactgctaagctaggggcttgggggtgggggggctcccagctcttctgtcagtgtttgcattgttactgtcattcacgaaaggggcagctggatatggcatcagcacttttcccgagcagtcgccccagtcactggtcgccctacaccaggcaggtgctggaactacctaacgaattaagtttaagctttgagcgagttgagttttctgtctccactgtctaaaagcattttagacttctttatgtgaaagtgtagggactttccctttaataaagtgcttgttagaatgcctgttttctgggattattttcaggagtcacatttctggtatgttaacaaagacagttctactgtgattcctcatagtcttcagtcatttggtattggcttgtcaataactagacctaacttctcgaggtgaatcggatcatgtttccttttgcaaagaattggcttggagagtgacatggcctgtgagaaagcaaagatttggaagaaaattcatttctctgaggttgctaaactagctcattaaatacatgtaccttactgaaatacatgactcactgaagattttctgtgttagggagacacaaaagaattgtgaggattggatttgcagctatagctaacaggtagctatagttttgcattaagcaaatatgacattttatggttaaagtggcttccattcatggtcctaaagtacttcataaacatttaatcttcctcagagcctgagaatgccagttaaattattcttgttcagcttatggggaaacatgtagagaagtggttttttttttcctctctagacggagtcttgctctgtcgcccaggctggagtgcaatggctcgatcttgactcattgcaacctccgcctcctgggttcaagcgattctcctgcttcagcctcctgagtagctgagattacaggcgcgcgccaccacgcccagctaattttttgtatttttagtagagacaggtttcaccatgttggccatgctggtctctaactcccgacttcgtgatcctcccgcctgggcctcccaaagtcctgggattaccggcgtgagccactgtgccaggccagaagttcaatgttttaaactttcgttgtagtttgcattggaatgtgggcaagtgattctggaggaatttctatagattcttgaacattctttggataatcttatatgacatagcttacacttggatttggaaagacttctttggtattctaagatgaattcgttaatccagctcaaaacattctgtgattattgttatttatcaacagtgaactaaagaggactattctctgaaaaattctaagtatattcttatttccctaaattctgagtgaaatcaataatgccatttttggtaatgtgcattgtcacagagaaccttaaaattaaggccagatatgtgacaatttttgggggagtcagtgtgggactttttaaacttgagtaataattgagggtagatttaaagcaattcaattgtaaaagcttattttgtattttaaaaataaatgaagtgcaactacagataagtaaacttcgactgggtttagtaacacctgtctttaatatttgtcagtgtacctacattgataacattgacctttggaaaaattggacttgtattgtgttatttctctagcatattagtcctaaaaaagtgtgagtaataggagatggagaggtgtttgtggattgtcattctgtggttcctacagcattcaagttgcgtccgtagaattaatgtgtttaattaccgacataaataagggtgaaaacacatttgctttagttatatagctatttcagaaaaaaagtgtgtgtacatatataaatattacatatatacacacacatatatcttctttttgtttatcccttgttatatgctagatccatttatagagagtaacaaattttttcttgccctcaaggaattttcagtttatttgaagtaagtaagaacttttagggcagcaaataaatatcaagtaagttgagatgtgcttttaggactactgaggagggtagaatcattttggggtaggatttgaattatgctttgaaggaagagtatttgaacaggtttggagcagggaggaaggaacattggattgggaaaccccacacagatacagaggcaggtaaatgtaaatagttcaatttaataagaatggaaggtacacaggggcatagttcatgagcctggagtagtaggctggtcctagagtacagatgcctatgaatgctaggcatcattgggactggacttactcagttgagagtgaggaccaatggaggtttcttagtaggggactaatatgatgcaaatagcattttaggaaatttaatctcataggatgattcattctcacttctttttttttttttttttttttttgagatggaatcttgctgtgttgcccagggtggagtgcaatggcacgatcttggctcactgcagcctccacctcctgggttcaagagatccctctgcctcagcctcctgagtagctgagactgcaggcccccgccaccatgcctggctaatttttgtatttttagtagagatggggtttcaccatattggccaggctggtcttgaactcctgacctcgtgatctgcctgcctcggcctcccaaagtgctgggattacaggcgtgagccaccacacccagcccattctcacttctttatgtgtgtgcagcaggtatcagcaaactaactgtggcccatactgcaaatgtagctgcagccctttttttttttttttggtaaggtccagtagctaagaatggttgttaatatttaatgggttgtttaaaaaacaaacaaaaacatgaaatgctgtagagactgtatttgacacacaaagtctgaaatatttactctttggctcttcatagaaaaaatttgccaaaccctagccagtgtaggttagtggttgtcaaagtttgatctctggaccagcaacataatctaaatgtagtctgttttctccagatttgctaccgctttcatcccattattttaggcccttatcatcttctgtcagaataattacaactgtctccgaattggacttccttctgccagtcctatccctttaaatccatcttctgtactgctgcctgaatagtatgttggccaaatcattcctttgatcatttcctcactgatctatcttgcctcttggttaaggtctaagtcccctcataacttgccatcttcctatctctatgaccgctttcccctaccccaacccagttttggttttaccctccttaagtgacatctaatagttgttcattgtttctttaaatacatcatgctgtttcttatcactgtgctcttgcacaaactggtccctctgttgaaatattctttgttgggataattcctactcctcttttgaagactcaagtgttaacacctccaagaaacctaccctggtgctttgcctccccaatgtggtttttgatgttacctgtatatgaggtaagccaggtaccatgtcttactcatttttttgtaccctaagtactcagcataggttttgtacatagtagatgctcaataagtatttaactgaatgttaaagtgcttggcatatagtaggcgtataattagcaagtgggaagtattggtagcatatatggacagggatacaaatgtttacattctgaagagcggtggggctgatatgagactgctgccattcaagtctctgatcatggtatagatgaagcatcttggtggtaggaagggattaccaatcctgttctgccagttagggatccagggagtgtaagatttttaaagtatgacatactttaaacaagttcagctagatgaattaagtacattcacataatgagtattcaactcaagaaacacatcagtactggaattcccaccaaatgcccctctccccattccatgttccttgtattttaagaacagaaaaattttgtctgttttccaattctttatcagtggaattatatagtatgtattctttgagcttcttttttttttttttttttggtgacagagtctctctgtcacccaggctagagtgccgtggctcgatcatagctcactgcagcctcaacttcctgggctcaagcagtcttcctccttcagcctccttaagtgttgggattataggtgtgagccactgcacctggctcctttgagcttttgctcggtgttacatttgtaagattaatacatgttgtattgtactttgttcattctgttgcgtgacaattccagtttattctgttgatggacatgtgggttttttagttttgctgctgtgaacacttttatacctttttttggtcaatgtatatgtgatttttgatggatatatgccttagggtggagtgattagatcatggtctatgcaaatggtaagtttttttttttttttgaaacggggtctaactgtgttgcccaggctggagtgcagtggtgcgatctcagctcactgcaacctctgcctcccgggttcaagcagttctcctgcctcagcatcccgagtagctgggattacaggtatgcaccaccacacccggataatttttgtatttttagtagagatggggtttcaccatgttgtccaggttggtcttgaactcctgacctcaggtgatttgtgcccctccctcagcctcccaaagtactgggattacaggtgtgagccactgtgcccggccccatgtgataagttttagtagattctgctaaagttttgcaaattggttttacaaatttacactcccaccagcagtgtgtaagagctccagttgcttctcatctttgctaacacttggtattgtcagtctttttatttttagttattctggaagggtgtgtagtgatattgtagtgtagttttaattcatattttcctgatacttaatgaagttgagcattttttcttgttagggaccccatgtttattggccattggatttctgcttttgtgaagtgtctgttaaatcttttgccctttttttctactgggctgtttatttttttcatattgacttctagttcttattctggctacatttctttgttaggtacatattgcatctatcttctgcccttttagaatcttggtgtgtcagtgaattaaagcttttatttatttatttacttatttatttatttgagacagggtcttgctctgttgcccaagttggatggcaatggtgtgatcacaactcactgcagcctctaactcttgggctcaagcgatccccctgcctcagcttcctgagtaggattataggcatgtactatcatgcctggctaagttttaaaattttttgtagagatggtgtctcactcttgttgaggctggtctcaaattcctggtctcaagctattctcctgtctcagcttcctgagtagctaactacagatgtgcgccatcatccttggctaattgttaaaattttttgtagagatggtgtctcactttgttgcccaggctggtctcaaactcctggtctcaagcagtcctcctgccttggcctcccaaagtgctgggattacaggcataagctatcatgcctggccaaattcttagttttaaagaagtccagtttatcagttggttagtgcttttgttgtttcccgtttatgaaatctctacctacctgaatgtcatgaagttaccctcctgtgcttttttctaagagctttctctttttatctttcatgtttagatctatacttcatttggttgatttgagcatatgtatgctgtgtttgtgaagtagcaggacattacattaaattttttttgttgaagtaaacatatattgaaaaagtatacaaatcaagtatataccttggtggatatgcacagatttcatataccctatgtaacaagtccctgtgttaagaaatagaacatttctttgctttttttcccttggcaaatagtggttatattattgatggtacatcttataatcacggctgtcatggaattgaggaaatatccaaagtctgataatttcaaagaacattcttgaagtatttctatgatatatatcttaaatgcagttttagtttttgttttcattaattctactatgtttctaaacaattgataaaattatatcagggttctatagctggaaaactacagcttaatttttttggcatgtactgtaagtttaggagtataaaatgtttgctggaagtttgattggattaaaaaaagatagagtgtcaaaataatacatcttggtgtgtgggaaattgaaaaactgaataataaaaatatttctctttggaaagactatataataaaatttagtttcgaagtgaattattttatgttactaaatactgttttctgtatgctgatttttctttgcatcccatcctattattttaccttgcagaaaggcaagaaggaaagaacatatttaacaggcaaactgttgatatgattgcctgattatttctagttttcagtttccttgtcctttcacatgcagtttccaagtcaaaatcatctccttcactgtctccatggttcgtgtcaactgcttttgagtttttgtccatttgaaagaagatgaaaatgacaaaaactttcattaagtatatttcataggtatattacgtatgtatgtatataatccctaatcttcaaaaggaccctccaaggtaggtattatctccatttatggatgtggaaacaatgacctaagttgagtaacttgtttaaggtataacaagtaagttgaagaaccagtctgactctaaaattagagtttggtattaggggcaggaaggtatgggaaaatatgctgcccgaaacactgaacttactttatcctacttcattttccccaaactgcagtatgaatatttaactcatatatgtatattatgtatatgtgtgtattatttaactcatacatgtatattatatatatatgtatattgtggcttatataaaggatttcctcatacatatgtatgtatatatgtatatgtatatatgtatatatgtgtatgtatatatgtatatgtatatgtatatatgtacatgtatatatgtgtatgtatatatacacgtatatatgtatatgtatatatacacatatacgtatatacgtatatacatgtgtgtgtgtgtgtgtatatatatatatatatatttttttttttttttttttttttttgagacagagtctcgctgtgttgcccaggctggagggcactggcgagatctcagctcactgcaagctctgcctcctggttcaagcgattcccctgcctcagcctcccaagtagctgggtctacaggcatgtgccaccacactcggctaattttttgtattttagtagagacggggtttcaccatgttggtcaggatggtcttgatctcctgaccttgtgatccaccctccttggcctcccaaggcgctgggattgcaggtgtgagccaccacgcctggccatatatttttaattgttacaataatcttatgattaggtatagggttggtaatgcaggcaagtctttatttctaccctcaccttgccattttatagatgagaaacgaagacttggaggaggctacgtcatctgagtcatattacttgtaaatagtagagttgggttttgaacccaggacttctggctaaagcttactgttaagaagaaaaactaagacttggaggaggcttgtatgagtcgtaactggtaaactgcagagctaagatttgaacccaggacttctggctgaagcctactgttctttccatttatagctatgccagagtgagaagttgaactatttggaatcagtaaacatctttttaattgtcaagtaatatcttacattaaaaaataataaacataactaaaaacgaatgcttagtataatataaatataatacatatataattacaaaataattggtatattttaattaggctagtcctaacatttgaattggacgtaataaaatttatggcacttctgccgggtgcgatggctcaagcctgtaatcccagcactttgggaggccgaggcgggcggatcacgaggtcaggagatcgagaccatcctggctaacacggtgaaaccccgtctctactaaaaatacaaaaaaattagccggccgtgatggcgggctcctgtagtcccagctacgcgggaggctgaggcaggagaatggcatgaacccgggaggcggcgcttgcagtgagccgagattgcgccactgcactcccgcctgggtgagagagcgagactcctgtctcaaaaaaaaaaaaaaaaaaaaaaatcaaaatttatggcacttctgaagaggctttatttaatattcagcaattcaatattgaacgaatcaatttctgctatgtgaaaggcactgctgatgggactaggtgtatagcaggggatgaaacagactaaaattcctggagtttacattttaattgcggggacagatgatggataaagtaaggaaaattgggtgcatgttctcaggacctcttgagggctatgtcatggaaaaaaaaaaaatatgtggtatgctagatagaggaaagtgctatggagagtaacaaagcacagctggtgcatagggaatgtttaaaggctcaggggtccaggctgcaatattaaatagcattgaaagggaagacttcggccaggtgcggtggctcacgcttgtaatccctgcactttgggaggccgaggagggcggatcacttgaggtcaggagtttgagaccagcctggccaacatgatgaaaccctgtctttactaaaaatacaaaaaattggccgggcacggtggctcacgcctgtaatcccagcactttgggaggccgaggcgggcggatcacgaggtcaggagatcgagaccatcctggctaacacggtgaaaccccgtctctactaaaaatacaaaaaattagctgggcgtggtggcaggttcctgtagtcccagctacttgggaggctgcggcgagaagagtggagtgaacccaggaggcggagcttgcagtgagctgagatcgcaccactgcactccagtctgggcaacaagagtgaaactccgtctcaaaaaaaaaaaaataagtaaaaaggaagacttcactgagatgtcatttgagtaaagacttgagctgggtgctgtggctcaggtctgtgatcccagcactttgggaggctgagatgggaggattgcttgaacccaggagttggagaccagcctggacaaaaaagtgagaccatcatctctacaaaaaataaaaaaattagctggatgtagtgatgtgctgatgtgtgcttgtggtcccagctacacaggaggctgaggcaggaggattgcctgagtccaggaggctgcagtgaaccatgtttcaccactacgctccagcctgggcgacagattgaggatttgtccaaaaaaaaaaaaaaaaaaaatgcctgatgcaggtgaaagaacaagccttgtattgtacattatctggggatagatgattttaggcagagggtacagcaaattcaaaggttctgaggctagagcaggcctggaatatttgaggaacacccagtaagcaaggtcattgcagctgaaatgaagtgaactggaacagagtagtatcatatgagttaagaggtggctggagactttttgagacagggtcttgctctgttgcccaggctagagtgcagtggtgcaatcatagctcattgaaaccttaacctcccgtgctcaagcgatcttgccacctcaatctcctgagtagctgggactacaggcaggcaccagcgtgcctggcaaatttttgtatttttggtagagatgggggggcgggtctcactatattgctcaggctggtcttaaacttgtggactgaagcaatcttcctatctcagcctcccagagtgctgggattacaggtatgagccactgtgcctagtctagaaaggacttttacttgagtcagatggtcattggaaggttttgggcagttgatggcatgatctaatgtagatttaatataattacttggctgctgtgatgagagtagttgaaggttggggagtggtgaaagcagtggcaagggcagaaccagggagaccagttaggaggaaaggagtaatccaactgtgagatgatagtggcttgaaatgagtagtaacagtggagatggtgagaagtgattggttgttgaatatattttgaagatagagctgagaggatttgctgacatacttgaagtatggagtgcgaaagaaagaaaggagtcatggttatctcttaaggtttatccctgagcattagcagtgatggagttgctattatactgagatagggaagatctaagaggaacaagtttggcgggggaaggttaggagctcaattttgttattttaagtttgagatgttcactgtacagtcaagtgtatgtatgagtctggagtttagggaagtggtctagactggagatttaaaagtggagattagcatcatatagatgattttttcttttttttttttttgagacggagtctcacattgtctcctgggctggagtgcaatggcatgatctctactcactgcaatgtccgcctcctgggttcaagtgattctcctgtctcagcctcccgagtagctgggattacaggcgcccaccaccatgcccagctgaatttttgtatttttggtagagatggggtttctctatgttggccaggttggtctcgaactcctgacctcatgatctgcccaccttgtcctcccaaagtgctgggattataggcgtgagccactgtgcccagccataaatgatttttaaagccaggtatctggatgaaattaccatgggaatgagaatagttagacaaaagaggttcagtgaccaagccttagaacattccaacatgaagaggttggggggatgagggagatcctataaggaatacagattaagcatctcatgaggaggagaatgagatgtcctgggaaccaagtaaagaaaatacttcaggccaggcttggtggctcatgcctgtaatcccagcactttgggaggccgaggtgggaggactgcttgagctcaggagttcaagaccagcaacttagtgagacccccgtctctacaaaaaataacaaaaattagccaggtgtggttggcacatgcctatctatagtcccatatactgtggaggctgaagtgggaggattgcttgtgcctgggaggttgaggctgcagtgagctgtgattatgccactgcactacttcagcttgagtgaccgagtgagattctgtctcaaaaaaaagctttaagttgaagacatctcagcataatttatgtagatttgcctgggcatttttctgtgaaacacatatgtgtaagtctggtctaagccattctcgtcttagccatttcctgtgttactgggagagcttcctactggttgcccagtttccattctgttctttacacagaggcaaagaaatctttttgaaaatgtagattcgataatatccttttcttaatctcccctcccccaattacataaccacattccaacttcttaccacaacttacaaggtcttacatactatgacctctgcttaactttctcattttatctaccatttttcctttcaccacattattccagccattctgggctccttgctgttccccaagtatgtcaagcttattcctgctttaggactttttcagatacttcataagattgactaattctgactgatggtcaaggaaaggaaatttgtattgattgcctgattttgttagtcacaggaggagagaaaggaagagatgttgaaaatggttcaacatctgtaaggaatacagattaagcattaagtttgagaccagcctggccaacatggtgaaaccccatctctactaaaaatataaaaattagctgggtgtggtggtttgtttctctgtatatagtgtgtctttctgaatatagtgcgtatattctctgagtatttgtttctctgaatatagtgtgtcttttcttcaggttgcttgacgatttcttattacattttactgctgttatcatgtacctttgaatagttttgagtttatcctgtttggggcttactatgattcttggatgtctgagttatagttttcagaaaatttggaagttttttgtctttattattacctcaagtatttttttcattgaggtccctgacctcaatgtgttctgggagacagtagtctctggagatgccttttgcagaaagggtttatggtcaaataagtttaggaactattacatctgtttttctcccttgagccctgacagctcacagtagacttgtggtgcattacaagatctgtcttggcgagtgttctatgttcagtcttggtgagtgttccatgttcttttgaaagtaatatgcgttctctgctgggcatagtagttcatgcctgtaatcctagcaattcgggagtctgaggcaggatgattgcttgagcccaggagttcgaggctgcattgagctatgattacacgaccacactccagcatgggtgacagagcacgaccttgactcctaaagagtatgtatgttttctgtagttatggggtggaatgctctataaatgttaattagattaagttggattattgtattggaatcttctgtattcctattgattttcttttcactatttctatgaattcttaagagcagtgttgaaatttccatctatagatggggatttgtcttattttttcttttagtttcctttttttttgagatagggtgtcactctgttgcccaggctggagtgcagtggcacgatctcagctcactacaacctccgcctgccaggttcaagtgattctcctgccttagcctccctcagctgggactacgggtgtgcaccaccacacccagctaatttttgtttttagtagagatggggtttcaccatgttgtccaggtttgtctcgaacttctgacctcaagtgatccgcccgccttggcctctcaaagtgctgggattacaggtgtgagccaccgtgccatgcctcttttagttttcttgattcattgtttctttctctctctctctctttctctctctctccccctctgtctctctctctccctctcctctccctctctctcccttcctccctccgaaagtgctaggattataggcatgagccaccatgcctggctgttttatgtatttttgattttatattatttggtgtgcatattgggatatatgttttcttgatgaattcactctatcgttacgcccttctttattgaaaggtagtttggtaggtattaagtttttggtgtgttgtagcactttataaattttgtattgtattttggcttagcatagcttctggaagtctatgatttttttatatttgtttctctgaatatagtgtgtcttttcttcaggtcgcttgacaatttcttacttattaccattttcctgctgttatcatgtacctttgaatagttttgaatttatcccttggggcttactgtgattcttagatgcctgggttatagttttcagaaaatttggaaatttttcatctttattattacctccttgaggattttttttttctctttttgtatttctgacactccagtcacatatatcttgcatagcttaatattctcccacagttcactgagaatgttccccccctttttttctgtttccttttgtataatttattttgctttgttctcaagttcagtgatcttctgcagtatctaattttgcttttaattccatgaatgaaacttttatatcaaatattataattttcatctctatattccatttgattgtcttattttctttttttgagatagaatctcactctattgcccaggctggagtgcagtggtgcaatcttggctcactgcaacctccacctcccaggttcaagcgatgtgcctgcctcagcctctcccgagtagctgggattacaggtgcccaccacctcacccggctaatttttgtatttttagtagagatgaggtttcaccatattggccaggctggtcctgaactcctgacctcaagtgattcacccgcctcggcctcccaaagtgctgggattacaggtgtgagccaccgtccctggccaattctcttattttcatatattcatgtcatttagatttttgggcatattgaatatttctacaatagctgtttttttaatctataatttctgggtctgggtatagtgaattatttttcttcctgtttattggtcatgtttgcctgcctgccttcctccctccctccctctctccctccctcccttcctcccttcctctctccctcttttcctccctccctcccttgctctacctccacccccaccgcaaggcacgagtgccttggcacaatcacagctcactgcagcctcgacctccagggctcaattgatcctcctgcctcagccttctgagtagctgggactacaggtgtgcaccaccatgcccggctaatttttgtatttttggtagagacaggtttttgccatgttgtccagtctggtttccaactcctgggctcaagtgatccgcctgccttggcctcccaaaggctgggattataggcatgagccactgtgcctggccgtatgtctattattattattattattattttttttttagacaaagtctggctctgtcacccaggttggagtgcagtggtgcaatctcggctcactgcaacctccacctcccaggttcaagtgatgtcttgtgcctcagcctcctgagtagccgggactgcagacacgcaccaccacgcctggctaatttttgtatttttagtagagatggggtttcaccatgttggccaggttggtcttgaactcccaacctcaggtgatcagcccacctccgtcttccaaagtgctgggattacaggtgtgagccaccacgcccgacctctctattaatttttattggatgccagacattgtgacttttatctcgagtatgatatttgtggtattcatttaagaagtattgaggtggccgggtgtggtggctgatgcctgtaattccagtactttgggagggcgaggtgggcagatcacctgaggttgggagttcgagaccagcctggccaacatggtgaaaccctgtcttgactaaaaatacaaaaattagccaggcgtggtggtgcacgcctgtaatcccagctgctcggggggctgaggcagaagaatcacttgaacctgggaggcagaggttgcagtgagccgagatcatgtcactgcactcaagcctgggcgacagagcaagactctgtctcaaaaaaaaaaaaaaaaaaaaaaaaaaaaagaaagtattgatgatatttctgtatttctggcagacagcaacagcattacttatggatcatttttatagttttctgacttgttttacaattttttaggataaaaaataggatagtttggccttggtggagttctatcattaaagctttactcttttggggcctgttctaaatctgccatataatcagtgaggtatctccactcagactggtgatagctccaatgattttggcccactgagttctagaaattgttctttccccagaagagtttctttggctttgtggagttttaccctgtgcgtgggcaggttgtggtattaaaccaaaaacctgagtgaacccctttgcagatttccagagttctttgttgtttagcttcctcttctccagaattctgatccggaaattctagccacctagccttctcaaacttcagtatggcaaattttagtgatcccacccaggtctgtgctcctcttcactgggcagtagtttataagttgtcttctggcagaattctgggtcatttaaaatctcattttgtttatttccttttccacagtcctgttgcccatgtagtctaatgtctgaaaaaataatgcaatgcatatttatatgttttgtctagtttttgtagttgtatatggatgtaggttgtttggacctgttacttcctcatgagtggaaatataattcatgccactatagttttaatgtgtatttttcttagtatgagtgaggttgagcatgttttcatatctttctttcttttttttgagacagggtcttactgtgttgcccaggctggaatgcggtggcacagtcatagctcgctgcagtctcaaattccttggctccagtgatcctcgtgcatctgcctcctgaatagctgggactagaggcatgtgccactatttgtagaaaaatcgaccctttttttcctgtgacattagttggaagcatttttttcccagtatcccatttgacttttgattttctgatgattttttttccatagttttcaaatatgtattttagttaattgtttcttccaattgcttatatttattatctttagtgttttttggacatatctgggtgttccccatttaattctctataaatgctccttattattttattaattcattttttttttaaatttgagacggagtctcactctgtcacccaggctggagtgcagtggcacgatctcggctcactgcaccctccatctcctgggttcgagtgattctcctgcctcagtctcccgagtagctgggattataggctcccgccaccacacccagctagtttttgtatttttggtagagatggggttttgccatgttggccaggctggtctcgaactcctgaactcaggtgatccacccacctcggcctcccaaagtgctgggattagaggtgtgaaccactgtgccccgcccattaattcacttttgacatttcagtcttttatccatttggaatgtattgtgatatgagatttgagatatgaacccacttttgtttattgccatgacacctcttatctctgtaaaggatcagatagtgaatattttaggctttgtgggccatatgatctgtgcctttgcagctagtcaactctgcccttgtattgtgaaagcagctatagttaatatgtaagtgaataactggctgtgcttcaataaaacttgatctataaaaaaatggtggtgaagcagatttggcctcccaattgtttcctcagccctgacctaggcttaagaattctgttggaaattatggagagcgactaatccatgtggaaagaaatatgcctttttatgttgactattaggaaaagtgacagaaataatttaagaatttttgttaagctgatattcttataaaatttggaaacttctcacaatttcagaatattcctctgagatgcaagcgaaggttgagctacttgtgactgaaggctcaagcaaaagacaacttttaagtataagggagttaataaaataactgctgattttacctggctattttcttattaattacttaataatattttgttttttctatagatgatggattcatttataggtttaaaaaaacatttccctcctgtgtcttagaaatcagattgaccagtgcttactcttctagtatgagcgtttagttgctgacagcactgttttgcctcagagccaataaaaagagtaagattttttgtttttctgagatcagagcaacttagaaattggaaatgtttgaattatggcttaatattggcttagaattattttacacttaattaaattaaattttaaattaaaaacttttgtatacattcctgtgtgtgttgtgttttttttttttttttgagtcggagttttgctcttgttgcccaggctggggtacaatggggcgatcttggctcactgcaacctccacctcccaggttcaagcgattctcctgccttagtctcccaagtagctgggattacaggcatgtgccaccacacccagctaattttgtatttttagtagagacggggtttctccgtgttggtcatgctggtctcgacctccagacctcagatgatcctcccacctcggctcccaaagtgctgggattacaggggtgagccaccgcgcccggcccattcctgtgttttaaaagtcaaaaatattgagaagtctcattcctgcattgtccttgtgtattccatgttccccttcccttataggtggttgcttttatcaatttcttatgtgtctgtctatccagtgattgtttatgcatatataaacacacgtgactataagtcatcattttctctttttcagcaagagctagcttgtatagttattttatatttggcctttttgtagttaacaaatttgatagttgaagatcttttcatattataacatagtcattattttgcttttgataccccccttttttgggtggctccttattctggtttttcagaggaagatatgacacattcattaaggtgattcaatatagtgcatatctaaataatatatcatttgttctcttgctagtctcagcgaaatgtcatttgctcttgtgttagtctcttgtcagtctcagaatctctttatagccttcaaaattattgatagccctaaagagtttttatttatgtgggttatgtatatcactagatatcaaatcagaaactaaaactgagaagctataaaagttacttacttttggctaggcgtggtcgctcatacctgtaatcctagcactttgggagctgagtgggcagatcacttgagctcaccagttcaagaccagcctgggcaacatggcgaaatttgtctctaccaaaaaaaaaaaaaaaaaagaaaaaaaatttagatggcttgagcctggtaggcagagtttgtagtgagctgagatcatgccactgcactcgagcctgggtgacagagccagaccttgtctcaaaaaaagaaaaaaccaaaaacaccccagacaccaaaaaccagccaaccaaccaaagttatttactgttaatttatttaaaaatagcaataataaacccattacatgctaacataaatgacatttttaatgaaaataactatctttcggaacaagaagagtatgagaagagtggcatttgttatagttttgcaaatatctttaatgtctagcttaatagaaaatagctggattctcatatctgctactgcattcagtgttgtgatatgttgttttgcttgaagcatatggagaaaatctggcctcacccagatgtaaatttggaagagggaggagtattttatttaattttttgagacaaagtcttgctctgtcgtccatgctggagtgcagtggcatgctcatggctcattgcaaccttgacctcctgggctcaagcgatccttcctactcactttcctagtagctgggactataggtgtataccaccatgcccggttaatttctgtattttttgtagagacagggtttcaccatgttgcccaagctggtcttgatctcctgggtacaagtgatcttgtctacttcggcctcccaaattgctgggattacaggtgtgagccaccacacccggccaaaattatttaatagactttccagatacttatggatagccatatttaacgctatactgaaactctacatgcggtagttccttttttaaaaaaaatcattttattgagatatagttgataagttacatatatttaatatatctatgaaagtcaacacaatcaagatgtaccttttgaaggtaatttcttaaagattaattgcagtgtagaatttgaaaccatctcagtaaagttttcatattgtgttttcattaagatctatgaatctagttggtttatcctccactttggttgtatcttttttccttgcaggaattttcaaacatcatgcattagtcagttggaaaatatttgtttattgagttacgcagatcttctaaatgtttacacatttcattatttgttgtcaaagaatcacacctgttaatatcgtcaccattctctttagaaaagtgtttttgacttgggaagttgttaagcccatagtggtagaaactatgttttgcaaaattcgaattttttcgaagcttaaatattgttggttactttccctgatgtgacaagcccactagtcattttctttctttctttctttttttttttttttgagacagagttttgctcttgttgcccaggctggagtgcaatggcgcgatcttggctcaccgcagcctttggctcggctcaccgcaacctctgcctcctgggttcaagcgattcccctgcctcagcctcctgagtagctgggattccaggcacataccaccatgcctggctaattttgtatttttggtagagacggggtttctccatgttggtcaggctggtctcaaactcccgaactcaggtgatctgcctgccttggcctctcaaagtgctgggattacaggcgtgagccaccatgcctggctgcccactattcattttcaaggaaataactttcagatacccaagagtaagtaactagttgttctttcaagagaaatggtggtctataaaaaagcacagttcagcttgcaactctcataagatgctttttcttgagacagccatctttctacccatttaagtgcacagaatattaagaagttgtatacttaagggcaaagatttaatgtgtaatatttgcagctatatcaaggacattcttaagtgaaactggctttaaaaaatttggtgagtgtttggtaatgaagaatgtagtgactactactgtagttcggtgctactgctaatgagacaacagcagttttatccaatgttactttttaaattttttttatttttttcgagacagagtcttgctttgtcgcccaggctggagtgcagtgccccatcttggctcactgcaacctctgcctcctgggttcaagggattctcccgcctcagcctcctgagtagctgggattacaggcgtgtgccaccacgcccagctaatttctgtattttcagtagagacggggttttaccatgttggcgagggtggtctcaaactcctgacctcaagtgatccgcctgcctcagcctcccgaagtgctgggattacaggcgtgagctaccatgcctggcccaatgttacttttgaaccttcagggaaaatcccaatacagtgaaagaaacaaataatattttagtattattctcaaagtggttttggtctggaggaccttctgaaaggtcctgcagacttctggtatgtagaaatccttacttctttcttggcagttgaaaaagaaaaaaagaaaccaagaactcttaccaacttaatcttggttatcaatcttaatctctctgtacatactgactcctccaagtccttcctactaacactctgcgcatactccttccattaattacagtggctcattttggcatgattctcaagaatcatgaagtaatttataaattacaggtgattttatttttcgtccttcacctcaaagtatggtgaaggatgattggaaacctactgaattagaattactgctagctgggaccctatctgctttttttaccatacactaaggtggttttaatatatagcagttagaaaactacagctttgaggccttaggaagaaaactagattgctcagaatagaggatgatatcatcattatcatttttgtatttattgctcaaagtggaaggtgacatcaccactataatctttgtattttcaacacccagagctatctggcacagggcaggagctggccaaatgcttcatgaatgattgaatgactaatatgactagattataatgttatttgtctgacaccaggtttccaaattgaatgatgacaaatttagccttacattgtgtattaaataatatttacaagtgtatgttttagaattttgaaaaatgtaaattggttaatatgactgtactagttaaaatcattaatgattttttaattgtacgtaagcttcttatttcagcccacatgatatggcctatgcctacctatccttcctagtcttttgtcattctccttgtttgttgtgttttaggattaacaaaacatttgttggtccaggcaaggtggctcacacctgtaataccagcagtgtggggggctgaggtgggaggattgaggccaggcctttgagaccagccaggacaacatagcgagaccccttttctagaaaaagtaaaaaattagccaggcattattgtacacacttgtagtcccagttgctggggaggctgaggtgggaggattacatgagcccagtaagtcaaggctgcagtcagctttgatcctgtcagtgctctctaacctgggtggcagagtgagaacacatctcaaacaaaaacagaaaacttcggccattgttttctccctaattgttgcaacatgctacactctttactttagggcccttgcatttgctgttctctcttccgagacattgctttccccagctcttttcttgacttttcttatccttcaaataacaatttagttgtcgcgtacttaaaggtgcctttcctgtttttttggaagtagtctgttttcctctactgcacatagaatagcagtgaagtaaatatttctgtttgtttcttttatagtgtttatcacaatttgaagttacttaagttgttacttactgtctgcctgtctcctttagaatatatgctccatgagaatgtagacctgcctgtcttgtttactgttctatcttcataatcagaaacagtcctggtacttaataggtattttgcaaaacttattaatatgtttataaataggtgaatgaatgagtgaaaaggatatatgaaagaaaattattttggttacacaataaataatgagtgaaggtaacagttatattattattattatttttttttgagacagtgtctcacactttcgctcaggctgcagtgcagtggcgcaacctcggctcactgcaagctccgccttccgggttcatgccattctcctgtctcagcctcccgactggctgggactacaagcccccgccaccacgcctggttaatttttttgtttgtattctgtctcagcctcccgactggctgggactacaggcccctgccaccacgcccggctaatttttttgtttgtatttttagtagagacggggtttcaccgtgttagccaggatggtctcgaccacctgacctcgtgatctgcctgcctcggcctcccaaagtgctgggattacagacgtgagccaccgcggctggccaacagttatatttaaatttaaaaacaataggcagtagtgagaagggaagaaagaatagaacagggagttccatctgtaactgactgtgaataatctattgagataactcacagacaagctatataagtatatatatttatatacttaatagagttgggatcttgccatgttgatcaggctggtcttgaactcctggcctcaagcagtcctcccatcttggcctcccaaagtgttgggattacaggtctgaaccactgtgcctggctgccaagccagctatatttattagtaaagattttgcataaataactttgttctgctagattattaagttaaacattacatgcatatgaggacttctggtgtataaaattgcttgtggaatatgacattttctattaataaatgagtaaatgtgattctaaacaattgttaaaagccatgtaaaggagagcaacactaattcttggtggaaaataagtatgtaggctgggtgtggtgtctcacgcctgtaatcccagcactttgggaggcccaggtggctggatcacttgaggtcaggagttcacgaccaacttggccaacatggtgaaaccctgtctgtactaaaaatacaaaaattagctgggcatggtggcgctcgcctgtaatcccagctactctggaggctgaggcaggagaaccacttgaacccaggaggtggaggttgcaatgagccaagattgcaccactgcactccagcctggtgacagagcgagactccatctcgataaataaataagtaaatgtgtaaatgaataagattaaaatccttgctgtttataattttctaagaatcattttgttatttattttaggtaaacactttcagcgtttatagattttattttagggacttgggaatacatatctcttattttcttaaaaaaccagtggggaccatgttttactgtgttgtaaaatagtgacactgtcaggatttagtgaggaatttggtgatatttgcctgctctttaaatgacctcagatttctgtactattcatgtttattattattttaatgaccttttagtttggaaagattttagatttactgaaaagttataaagatagtacagaatttctgtatattcctcaccgattttcccctactgttaacatcttacagtaacatcttactcttacatggtacatttattaaaactaaaaatagtagttggtcagtacaattaactccagattttatttgatttcaccagtttttacactaatgtcctttctttccttttttgctttttttttggtttgagacggagtctcgctctgtcgcccaggctggagtgcagcggcacaatcttggctcaccgcaagctctgtctcccgggttcacaccattctcctgcctcagcctcccgactggctgggactacaggtgcccgccaccacgcctcgctaatttttttgtttgtgtttttagtagagacggggtttcaccgtgttagccaggatggctcttgacctcgttatcgcccgccttggcctcccaaagtgctgagattacaggtgtgagccactgcgcacagcccactaatgtcctttctctgttctaggatcttatccaggttaccacatcgtgtttagtgagcctgtctttagtcttctctgatctgtgacaaattgttaatttttctttgtttttcatgaccaagacagttttgagacactgtcaggcattttgtgaaatgttccttcatttggatttgtctgatttttcctccccacccctcttaattagattggagttacgggttttggggatgaataccacagaggtataatgacctcatcatatattggggttacattaaattaatgttggtgaggttaactttgatcgtttggttaaggtagtaagtgtttgccaggtttgtctgttgtaaagttgctatcttccttttgccgtattctgttctttggatgtgagtcgctgaagtccaacccacactttggatgaggaaatatttgcatacattacttgagttcttctctaaggaagatttgtctctgcccctcccccactcaacttatttatatccgtatggactcatgtatatttattttgtactttggaaggtaatccaatcccacactattttgttgctcagaatttttcagccttagctattgggattatttttaggttggtacctgaatccttttggcatgttccattctttggacttttaagcactctcttgctttcttcaagatgcttcaagctcatcttatattttcctgccctgtgggtagaatgttctatttctccaaggagccttgctttcttttattgggaaatgatatttagaaacaaagatttggggccgggcgcggtggctcacgcctgtaatcccagcactttgggtggctgaggcaggcggatcacctgcggtcaggagttcaagaccagcctgaccaacatggagaaaccgtgtctctactaaaaatacaaaattagccgggtatggtggtgcatgcctgtaatcccagctactcaggaggctgaggcaggagaaccgcttgaacccggaaggcggatgtcgcagtgagccgagattgtgccaccctcactctggcctgggcaacaagagcgaaactctgtctcaaaaacaaaaaaaacaaaaaactaagatttgggcattgaatgtgttaatggctactgggtatcactgcttctaagtcctgtcaggggacagagacaggaaatatatttatttatagtagcatatgtacacacatatctctttctgtatctatccatttttatgtatattaagatttaaaaaaattttttttaggcagagtcttgctctgttgcccaggctggagtgcaatggcacgatcttggctcactacaacctctgcctcctgggttcaagcgattctcctgcctcagcctctcgagtagctgggactacaggcgcccatcaccacacccagctaatttttgtgggtttgtattttttttttttcttttttagtagagatggggtttcaccgtgctggcgaggctggtcttgaactcctggcatcaagtgatccacccacctcggcctcccaaagtgctgggattacaggcgtgagccactgcacctggcctatgtatattaaacttaacatgagtttgtactcatttctccaactctaatccagtaccacagggcttgttttactgttttccctgtacttatctgtaacttctctcctcaacattgagaaacctggctcccacccaccatctaccattcattttacctatttgttcaatgccagtatacatgaaaagcaggtgtagaactgttaacctatacctctgtttgaaacaaatttaccagctagagtataagtttttatacagcttttgtgcctttagcgttacaatttctaatcaaagcatcatttcccaaagttaagtaactttgggaagttcctgaacttcatacgtatctttttttttttttttttttgagacggagtcttgccctgttgcccaggctggagtgcagtggcgcgatcttgctcactgcaacctctgcctcctgggttcaaacgattctcctgccccagcctcccgagtagctgggattacaggcgttcacctccatgcccagctaatttttgcatttttagtagagacgggctttcaccacgttggtcaggctggtctcaaacttctgacctcgtgatctgcccgcctcggcctcccaaagtgctgggattacaggcatgagccaccgcgtctggccttttttttttttcgaagacagagtcttcctctgtcaccaggctgcagtgcagtggcatgatcttggctcactgtaacctccgcctcctgggttcaagcgattctcctgactcagcctcccgagtagctgggattacaggcacccaccaccaagcccagctaatttttgtatttttagtagagatggggtttcaccatgttggccaggatggtctcaatctcctgacctcatgatccacccaccttggtctctcaaagtgttgggattacaggcatgagccaccgcgcccggccagttgtatcttgtatttgtaatactgttagattcatttgtcaccatctacatttcatcctaggatatcctgacgtattggtaaatttttttgtttggttaacttgcatacattaaagttcattatttatgatttcagttatatgggtctgacaaatgcataaaagtctatttctttgaaaaaaatgtgtgtatgtatagataatttcttttaggtgtcattatgcctgtttgtagcagtctgttgctttccccctggttgttggttttcaaacaagatcctgtggttgggtgtttggaaaataaatttattggaattgagtgaagttaagtcttgaatttttgggaactttcttgggagtaaaatacatgagtttcccttgtattaactaaaatgttgattttgttaaggcaaataaatgcttttctcccttggttcttgtttgtggtttcatttgaagtttgaatataggattaataaatatcacaatgttttagaaaaattaggccaaatgtggcaaggaagaacatttgtttggtgattatttttaacatttggatacatggctttcatgccacaagtcagataatatattgtttaggttttaaggcagagagataggtttaagttaccttaagtagtggagatttattatgggaaggtaaatgacataaaagtcccaactgctgcataacaaggtgtcaggaagacagagagtggttgaggaaatgggcagtcattgaggaaaccagggagctctaactactttactctaactactcctgctgtggttctcaactagaggctgtagtaagaactgtctgtggggccctccttcagatctgttcagtcagtcagtcttctttagtaatggggattgtctgttttcttctaaaactctgtatatgattctgataaacacttcttctctactattttgacattaggttattcaaggtcagtttcttctgaattggtgtacgattgactatttaaactgtgtgagggagatgggaaagagttggacactgattagtttatctagtcaccacgtttaatttgtatagaactcttgctgctgagactaccgtattggctgctggctcttcctgatttagtcatctgttgctagatggaagggtcctgtgatattatgccttatattaccatgcttggtactacttgcctctgcatttggctgtggtcaacaagtaatgcagaagtgactagaagttactatagatatgggtttagaggtggcttttctgtgcaggtagaagttaaattgaaatcccaaacgccgtgacgttctcagtgggagagttttccttttagagggaatgtatggctgaaatacagtgaaaaatgttggagaaggaggctaaaactgtatcctatatcatcttatataggattggtaaaatagtttgtgttttattctaattatgataggaagccatgtgaaatgacagagttcaagtaatttgactcatgcatttaaaaatgttataatggagcaatcattgaatgaagaacaatgacttaaaaataaaaaaaatctaaaaattatatatttatttttatagacagggtctcattctgtcacctagttgctgcagtgcagtggtgtgatcgtagctcattgcagcctccaactcctgggttcaagcagtcctcctgtcttggccttccaagtagctgggaatgcaggtgtttgtcaccacgcccagctaattttaaaattttctgtagagttgggggtcttgctttattgtccaggctggtctccagctcatggcttcaagcaatccgcctgcctcatcccctcaaagtattgggattacagttgtgagtcaccatgcctggcaaaatattttaaaatttccttgctaatgtaactttggcatcaatataatttagtcattagtttccgttctttttaaatttaaaagtactgtttttagataactgagttaagacagtttttttctttcttttttttttttttaaattaagacagtttctgatttggacttggatatagtctatctatagtttgtccattatctgttatattaataaatggctagtttctacatatcagtcaataattatttactaattacatagtaacatttcacagggagttgaagtagaaaataagtacaaacgagcccctgctacagttcagaggagccaacactagaagttagcaatatctatctttaaattgtgatttttctgacaatcatcaactaaagcaatggcatggcattccagtaccatggtgtttttagcttgctttttgttttttaaaattcagactcacagttttttaatactttattttttatttttaaaaaattgggattaaaattacataacatttgccttattaaccatttttaaatgtatagttcaaggcattaagtacattgacattgtgctgtcaccactgctgtttatccatagcagattcacaaattttgatgattttctgaaaaacaggaattaaatatattttacttaatatatgtaattattaataagtgtgaaacctcatgtaaagatcagtttagtattagttaacttttagagacagcaaagaaaaataaaatgaacattagggatagctcttgcattaaatgttaggattcctatatgtgattattgttaatattttaatatcaagttatatagttaggcattgtgtccccacccaaatcttatcttgaattgtaatccccaggcgttgagggagagacctggtgggaggtgattggatcatgggtctggtttcctctctgctgttctcatcgtagtgagggatttctcacgagatctgatggttttataaatggcagtctcttctgggcttttctcttctctctcctgatgccatgtgaagaaggtccttgcttccccctcaccttctgccacctccccagccatgtggacctgtgagtcaattaaacctgttttctttataaattacccagtcttgagtggtatctttatagcagtgtgaaatacatcaagacttttttttggggggggatggataatcatttcatagaatggtaaaatctgggaaaatgtgattccataggcaaagtattgccttatgaaaaaaattttgagacatacctaatgtgtaaagatggccataatagaagtaaattattagatgttgcttgggaaaatatatttcaaaagaaaaaagatactgaataacaaggagacaaattaatggtatccagtgtttggggctttgctcaaaatgagaatatgcattttaggccaggcacggtggcttaagcctgcagccccagcactttggaaggccaaggtgagaggatcacttgaggccgggtatgggcaacacagcaagaccccatctctaccaaatattaaaaaactagccggtcatggtggcgtgtgcctgtagtcctagctactcgggaagccgaggtgggaggattgtgtaagctcagtgagctatgatgatcatgccactgcactccagcatgagtttctggattctctttaataattatagccaacattttttgaacctttactatatgccaggcatttgcacttgcatttctcttttattttattttttttgagacagagtcttgctgtcttgctcagggtggagtgcaatgacctgatctcgggctcattgcaacctcctcctcctgggttcaagtgattctcctgccatagccttctgagtagctgggattacaggtgcccaccaccacgcccagctaatttttgtatttttagtagagatggagtttgaccatgttggccaggctgatctcgaactcctgacctcaaatgatcctcccgccttgacttaccacagtgctgggattacaggtgtgagccaccgtgcctggctgcatttctcttttaatacagcggtcatatgaagaaactgaaccttgggttgttcaaagtcatgtagttggtgctggtttttcaaccagctgactctgcagttggagctcttaatcaccatgtcatattgtttgttttaataaagcataagttttaataaagcaatatcctagattattaaccatgtatgtttacttgaatataaaatattagaaaataatttaactcatactacatattttattttgtgaagtttcatagtgtaaaataaaagtaagggtatgctgggcatggtggctcatgcctgtaatcccatcattttgggaggctgaatcatttgaggtcaagagtttgagaccagcctggccaacatggtgaaatcccacctctaacaaaaaatgcagaaattagccaggcgtggtggtggcggtggcagtggtggcgcacacctgtagtcccagctacttgggaggctgaggcaggagaatcgcttgtacctaggaggcagaggttgtggtgagctgagatcgtgccactgtactccagcctgggtgacagagtgagaacctctctcaaaataaataaataaattaaataagtaaataaattaattaaaagcaagataattttaagaaaattctctaatgtgtaaaattaaagatgttgttttcctgcggtcatcattgtgacttaaggttaaagattttagccatgcatgttgcttaaactatacagtgcacatgattgaatgttactcttgtaaataatatttttcaagcatgagaagtcctaaaccttcagtggctccccattgactgtctgtctacacagaaaatgagcaaactgcttaacctaggttttaaaggggtcagctattctagctttccctttctcaactatgcaggtttttgtttcatgaactgaatttgtcatatccacttctatgcttttgttcatggcttctttctgtttgaaataccctgccgtcttctgcttctctatttctgctttctagtttatccctttttcttcccaacattttccttcttctgaactctaaatcctttattaggtgctgtatatatcctaccttgttttatttagttgtttacccaactagataggtcttttgatggaaacggctgttgctggtgcttttttgtagttagtgtcatatacacaaagatctcaataattgcttgctggtaaagaggataagccatatatgcagtctcagtaatgttgcttaattaacattttcattttgttcatcctgtctcataaatctcgtttataatctgaaaatatatactcttgcttgaaatattttggtgtttaatttcatcaggaaatgaaagactctctaaaagaaaaaaagctatatttgtattgattagcaaaaatagcaaaaaaattatgatcatagtaatatgtgaatttttagaaatgaatattctcttgacagttgagatatttaattatccttactttatattggttctgaaaatatattctttcttttttttttttgagacagtcttgctctgtcacccagactggagtccagtggtgtgatttcagctcactgcaacctctgcctcccaggttcaagtgattttcatgcctcagcctcctgagtagctgggattacaggcatgtgccaccatgcctggctaatttttgtattttttgtagagatggagtttcaccctgttggcctgcctggtttcgaactcctggcttcaagtcatctgccctcctcagccttccaaagtgctgggattacaggtgtgagccaccatgcctggctgaaaatatattctttatagttctgaattatactttctaagtttggaatgtacatggagaaagcatttaagtttagcttttttgtgctgttagtgtttttctacttccaactctatttaaaaattttaaactgtgagaatttgcttccccatttgatactttatcttttcctcatccattgttcagttgtggagtactaatctcaggggaaacatttattaaaagtaattgcaattaaattagctgggtatggtggtgcacatctggaatcccagctactcgggaggctgaggcagaagaatcacttgaatctgggagaggttacggtgagctgagattgtgccactgtattccagcctgggtgacagagtcagaatgtctcaaaaaagcaaagaaaagaaaaaggaaatttactatattaagagtcttagttggaattaaaatttcatattcataatttatgggccacttgaagagaaagtgatttgtatgtacagtccaactctggacattgtgggttcttttttaattgtctctatatttttaatatatgagtgtattttttagtaatttttaggaatgtgacttgttagcactaatgcttatttggacatcattttcagcatttttgatttttgccacatttaaatgtatcagagtttagactcctttcttagctcatcattaaagtgttctgcttcttaggaagaaatgaatctaggacactactgtctttttttctaggtacacactaatggatgtggaagctaagtgctgtactcttgagatctgggtggcacctcccatgtgtctaggagatagagaatgggttcaagaggagtatgggcttttacataactggtccccaaaagtcccaaaatgtttatatattgcctgctgactcctctgaccgtcacaaagatcaggagatgagaattttcttcaaactctagttttgtctaaaggagctttgtctcaggagaatgcataatttaggtatcatcctacttaccaaactggtgtgcatgtgtatttctttttaaataattcttttacattagttttactttccttttgcagactaagtaggaataaacgttatttatttatttgtttgtttttttgagatggagttttgttcttgtcacccaggctggagtgcagtggcacgatcttggctcactgcaacctctgcctcccagtttcaagcgattctcctgcctcagcctcccgagtagctgggattacaggtgcctgccaccacgtccagctgattttttgtatttttagtagagatggggtttcatcatgttggccaagctggtctcaaactcctgacctcaggtgatccacttgcctcggcctctcaaagtgcagggattacaggcatgagccactgcgccctgccaatttttttttaaattttcatggtattcctcttatggcttaagaaaataatcagcagagtaccccttagaactttcatgatttcactaccaatttttttttggtttgttttttggtctttttagagatgtattttcactcttgttgcccaggctgaagtgcaatggcgcaatcttggctcactgcaacctctgtgcctccccgcaaccctggcccccctgggttcaagtggttctcctgcctcagcctcccaagtagctgggactacaggtgcatacaaccatgcccggctaatttttgtgtttttagtagagacaggttttcaccatgttggccaggatggtctccatctgttgacctcgtgatccacctgcctcaaccccccagaatactgggattacaggcgtgagtcaccgtgcccggccgcaaatgttttaatttttacttagaagcaaatttgagtcattggaaaagtatataacaccttaaatattcattacataaaccatcttgtcagggataagtaccttggttttcttaaataagtatattttgaatgtaaaactgaaaatgtgattttccaaccagtatattatagtaattggcattaagtgttgcacatttaaattattaactgcaaatgatgtcataaattgatttaactttgttgattatcaggcaaaaacatggtgaataaaggaagtgcccctatttttgtattacagaggaagttagcatgttttgtgaatatccatgatattaaactgttacaaaagattggagggagggagggagggagcgagcgagaaacaattagcagtttctgctttaactaattttttatttttatcacacttatgaactcctataaaaagatttatctaaattgtcttttttctttgttgattttattgaggtgaaattcatataatacaaattagcaattataatgtgtgtatttcattgacatttaatacattcacaatgttgtgcaactaccacctgtatcaagtttcagaacatttttctaactccaaaagaaaacccctattaagcagtcactctccttttcctcctcttatcccccataaaccacaaatctgctttctgtttctatggatttacctattttggatattttacataaatgatatggtattgtatgtgacttcttgtgtctggcttctttcacttagcatggcactttcaaggttcattcacatagtagcatatatcagtacttcattcttttttatgactgaataatactttattgtatgtatataacacattttgtttttccatttatctgctgacggacatttcaaaagactgttccaccttttggcttttgtgaatagtgctgccatcagtatttgtgtacaagtatctctgtttaaatacctgcttttaattctttttttttttctcttcccgagacagagtcttgctctgtcactgagtctggagtgcagtggcatgatcttggctcactgcaacctccgtctcctgggttcaagcaattctcctgcctcagcctcccaagtagctgggattacaggcacccgccaccacacatggctaatttttgtatttttagtagagacggggtttcaccatgttggccaggctggtctcgaactcctgacctcaggtaatccacccacctcggcctcccaaagtgctgggattacaggcatgagccactgtgcccagcctgtttttaattcttttagatatatacctaagagtggaattggtgggtcagtggcaattctgtgttcaacatctttaggaactgacaaacttttccacagtgactgcaccattttagagtcctaccagcaatatatgaggattctagtctgtctcttagctgtcacttgccattttcccttttttaaaaatagccatcctagtaggtatgaagtggtagctcattgtggtttgatttacatttccatgatggctaaaaaggatgatcatcttttcatgtgcttattggtcattgtatttcttccttggagaaatgtctatttaagtcctatgcccattttaaaattgggttgtctcttttgttgttgagttgtaagagttctgtatatattctgggtattaatcctgtatgtgatttgcaagtatttcctcccattctgtaggttgtcttagctttttttttgagatggagtctcactctgttgcctaggctggagtgcagtagcacgatcttggctcactgcaacctccatctcctgggctcaagcaattctcctgtctcagcctcctgagtagctgggactacaggtgcacactactatgcctggctaattttggtatttttagtagagaaggggtttcaccatgttggccaggctggtctagaactcctgacctcaagtgatccacctgcctcggcctcccaaagtgctgggattatgggggtgagccactgcattcggcccatactattctcttatccttttctgtaaggtaattagtaatgtctttattaaattggcttttaagtagagcttttaattttttgttgttgttatatcatttcttaatttggtatgtttttgacacagccagctttgtttcacttgcttcagaaggtggggaattgaaaacgaatgagtaatacaacatccaaaagttactttgtactggattttctgtatatgagttcaaagaaaggttcatcagaccaccagaccatctctctgctacatcagttatagaaacatttgagagattattataaaaaaaggtatttcacatataattttgtgtagtgctgttcctagtctgcacctttctgaatcttgtagtataaggcgcttgatataattttatattattgaatcttccacatgcttggttttagttatatttcttttcttttcttttctttttttttgagacagagtctcgctctgacggccaggatggagtgcagtggcacgatcttggctcactgcaacctctgcctcctgggctcaagcaattttcctgcctcagcctcccgagcagctgggattataggtgtgtgccaccacgcctggctaagttttatatttttagtagagatggagtttcactatgttggccaggctggtcttgaactcctgacctcaggtaatcctcccacctcggcctcccaaaatgctgggattactggcgtgagccaccttgcccggccttagttgtatttctttaaattaggtttttgtgcctgtagttccagctactttgcaaggctgaggtggaaggtttttttgagcctaggagttctagttcagcctgggcaacacagcaagactctatctctaaaaataataataaaaaataaagggtttaggctgggcacggggactcatgcctataatcccagcactttgggaggccacaataggaggatctcttgagcccaggagtgcaagaccagcctgggctacaaaaaattaaaaacaaatcatctgggcatggtgatgcaagcctgtagtcctagctcgttgggaggctgagttgggaggatcacttgagcccaggaggtcgagactgcagtaagctatgattgcaccactgtacaacagcttgggcaacagagcaagactctttttcaaaaaaaaaggtttatgcttacatttttctgggtgactgtgcctatgttaggtttatgcctaagaaagagggcctacaatctttataatttaacagcaaacatatcctgcagatggtaagagatccatatgaatgcatcaatgagtaaattaaaacatctgaaaatgtaacaacagcaaaatattaaggtggcttttggagagagttaaactcttttggtctaatttgtaggtaattatatgaaatatctttgttttattttgagatggagtctcgctctgtcacccaggctggagtgcagtggtgtgatcttggctcactgcaacctccaccttctgggttcaagtgattttcctgtttcagcctcctacgtagctgggatttcaggtgcctgccaccatgtccagctaattggtctatttttagtagagacggggtttcaccacgttggccaggctggtctcaaactcctgacctcaagtgatccccccacctcggcctcccaaagtgccgggattacaggcgtgagccaccgtgccggctgaatatctttgaacctgcaatgttgttaaagtggtcagtggtattaataaaaagtgttttgtgtatgcatttgtgcttttttttttttgcttcatcctggtgggaatgatagtgcattttgcgtgtcaatgagaactatacagtttggttaaaaaaaagatgataacagatagtaaacctaagactcatcaggaagccaggttgtataacagtgtctaacatagaataggtgtttaataaatgtttgattcaataaaaaaccatgaaactgcttgagtagttggctaaaataaaaacgaggctgagatcaactaaattagaattatgtcctttaaacaagctacattttctaataccataataagattactgtagcaaacgtaaaattgtcgtgagatcacaggggcagaattgtccctctggagagagggctactgaaaattacgaaagagaggccaggcgcggtggctcattcctgtaatctcagcactttgggaggccgaggtggcggattgcttgaggtcaggagttcagaccagcctggccaacatggtgaaaccccatctctactaaaaatacaaaaattagcaaggtatgatggtgcatgcctgtaatcccagctactcaggaggctgagacaggagacttgcttgaacctgggatggggaggttacagtgaactgagatggcgccactgcactccagcctgggcaagagagcaagattctgtccccgtcccctgccaagaaaaaagagaaaagtgaacttgtgttatatttattacaaaagtaattcaggtaagttatagaaaatttagaaaataccgtggccaggcacagtggctcacgcctataatcccagcattttggggggccaaggtgggaggattgcttgagaccagactgggcaatatagtaagatcccttgtcttaaaaaaaaaaaaaagttagttgggtgtagtgatgcatccctgtagtcccaggtgcttgggaggctgaggtgggagggttgcttgtttccaggagtttgaggttacagtgattgtgccattgcactccagcctgggcaacagagagagcctgtcttaaacacacacacacacacacacacacacacacacacacacacacacacacccacacacacacccccagaaaagatttagaaagtatagataaatataaagctgaaataagtcacttgttatcctaatatcttttttaaacttttttctgtctataaaaatgagatcattatacacatatgtgtgatatatatgcgtatacacacacatatatgtatatatacgtgtatatatgtatatacacgtatatatatacacatgtgtatatatatacacgtaacatatatatgtataatgtgtatatatacacacatatcacacatgtatatatgtgtatatatattatgtataaagcaggatatatatatatatatagctttgtagcctgcttaaatcacttaccagtaagtctaacatgagacttggtgctgaaatattggagattaggaatcctgccagaaagtttcctgtgtatttaatatagtcttacttatcaaatggccagttggatatagtgactagattttcctgtgtatggaatagacattattgggaaaattggtttgtccatatcatttatttaaaatcacattattagtattaataatatatattatgcacatatggtagtctacttacctacttgtttggtattttaaacttcttagtttatcaaccatttttttaacttttactttaaaattaacaattttattataaatatgctgtaaactgcatcaggacttttaaagtattttctagtttatgagaagaaagagttaaaaatggaatggaagtgtcctctttagagaacatatttactatctaaaattctgtgatgtccatctatgatggacaacaatgacaaatttgaatgaaaacaaacaaatagacattgaattgtgaaacaaacggaacacttaatttatatgttaggaattttcgggaaagcatggagattggaatgcaaggatatggactgaagagtagttttgttgtcagggaaacaattgaaagaaaaggagacctcctttgtaattaatctgacacttcttgggggacttgtccttgtgcaatttggtcactaacagaacagaggctgcacattaattaactggactgtttgctaccaggaggtgtccataatactagaaatctactcatactattagtagtggcaaatagttcaggacttagggaattctgggtcgggttatcagcatgacagctcctgaacatagttctaccattccatggtggaagtgtttgcagtcagccccacttgggtgtagacatctttgggtcccttggtgttagttgaagccagaaggagctcagatctgcagatgcatcctattcccgtatttcccctacaaagcattttcatcattcctttttttatagatgaggaaactggctcagacagatgttcattggtttgagaacgctcccagaaattctgcttcagtctttctgggtcagcctttggagagtcttaatttttattaagcacagcagctaattctattctatttggctcttgacctacagattgagacacacaggactcctgacttttggttggccattgtgagtttttacttccatttttctttttctccagaaaaatgcttacccatcattgcgagttttgattcttattatctaagtatgttggtcagtctctcattcttccaaggcctcagatgactctccaagataatatttgaagatagaggttataataattgcacaataactactttctgtactttacataaacaatttttaaaaaatgcatgtctgtgtttagtggggaaaaaacctcccactaaacacaaacacacattttcaaaaatctattaagttttactaagaaattatacttttattaggccgggcatggtggctcatgccctgttgtcccagcacttttggaggccaagctggatggatcacttgagcccaggagtttgagaccagcttggacaatatcgtgaaaccttgtctctacaaaaaataattagccaggtgtgatggtgcatgcctgcagtccccagttacttggaaggctgacatgggaggattgcttgagcccggaggtcaaggctgcagtgagtcataattatgccactgcactccaggccaggtgacacagcaagaccctgtctcaaagaaaaaattatacttttattaaaaatagttactgactattggccgggcgcggtggctcacgcctgtaatcccagcactttgggaggctgaggcaggcggatcacgaggtcaggagatcgagacatcctggctaacatggtgaaaccccatctctactaaaaaatacaaaaaaattagccgggcgtggtggtgggcacctgtaatcccagctactcaggaggctgaggcaggagaatggtgtgaacccgggaggcggagcttgcagtgagccgagatggcgccgctgcactccagcctgggcaacaaagcgagactccgtctccaaaaaaaaaaaaaaaataaaatactgactattgactggtaaatgattgggacctattaatatttctcacacagcaatttttatttaatgaaattatgtcaataactacaaaacagtttagtatggattactatttctgtcctttatagaacaaagtcctgtattatcctatatttatacaaagcttttttaaattataaaaatacttggttattatagaaaaagtttgaacgtatagagatgacaaagtattcgtaatttgacatcccagaataatcactgaaagcatattggtgtacatcatttacaaatgtggcagtgtttactcaggttgttttcaacataaatacaatatttttccaaagattttattttatctccctttttatttttttcattttttttttttgagacagagtcttgctctgttacccaggctggagtgcagtggtgcgatctgggctcactgcaacctctgcttcagcggaagttcaagtgattttcctgcctcagccttccaagtagctgggactacaggtcgtgccaccatgcctggctaatttttgtatttttggtagaaagggggtttcctcatgttggccagcatggtcttgaactcctgacctcaggtgatccccctgccttggcctcccaaagggctaggattataggcgtgagccaccgcgcctggccagacctagttttaatggcaaatagttattaaagacagttcatacttactattcatctttcagaagaaaggtgtctgcttcaaactctaatgacagatcaccgaataaccagtagtggtaactgacactggctggtaagtgagaacttagtaaaattctgttcatcctaaaataagtctctatttaaacagtggaggtatacagagccatttttgtaatgtattatgtgggaatgaagggatggtagttggaaagaggcgctaactgcatttagacttgtgagaatttttgctagttttctcactttttgaatgaggagattgggccagttgagctcttgtttgtttagtactttaggaaagggtggaaagagttggcttttagcaaacatatgtttaatatgtgttattccatttaatgcttaaccactccatataaagtaagtgttttatcctcattttaaaaattttaattttattttattataagttctaaggtacatgtgtaggatgtgcaggtttgttgtaaacgtatgccatggtggtttgctgcacctgtcaacccatcacctcggtattaagcccggcatgcattagctatttttcctaatgctgtccctcccacaaccccctgacaggccacagtgtgtttgttcccctccctgtgtccatgtgttctcattgttcagctcctacttataagtgagaacatgcagtgtttggttttctgttcttgcattagtttgctgaggatgatggcttccaacttcatccatgtccctgcaaaggacatgatctcattcctttttatcctcatttttatagataaggaaactgaaacttaaaagagttttgtttaggtcacatacccaggtatttctggctttatcttcatttctttcccttatatttactttgttctcatttataatattctttccaactctaaaattgtggttctgtaacagtggaaagaacactgtaatgaaccctcatttaccccatttacaagattattatcctatggctgacttgtttcatctgtacccctttatagttgcctcccagcattagtttctcccaccacattactttgacacagaactcaccattccctccctctcttcctccctccgtccctccttccctccttcccttcttcccttcccttctcttcccttccttccctcccttttttccctccctttcttcccttcctttcctttctttcttttttttgatggagtttcgcccttgttgcccaggctggagtgcaatggtgcgatcctggctcactataacctctgcctctccggttcaagcgattctcctgcctcatcctcccaagtagctgggattataggcatgcaccaccactcccgactaattttgtatttttagtagagacagggtttcattatgttggccagactcgtctcaaattcctgacttcaagtgatccacccgcctcaacctcccaatgtgttgggattacaggggtgagccgctgcacccagcctcaccatatcatttcatctgcagacattccagtatatagctctaaaagaaacttgaacacctgtgaaaagaagggaatacaaataaaaaaagaaactattttgtaaaaatttaaaacataaccacaatactattatcactgtaaaaacaacagttccttcctgtctactcagtgatttttatttaattttaattttaatttttattatttatttatttatttgtttttttgagatggagtttcgctcctgttgcccaagctggagtgcaatggcggaatctcggctcaccgcaacctccgcctcccaggtgcaagtgattctcttgcttcagcctctggagtagctgggattacagccatgcgccaccacacctggctaatttttttttgtgtttttagtagagacggggtttctccatgttggtcaggctgatctcgaactcctgacctcaggtgatccacccgcctcggcctcccaaagttctggaattacaggcgtgagccaccgcacccggcctactcggtgatttttataatttctttttaaactgcttgagattcatgtaagaccccatacattttaattagttggtatgtctgttaagtctttaatctacacatttcacctctatctcactttctcgttttcttgcattaaaaaaaaaactgtgtttgtgtgtgtgtttgtgtacgtgtatgtgtatgtataaagaaactgggttttgactttcagacatcctcataccgtggaggctgcgatggtgttcaacgtttttctgtctcatgtattttatacaatttggtaatttgatttagagtattcctgtctaatataacgtaagccataaatttaagccatatataatttgaatttttccatatatacttttttaaaaagtgaaaagaaacgggtaaaattggtttgaataatacttttatttgacccagtatatccacaatgttattatttcaacatataatcaatgaaattaatgaagtatattgcattctttttttggtatgaatcttagaaatttggtgtgtattttatacttatagcacatctcagtattagccacatttcaagtacccagtagcagtatgtggctagtgactcctgtattgaacagcacagatttagagaactgatcagtcaggctttttgtttttatgtcaggaaatagagaatgcctgactctcttggtgtggtgctattggcagccattcatgaacattgtttttatctattgatttattagggcttgcaaagtggtgatattttatccttctaccttcatttattatctataatacttatctaaaggaatacttcccaaccttgactatttggtcacacccccgtcacctgccaaaaaaccctacacagttcatatagaaaaaggataaataatgcttgacctttttcttttatttaccagttttccaaataatgaatttgtttcctaccattgtccaaaagtaactggggaatattttgttttcacctgtcatagatattttagctttccttgcttcttggagtattagtcagtgtccttcagagaaacagaaccagtagggtatgtgtgtctacacctttataactatatttgtatctatatctatctgtatccctatctgtagatctgtttatcttcaatatagaaagagatttatttggaattgactcatgccattatggagggctgacaagtgccaagatgtgcagtcagcaagctggagacccaggagagctgacggtgcggtttcactttgagtctgaagccctaagaaatgggagagctaatggtgtagttagagactgaggatgggttggttgactcaagacttaggaagagccagtatttcagtttgaaggtgaaggcagaagaaatctgatgttgttgcttgaaggcttagtcaggaggaattagttctgtcttacttgggggagggtcaacctttttgttttaggcaggccttcaactgatgaggtggggcctacccacatagggaggataatctgctttacttagtctgctgattgaaatgttaatcttatctagaaatactctcacagatacatccagaaaaatgcttgaccaaatgtctgggcaccctctggtccagttaagtcaacacataaaattaactgtcacatccaggctcattttgtacatttcctgccctaaatattgttgtcagtcaatgaatgccctttgatgatacttttgatgatgaaaacactttgagattcatacttttcaaagctttacttttagtgttttttcatttggaaaggtgtaatttcttaaaagtgattacattatcttatacttaatttttagatgccttttctcacttttgggaaggaggtttttggtgtttactctgtcagtgtcatattgatgtttgtttctgataaagtacttgagagaagcatagaatgaaaacttacagcacagagtcatacctagtaaaatggatacacgtggtttatagttatctctctctctcttctttcttttcttttcttcttttttggcagagtctcactctggttactcaggctggagtgcagtggcatgatcttggctcactgcagcctcgacttccccaggctcaggtgattctcctacctcagccttctgaatagctgggattacaggtgcatgccaccacacccagccaagtttttgtgtttttagtagagatggggtttcaccactgtgttgcccaggctggtctcgacctcctggactcaatcctctcgccttggcctcccagaatggtgggattacaggtgtaaaccaccattcctggccattctttgtatcaacctgaacaattttacctcttagtataacaactgaattacagacgcaattgagtttatcctcttcatttttttttttacagaaaaggaaacagagggccagatctagttattgggaatgacttggtcttagagtcgtcagcatgctatagtgggagttcagagccagactaaaatggctcagattcttagcattgccatttactagtcatgtgaccttgaggaaacttgatttttttggtttatttataaactacagataataactatgtcataggattactgtgacagttaaccaggataactttttttttttttgagtcagggtctcactttgtcacccaggctgcagtatagtagcacgatcttgggtcactgcaccctctgcctcccaggcacaaatgatcctcccacctcagcttcctgagtagctggggctataggtgtgtgtaaccatgcctagctagttttttttttgtttttttttaaattttttatagagacagagtctcactgtgttgcccaggctggtcttgaaatccggagctcaagcaattcgcctgcctaggcctcccaaagtgctgggattataggcgtgagccaccatggctggcccaagataacatattttaaagaacccagtagtgtgcctgacacattgtaggtacactgtaaattctgtttttttcatgtcctcccagattgcagttttttctggcatattgttgcctctttttttttgatggagccttcctttatcacccaggctagagtgcaatggtgtgatctcgctcactacaacctctgcctcccaggttcaagcagttctcctgcctcagcctcctgagtagctgagattataggcacttgccgccacacccagctaatttttgtattttcagtagagagggggattccccatgttggccaggctggtctcgaactcctgacctcgagtgatctgtccgccttggcctcccaaagtgctgggatttacaggcgtgagtcactgcacctggcctcttgcctcctttttgaatttaacatcaagtatatctaaattagctgaaaataatatgctttgcttacatttgttactttgtttatagtatttgcttagcaaacttttttccttaatagactaaaaaaatttggtccttttctgaatttttctggatgacagttactgaaatttaaattgagaagatttggccaggcctggtggctcacacctgtaatcctagcactttggtaggctgaggcgggcggatcacttgaggtcaggagctcaagagcagtctgaccaacatggggaaacactctctctactaaaaatacaaaaattagccgggtatggtggtgggtgcctgtaatcccagctacttgggtggctgaggcacaagaattgcttgaaccccggaagtggaggttgcagtgagccaagatcacaccactgcactccagcctgggtaatagagtgagactctaaataaataaataaatagagaagattttacttttcatattgaagtactttatccaaagtaacttttgttattatatcttaatttattgtaattattgaatattagttacaaatagttcttaatcatattttgtgtgttagcagggtacagtgtaattattttcatgcttgtgttttgctacagtaaacaggatagtttagaaaggctataattaatagatgttcaaaagttgctttgatgtccttagataaaagctatgcttccaacaccaaatgctagtatttttaattatcattctcctttttaatttgaaataatggcttgagtactgtagtgctagctccaggattcttagcctgtattgtttaatgtgaatgtgcagaaaacattttagaattttttttttttttttgagagaggatcttgctctatcacccaggctgcagtgcagtggcgtgatatcgactcactgcaacttctgcctcctaggtccaagcagttctcatgcctcagcctcccatgtagctgggactataggcatgcgccgccacacccggctgatttttgtacttttagccaggctggtcttgaactcctggcctcaagtgatccgccctcctgggactcccaaagtgctgggattgtaggcatgaaccaccacaccaggccagaaatgattaacatttatctttcaaaaaatgcacttttagattcaggttgtttgctatttgagtgcagttgcagaagcatgttgtcagatacttgaatactgactttcccgtgacattaatagatagctttctttgttgtgaggtataaaaaatacaattgctgatgcccaaggttgtgtttcataaggtaaatgaattttatttgaggttctgtagacttcaaattgggagatcctcgaggtgatgaaataggaagtttaactaccttcatttttttttggagtagttttcatttgctttctccattttcttgtacctcatcttgtctgtaactacttgtaaatgcaacttttacctgcaacccctgaaaaataactgctcaaaggctcccaatttctcataatcaccaaaatcaattgattggctttttttttttcagttctcattgtgcttattcattagagagagttggattctgttaatcttcatgaaagatctcatctctttgctttccttgtactgtatcttctctttatctcttgagctgcacctcttttcccttccttattggcccaacttcttacttctctgcccaagtacctgtatctcaggactcactttttctaacatttctattgtcatcatcatcagtcagtccacgttcagatggctcttatgcattcttttgtctttaccaccttaattaaatgattctgaaatctcttgatcccttttcctgcacttaaggctcacactcttactaatgggaatattcagctggttgccttgttgtctcctataacttttggtgtgtccaaaatcaaagtcttcatcttagaacaaacttcatggctttccttgatcttgttattggtactggtattattattcatctaggcccattttaataatcattgattctttctcttatcccccttcaatttatttaggcacacagttctagtctaactttgtttaacacagtttgggctgggcacgtggctcatgcctgtaatcccagcactttgtgaggctgaggcagatggattgcttgagcccaggagttttagaccagcttggtcaacatggtgaaaccccatctttactaaaaataaaaaattaaccaggcgtagtgtcgcatacctgtggtcccagctactcaggaggctgaggtagaaggatggcttgagccagggaagcggaggttgcactcagctgagatcgtgccattgcattccggccagggtgatagagccagagcttgtctcaaaacaaaatgaaacaaaacaaaacaaaacaaaacaccacacacagtttggaggatggtggcttttacaaaattgaggttagttgatgggttattagttcatttgctgattcggcctaagagcaggaagaggttcttatttcttaaatagaagttttgtggggactgtggttgaaaagaaggtgccatggcattgtagaatccttttaaagttgctggtgcttgggcatgactgaggctctgaccttttctgttatgatttcctgttagttggagaggtaccacttcaatccaggcaccttttttacattaacacgtctgcttcagcgtcaggcagttcattccaaagggaatgaactggaaatcatatcagaaaaggtcagagcctcagtcatgctcaagcaccaacaactttaaaagcaaagtgtttggcagagtggatacacacatacaactcaacttttatggactgtgcccttcatttccaaacttagttttccccctaatttatcaatatcagaaccctctggaaagtcttttattgtgatgggtgttatatctgattacctttttttattcccctgcacatctgaaacctggcatgcccatttcccatcactcagtccacagtagacatgtttcttggccagttataagggcagaggttgctgggattcttttttgtgcatcttatggttgctaaatcagaaactttttagatggatgagctggcacttgcagtactagtgcttagtgaaagaaggaaacagacctcaacatgccacaacaaatacccaaaaccaaaaattgtatcccattatagttaattacttcagaaggcaatttaacttatctagattatctgtaaatgctgacgaagtcagagtggagaatagctcaagcccttgctagacaaataaaactgttgtaactgttaattttgttcattagagaagaattatgaagaaagatattaataaggtgtttcatgtcttgactgttctctagatggttcttttctagagtatttccatgttctctgcttctttctaccagatatttggtgatggatatcatacttaggaaagtaaagtaaaaggaggaagttcctttttgctaatagggaaacttggtcacattggcccacatatatctaattactgtaatctatatgttatttgttaaatagcaattcttaaaagtttggttttatgcattttaacctagattgttaatgtagctattatcttaggttcaacaatgatttgtttttagccaggtttagcattcagaggcctttttccacatcagtagacatatcccacagcatcattgtttatgacttcatagtattctgttatatgattgcaccatattttttattacttaattttttgatagataatacatgtacgtagtgtaaaatacaaacgatctgaaagagtatacagtgaaaagcaaagtgtctctctttgttcccttttcaggatgcagtaactgttacacatttctttttttttttttttttgagacggagtttcgctttcgttgaccaggctggagtgcaatggcacgatttcatttcaccgcaatctccacctccctggttcaagtgattctcctgcttcagcctcccgagtagctgggactacaggcacatgctaccacacccagttaatttttgtatttttagtggagatggggcttcaccatgttggccaggatggtctccatctcctgaccttgtgatctgcctgcctcggcctcccaaagtgctgggattagaggcgtgagccactgtgtctggcctacacatttcttttgttcctccagagatattctacataaatacaaaccaatacataatcatgtatgatatatatgcacacacaaaaatggcaacgtattgtaccttctgttgtgtataatgcgtgttcttccccctcaattaaaagatgttccatagaggttcataaaattttgcttcattgttttccggttgcttaatattctggtttatgagtctgccataatttatttaactagtttatttttgactattcaattttcagattgtttgttctgtcagttcacccatgtgcaatcattacagcctctcttaccacattttacatggtgtcatcctctgggcttgatctgcttctcctgatcaaactgtgagtgaaagctcttacagaaggaaatcagtatcacactgaatagggtgagacagtgcttaatgtttacaaatctgttttgtggtagaaatatatgaaaaataaaaattctaacttttcattttctcttaagaaactcctttttttttttttcaaagaaattgcataagaagtgctaccttgtgtgggaagtgttatcctagtcctgattctttccagtcaggcagacttactttatttttccacagattatgtttttgttttaggatttgagtactgaattatcctgattactactactgactaattgtaaactccaaaaaatgaagaaaaaagaaatatgctagctgaatttggaaggaaataatcatttctgtttagctctgttttagggaagtactgtcgactcaacttcaagcatttgtgtcacttgaggtggttgctttttatggtccagatttatatttccctcactagagtactggacccttttgtcagacggtaaacatggtgtttttgaagccttcatttaaattggaaataggagcatggaggaatattggggcgttttgaaataaacgtggatggccgagcatggtggctcacgcctgtactaccagcgctttgggaggctgaggctagtggatcacctgaggtcaggagtttgagacaagcctgaccaacatggtaaaaccctgtctttactgaaaatacaaaattagttgggcctagtggtgcatgcctataatctcagctactggggaggctgaggcaggagaatcacttgaaccctggaggtggaggttgcagtgagccgagatcgccccattgcactccagcctgggcaagaagagcaaaactctgtcacaaaaaaagaaaaaaaaagaaataaacatggatagttttcaattagactagaacattctcatgaatttttggactaaaacagaagattttaaaagataattttgagtttaagtatcacctagggtctaagagtctgagttttattttcttcccttatcagtgttatttggaaaagctggagaggaattaattgaagtgagtctaagaaacaagggggttacttaaggcttcaaagtagcttggaggtaaaattaatgtgtttatttattgctaatttatagattatatgatttctcaattacactgaaaaatctcaggtataaaccttccaggagtctgttagctgcattcactgagaatatagcatgtgcaaataaactcctttaaggcagtgggcctcacgtttgtttgtttgttttttgtttttttttttgagacagggtctcactgcagatttgacctcctggactcaagcgatcttcctgcctcagccctggagtagtactacaggcatgcgccaccacacccggctaatttttgtatttttttgtggagatggggtttcaccatgttgcccaggctggtcttgaactcctgagctcaagtgatcctccctctttggactttcaaagtactgggattacatgcatgagccactgcgcccagtctcacattttaacgtgcaatggagtttcctgcagaggttgttaaaaattcctggttgccattccagagattgtagtggcacatctctgggataaaacctagggatctttcttttttttttttttcaaaacagagtttcgctgttattgcccaggctggagtgcaatggcacgatcttggcttactgcaacctccgcctcctgggttcaagcaattctcctctctcagcctccctagtagttgagattacaagtatgcaccactatgcccagctaattttttatctttttagtagagacggagtttcaccatgttggtcaggctgattttgaactcctgacttcagatgatccgcctgcctcggcctcccaaagtgctgggattacatgagtgagccactgtgcctggctgggatctttcttaaataaacacattacgtgattctggtctgtagactactttttgactattataggagtaagaattatgatttttttaaaaaaattaatttttacaagaatagagacaaggtcttggtatgttaaacaggggtctcactatgttgaccaagctggtcacgaacttctggcttcaagtgatcctcccacctcggccttccaaaatgctgggattacaggcatgagccacaaagcctggccaagaattatgatttctaaaaggatgaaaaatcataccccattagttaaaaagatttaaaggcaggagcgtgtaaacattttcaggattgtgggtaatttaaaataacaccatagtgcagcacagtaagcttggtgttgaaattggtttgtcttgtgtgaagacagatagatactagttgttccctctgtgttagtgatggataacttgtggctggcaagaagactcaacaatcatgtggctatatgtgtcccaagtagcaaataagtatcttagaagtcaaaatacttttgtcttagaatttaagatggctttgattttaaaaaatcagaatatttaatttattttgaaataccaaatatcattgaggagtgggacattagattttaattttagcaaatgggagcatgggttaaatgagttaatttttcaaaatatttgaaggagagtagcgagattatggtgaagtaggccttgtcatgcatcattttgaatggatgcagttttggataacattttgaatatatgtatcaaaatcttataaaggggctgggcacggtggctcacacctgtaatcccagcactttgggatgccaaggtgggcggatcatttgaggtcaggagttcaagaccagcctgagcaacatgatgaaaccccatctctactaaaaatacaaaaaatgagctggacatggtggtgcacatctgtaatctcagctactcaggagactgaggcaggatagttgcttgaacccgggaggcggaggttgcagtgagccaagatcgtgcctctgcactccagcctgggtgacagagcgagactccgtctcaaaaaaagaaaaaaaaaaatcttatgaaagttcgtactgatttacatagtaagtccatttctgagaatctcaaaaggaaataattgtgtttttttttttttttttttgagacggagtttcactctatcacccaggctggagtgcaatggcatgatctcagcccactgcaacctctgcctcctgggttccagcgattctcccgcctcagcctcctgagtagctgggattacaggtgtgcgaccaccatgcccagtgaattttgtagtttcagtagagatggggtttcaccatgttggccaggttggtcttgaactcctgacctcatgatccgcccactttggcctcccaaagtgctgggattacaggtgtgagacaccgtgccggccagaaataatcttaaatatggaaaaagctttataagtatagatacataatacagaattgtttataataacacaaaaattggaaacaacccagtgattttatattaatgtttaaggaaacagtgatccattcacacaaggaaatattatttaatcatacagtgtctttgaagagtttataatacagggaaatgcttatattagaatgttatgtaaataaaagtaggctccagaattatatatcatcttaaagactagaaggaaatttggaaaatattaattttggcgattttttagtaattatgggattgtggttctcctcatacatattcctcaaattttctgtactgagcatgctttttttctaatgaaaaaatagcaagcaaaaataaatattttgatcttaaaaatagtttagataagatgctataatcagatattatcaaagtatttagtggcatttgacagagctaggaaactgatttataaacagtgaataggggtgggaagagagaatccaaattaatggactgttacaggaatcagtgctaaacccattttcagatgaggtgtttgtaaatgaactggaataagtatactgtgattctccaaatttgtagctcttttgggtacgaaatgccaatggaattggttttagctctgaaaattttgagactatatatgaacggacagaaaagtagtaagtgatttccagttggccaaatctaagaggtggttggtacacactaaagattatttattgggattgttaattgccctctgctattgtattctgaaatacagtatagccaaaaatgtaaataaatacttaaaatatttacataaattagtagatagtaaggaatccaagatatatggatttggcctaacctttgaggtttatataaaggcgaacagtcggtgtttttcacagtgcgatttttattttaattttaacttttaaaatttgttttgatttgatacagtactgctctggataggttttggatcagacttgctgtgacagttcttgcactccctaaggtgctgtaccaagggcatgctattttctgtgtgaggagccctatcagatacataaaaacaaacaacatcctttgagatatatctaaaaataggatatgaattttgtaaaaagcatagcaataaattccaagtgtgtgatcatagtagagcattagtaatgagagaaaggatttggaggaagctgctgaaatgttatttgtttttaaaatcaaatggggctgggcgtggtggctcacacctgtaaatcccagcactttgggatgctgaggtggttgggtcatgaagtcaaaagttcaagaccagcctggccaagatggtgaaacctcatctctactaaagtacaaaaattagccgggtgcggtggcaggcacctataatcccagctactcgggaggctgaggcaggagaatagcttgaacctgggaggtggaggttgcagtgagccgagatcgtgccactgcacttcagcctgggtgacagagtgagagtccgtctcaataaaaaataaaaagataaaaaaaaaaaaaaaccattaagtgagattttgtagttggtaaggcttctcggaaacacttttcattgtagtgagaagcagtggttcccaaatgctgatttttgatgaatttttcactgttctgcattgaaattaagaatatcagaacatcatagtgagtggggttttcatagtggtagtatatttcatgaattttaatatgtatgttttcccacactttttcatttctgaaattgagatgtgttttccagtcagtagcaacttaaaattatcatttggaaaatagttgtcactgcctgttcatatgtgaatttggtagttaatcctactgatatgactgactacacaacatcacccctttgatgtttcagtcaacatactagttaaataccaattacagaaggtgtaccatccctgggttgttttctgaaaccgtctgttacatcattcagtgataccttttggtaagatcaggaaagggactgcattgagacttgggcgatatatgtcagcagcttggaagacagtcccaaagcaacagagaaacactttaaaaaaatgttgaatcatgaattctcttaatggtatgaaggacgatactatggaaaaacaaggattgctgatgactctaagtaaaaagcaatttgatgatcagattgtgaatgttgaggaaaattttaagaataccttatttattttgcttttgtattttttataagcacaaggattatatatttgtctgaataagtatttttttgttttttaaattttttacttccattgttttatttttcttttctttttttttttttgagatggagtctcactgtgtcacccaggctggagtacagtgtcgttatctcagctcactgcaacctccgcttcccaggttcaagcgattctcgtgcctcagcctcccaaatctgggattacaggtgtgcgccaccatgcctggctagttttttcttgtgtttttagtagagatggggtttcaccatgttggccaggctggtctcaaattcctgacctcaagtgatctgcttgcctgggcatcctaaagtgctgggattacaggtgtgagccactgtgcccagccaaagaaataccttttaattgcttgttcattaataggtttttttttgttttttttttttgacggagtcttgctctgctgcccaggctggagttcagtgctgtgatctctgctcactgcaacctctgccttccaggttcaagagattctcctgcctcagcctcctgagtagctggaattacaggcacctgtcatcatgctcagctgctttttgtatttttggtagagacagggttttgccatgttggccaggctggtctcaaactcctgacctcaggtgatccatctgccgtggcttcccaaagtgttgggattacaggcgtgagccactgcgcccggcaataatatatgtctgaacaagtttaaaagaactctgccaataagtgtaaaatgacataattctaagcaatagaaaccatatgtcatagtttgagagaggtttttttccttcttagtgatacttaaaataatggtgcacccaaatattgatggtatctttttaatttttaatttttattttttgcgggtacatagcaggtatatatatttatgggaggtacatgagatgttttgatacaggcatgcaatatgaaataagcacattatggttctgctaatagttgcaagggaatggggtatccatcccctcaatcatttatcctttgagttacaaagaatccaatcatactctaaattattttaaaatgagcgattaagttactgactgtagctaacctattgtgctatcaaacagtaggtcctgttccttctttctggttttttttttttttttttttgtacccattaaccatctccacctcctatccaaccctccaatactcttcccagcctctggtaaccatccttctactatgtccatgagttccattgtttttttttagatcccacaaataaatgagaacatgcattgtttgtctttctggtgcctggcttatttcacttaacataatgatctccaattctatccatgttattgcagatgactggatctcattcttttttatggcttatgtgtatgtaccactgtttctttatccattcatctgttgatggacacttaggatgcatccaatcttagctattgtaaactgtgctgcaacaaccataggagtgcaggtatcccttcaatatagtgatttcctttcttttgggtaaatacccagcaggaaaattgctggatcctatggtagctcaattttcaattttttgaggagcctccaaactgttctccatagtggttgtactaatttagattcccaccaacagtgtataagggctcccttttttccatctctttgccagcatttgttaactgcctgtcttttgggtacaagccattttaactggggtgagatgatatctcattgtagttttgatttgcattctgtgatcatcggtgatgttgagcaccttttcatatgcctgtttgccattgtatatcttcttttgagaaatgtctattaagatttttgcccatttttgatacaattattagggtttttcctgtggagttgtttgagctccttgtgtattctggttattgatggcattttgaagttgatgaaatgtggttaatttattcagtttaaaggatttagattatctcaaaatcctgcctcagccttccaagtagctgggactacaggtgtgcaccactacgcctggctaaattttgtatttttagtagagacggggtttcggcacgttggccaagctgatctcaatctgctgacctcaaatgatctacccgctttggcctcccaaaatgctggtattacaagtgtgagccactgtgccctcttttgtaattttattggcctgtgaaaatcagagatccaggaaccgctgtttaaaacactctggcttattcatcttattatttatagatttctcacgatagatcagtttatttcttagtttgatttgaacatatttcacagaatgattaataatgaaatactgggtgccaacggcctacttttatttggctttttatgtgttgcttcttgttaccttatacccaaccatgtgggattgagtttattgtgctaataggcaggtattacctataaaaaaaatggaaaaagttgtggcagttggtcattctttaaattacatatgtagaatagtttcagcaacactagaaggctcccttgtggagaaatgtttctcttaccagcttgtcctggtatctaaaatagatcttttctttatctacaccttcattttatctctagaggaaactttgtatacatatggatttgcgaattccatgacaactgttgatctagacaggttgctggagtatagcctataggccagcaacattgctatcacctgagaagcatgttagaaatgcagaatctcagtcctactgtataactgtaggatcagaatcagcatttcaacaagattctcaggtgattcatactcactaaatttgaaaagagaacacatgacttttgtctagagtaaggaggagcaggctaaacagcgatagagaagtatagaaaaccaatttggcttagttcattagcttattttagaatgattctgttaatagttgcaagggaattcttgaaaagcaggtgtgtgtgtgtgtgcgtatttagtgtctggttttgtcaccatgcaaataaacttacttggaaaatattctttgagtcaagtgggatttaaatagaagtgttactgtatttcctacagctcattgtttattatctatttcttgaggagatacctcagcttaattctttgggaacctacttttactgttgtatccaaaaaagtaaatgcctatttatccctcttaagggcaagatcacacaaacattaagtagttttgctaggatttagcaatgctttttctttttccatttatcagtatttcttcaaacccagtggtatttgaaaatcaaagcacgtatttctaaatccttcatgtatcaaggataccatattggcaagtattggctagtctctgtgaaagaactcagattcacctttttacttgacactttatagataattaagcaatcatacgtaataaataggtatgcttaattatcttattcaaagataagtgagaaacttggagtttggctcttaccttagcgtccttgggaagaaattggtctttttacagaagtagccatatgaaagcttggtttactgcttaaaaacagtgaggttgttggcagtggggtggatgaattcaggtatattttctttgcttttatctgtttttcacattggttctgtaaacttcctgtgttgtgaacgtttttagggttatacagtcgtgttacttaatcacagggatgcactcgagaaatggtggttaggccatttcgttgttgtctgagcatcataagagtgtatttgccaacctagatggtatagcctactatacaccaaggctagatggtatagcctgttgttcctaggctacagacctatacagcatgttactgtatggaatactacaggcagttgtaacaaaatgatatttgtgtatgtaaacatagaaaagggaaaaggtagagtaaaaatacagtattgcagtttttcttttttttgcaatggagtctcactctcttcaggggcgtgatctctgcaacctctgcctcccgggctcaagtgattcctgtgcctcagcctcccaagtagctgggactgcaggcgtggcccaccatgcctggttaattttttgtatttttagtagagatggggtgtcaccatgttggccagggtggtcttgatctactgagctcaggtgatccacctgtgttggcctcccaaagtgctgggattacaggcatgagccaccgcgcctggcccggtgttgtcatcttattggatcactatggaatatgcagttcattgttgaccgaaacgtcattatgtgacacgtaacttatttttccttaagttaataatgaaattactttgtataagttttttggtaactgttcttaaattcaaattttaagatgaacaccattgtttaatcactgagtcagactttttttttgtactttgggaatttacaaatttactgtccattttaaacttgacctgtttatgtgtagcattataaatatatacagaaggacagtagatgcttaatttcagtgcatgttattgaaacacaaatacaaaataaaaacaaggaatatataccatttcatatccagattgacaaaaatgaaaaattctgacaatatcaaatattgggaacgacgtaggggaatgtgaacctttaactattacttgtgttagcaatgatgaaatgcaattaaaaccaaaatctgcttcccccagaaaacatctcttcaaaggtagaagaaaaaggaaacaatttcagtttttaataagtattaaaccagaatgacacgtgtatcacaagcaatctgctaaaagattgcaaagaccaaaagaatgctcacccttacatctagccaagtggatgtaacccattacatacatgttctcaagataaatagtaaatagtgttcaagtaagaggacttgataccatcatttgtcacacatagtttgtcctaaattcacttggtaattggagcaaccttgtgtgtgaacaaattggctttttctaaaggaaaaatgaactcatatctttatgacaggatgtaattttacaacttggaactagatggcctgccaaagttaggcaccctgtcctcccacagaaactgggagataagggtgccgtctctcttgatgatctcatttgaaagagatggttataaggttcttgagaaaggcagttttgggctgctggctagggttttacaaagatttacatacatctctaagcaggcagagaaagaatttaccaggttttgaaagaaaatcctctaagaaaagggggtcggggagtacaggtagaattaggcctcttattttaaattttaatttgcctgtatactgatggataagttgatccagctaccttagtgggcaagttagcaatgctgtagtcaagttgaagaagagtacaccctctgattcagcacttttacttttagagaaactgttaacatatgttcataggatacttgtagcattatgtattaatagtgaaacattggcaacaactaaagtatttgtaagtaggaaagtgaatagataaattttgctatattcgtatagtgcagtactatacagccctgcaaatgaatgatttagggcaacatatatcaacttgagtaattttcaaaacaatgttgaattactaaagcaagttgcagaaggttgtgtacagtatattgatacaacatttgaaaacatgcagaacaataccacttattgtttattgatacatatacagtgaaagtagaatagaatgataaacaccaaaatcaggaagtggttacctctaaggagggagatgtacaaagggatcagcaaggtattcatttatttcttaaccaaggaaaatcttaagtaaataaggtagaatgttaagatttaatttatttaggcagtgggtatgtgtgtgtttgttatattattacctagattcttttgtaatgtttaaatatttaatgattaaaagttttaaaagaaagaatggatggcaagcagtggaaggaaatgaggacaactcttcaagaaaatttgttgtaaaggggaccaaagaaatggaggggtagttgaagggaaattaatcagtgttagtatgacacatttgcatgctaataataatgataaagtaaaaaagggaagaattggtataggagacctataatagttatgggagcagaatccttgagaaagaaaaaaataatgggatccagtacagaaataccgtttggctcttgataggaacaaggacaatttgttgaaatacgagggaaagcagaataagtggtgggaagatgaagtagttatcttctcaatttagggtgaccaacatccaggtttgcttgtgatttagcagtttctcagaatgcagcacttccagtgctaaaactgggaaagtcttgggccaacttctgattgtttttccttgacaaaatgaaaagcattgatcattatcttctggaagtgataaggggatgaaggaagtattgaggcttaaggtgaaaagagaaggtatgagttaattctctatcttaaagataggagagcagattcactacgttaatgtgatgggatttctgagcattttaggggtctgctgaaatttatggttattattttaaagtttatatggttgtatttctctttagtctcattcagctattcaggtaaaagtactgagttaagtggaaagttggttttaaactatgttttgactgtgatggagggagagaggagcagaggagtgaggccacagcaaggaaatgactgtgatgatggatttttgagtctcagactaggtaagaagtagagacgaaggacagtggaaaaatttgtagggtctgttggagttaacaggtttctggtagtgaactggaaaaattagtatattgagtaaagaagctgagatgcttgaaactgagatttttaaggtagcgtagttactggttatcgatatttcattatgagaataggggactggagtgggatggaagaaaagatcattgggtgtggaagtgattaccttctgtggatgtcatttcagtgattaatctgtagagcagattttggtgctctataacatattcaattatttcctcttcatacactgagagtttctgcttcctgttttattttgtttaaatattgcctcaacttgtaaatcacattgtgttgctctgaaatgaagacagctgtaaataagtaaatcgataaaagcaaattttgtttagtcagaatttggccttatcatatggcttgttagagactgtgtagttggtaaattcaaacattaacatcccaactgatgatcctattgcgcattaagctagtttagtcccacataagttcagtgagggctttatgccacatatgtttatctgtagtacattgctttgctgactctaattttgtctttgtctttttataggaccgcagctgaatgcacagctagaaggttggctttcacaagtacagtctacaaaaagacctgctagagccattattgccccgtaagtcttttttgtttttgtttttgttttgttttttgagaaggagtctccctgtgtcgcccaggctgaagtacagtggcatggtctcggctcactgcaacctccgcctcccaggttcaagcgactctcctgcctcaacctcctgagcagttgggactacaggcgtgtgccaccacacctggccaatttttgtatttttagtagagacggagttttaccatgttggccaggctggtcttaaactgccgacctcaaatgatccacctgcctcggtctcgctcacgcctggcctgcactgtaagttttaagagtctacttaaaatcttttttgtatgtttattattagtaaatgagtatctacagattgaactaaaaattaaaaactgaagtctatactgagctgaagaaattgtattcagtaattttcacaattcttgtgggttttcactgtaacttaaggataaaagaattggctactttggctgcgtgtggtggctcacacctgtaattccagcactttgagaggccaacgtgggaggattgcttgagcccaggagtttgagaccagcctgggcaacatggtgagactccatctctactaaaaatacaaaaattagctgggtgtgatggtacgcttgtagtcccagctaagctactgggggtggcagtggtggggttctgacgtcgggggtcgcttaagcttgggaggtggaggttgtagtgagccagatcatgccactgcactccagcctgggtgacagtgaggccctatctcaaaaaaagaaaaaaaaagaattggctactttatttcctcagatagagtaatttcgaaatgtatttttgataataaaactgacttttaaagaaaagtgttttttacatcaggtaaacttgccaattttggtagccattgctataaatgaataagttctattttaaatattaaagagatctaatttaatcccgatgatttttaatttataatgaaaaagatatattaagcatagtatggtgcaacatggaatagcaacttaatttttgaggaggagtagattgtgtctttttttaattgagaaaatctgattattttgtctttggattttagagtttgctttttagaactgcaagctagcacatacacagttaatgatgtgtgtctgtgtatgatatgaattcagttaattttgatttggtttccagtgctaaccttcacaacatattgtttgaaacacatggtaacattttttctgagaagagtgaaggtttactctgtgccatttgtctcatagcatgttgttgtttgtgacttctattgggttaaggttcatgccctgataaatagtaaatagtgatgacaatatataataaccgtttttaatcaatatcagaattaaatgagcaaatagtaaatacacataaagagcctactattaatggtaggcattttatataccaaatattttgttaaatgccttatttgtatatctaacttgatctcatttaatgggtgcaggagcctgactcctacttacaagctatgtgacatgcaacttttttatctgttgggatttcagctcctcattggtaaagctggaataataatagtatttccttaacgcttttaacaaaagattaaatgaactaatctttataaaacttacagcaaatgacttactactatttatttagtcatttacataccaggctaaaggccaagtgctcttctttgtgctgcattttgagtaaatcaaagttgccactcttgtggtactagcattttggtactagggaagacaggcagtaaacaaataattatattctatgtcaggtgctgatgggtgctaagaagaaaaataaagcagatagaggattgagagtgacagtatgggtagggtgttactgttttatataggattagtaagaaaaggactccctggtaaggtaacattttagtctgaatgatgtgagagagcaagctgtgcagatagctgagggaagagggtttcaggttgaggaacagtgagcacaaaggctctggaacaagagtatgcttagtgtgtttgaggagaagcaaggaggccagtgcagctggagtggcagtacaaggggaagagtggtagatgagataggcagcggagggctagatcatgaagaggctttgtagtcataaggactttggtttttattctgagtgatatggcaagtcatgacaagttttgagcagtagaatgacatgatctgacttaggtttgaaaagaattactcttgctgctgtatggatattatattatgtgggaacagggagtccagtttaggaggcttattttacaattataattatagaaaagagatgacatagtggcttggattgggggcttgaggcagagatgatgagaagtagtgtattctggatatgttttaaaggttggaccaacaagatagagagaagaagagtcaagaatgacacttggctaggggcagtgactcacgcctgtaatcccagccctttgggaggcctaagcaggaggattgcttgaggccaggagtttgagatcagcatgggcaacaaaacaagactccatctctacaaaaattagctggatgtgatgggatgcaactgtagtcctagctacttggtagatggagggaggaggatcccttgagcccagggggaggctacagtgagctatggtctgtttgcaccactgtactcccgcttgggcaacagtgagataccctgtctttaaatatatttttaagacatggttttaaaatatcatgactgaatgattcttatgttttgtcctgtgaaactagaaggatggaattacctttatactgataaggggaagacaagtggaagtatggagtagattttgaagtgttcgtatagaatctaggtttttggttttgatcttgttaatgttgaggtgcttattagatatccaaatggagatttagaatgggcagctggctatatgaatctggagtacaaagaagaggcaccagacttgagatagaaataaaggctttattagtatatataatcacagagggtatggttgcctagggaataaaataaagataaacaggagaagagtttcaaggactagccccttggataagccacctttttagaggctagaataaagatgaacatttgcaaaggagataatgaagggagaataagtgaggaaggaggaaaatcaagagtgagtgatgtctctgagaggccaaaggatgaaaaatgtgtcgggggaaaaagtgatcagctgtatcaaatgctgccagtgaggactgaggattgataattggatttggcaatgtggaaatcactggtgaccttgagaagaaaagtttctgtggggtggtggaaatgaaagtattattggagtaggtttaggaaagaatgagaggtgagggcgatgaagacgtaagtatagatagttttttgaggaattttgctgtaaaacagagaaataggatagtatctatatggtaaggaggatttttatttcatttgtgagattttaaagtgtttgtatatgaagtgagtcagtaggggaagaaaaattgatgcagggataagaggggacatttacctaagagggatccttgattaggtgagaaacaatggattaataataatttctttatagtaactcacgagagacattctcatttcatcaatttgctggtatttgactattatggtatgctacctttccagttaaaacttgttctaaatttgggagctgagttgaatcaacatataattaagttgagtttagtattcataaaaaagtagccagacttgtttcctttttgtaattaattttaaattggaataattgggagtgacctgggaaatggaatgttttagcctaaattacaaatatgttgatttccaagttaccccagattttaaaatggatatttgaaaatagttttggctttggtgtgtttctgtgacatgctgactttgtatataacgtataataaatgttataataaacatataaacatataaaaacataaatataaacatacaataaacatatataaatgtgcattcataggcaatttctatttcgttaacataggaagactttataagtatagccaagttttatcttatatggtttccagaagtaattattttcctttccaaggctatcttttttttttttttgaggtagaaaacaaatctttcattgttactgggtgcagtggctcatgcttgtaatcccagcactttcggagcctgaggtgggaagatgcttgagctcaggagtttgagactagcctgtgcaacatggcgaaaccccctctacaaaaaatacaaaaattagctgggtgtggtggcatgagcctgcagccccagctactccagaagctgagatgagaggatcacttgagcccgggaggttggggctgcactgagctgagattgcaccactgcaccccagcctgggtaatgggagtgagaccctgtctcaaaaaaaaaaaaaaaaatattgttctatggcatgaaagggttatgctatttaataattagaaaaatcacattaatcaaaaacttactttaagttttataaatgttagctctctagtacttgcttttcttagtttttattttttatttttttattttgggacggagtctcactctgtcacccaggctggagtgcagtggcgcgatctcagctcactgcaagctccacctgccgggttcacgccattctcctgcctcagcctcccgagtagctgggactacagtcgcccaccaccatgcccagctaattttttttgcatttttagtagagacgtggtttcaccgtgttagccaggatggtctcgatctcctgacctcgtgatccgcctgcctcggcctcccaaagtgctgggattacaggtgtgagccactgcgcctggccttcttagttttttttttttacctttataggcataaatcatatcatggaaaccttaaataaactcagaacctggatatagttgtaactaattaggctgtgtgaaaatggcaagtttttgaaagtgcttaaaaatattgttcatttttatattgatatagattaaatagaataaataccattaaagaataaatattgacctgtcaactgttgttctatcttaatgaattctaatctgtgtgacataaggcaggcacgtttggaggatttaaaagaaattaatttgattagaaatgtactgtggttgaattcagaactaccttaccttgatgtgtaggagacagtatgtgtcgcagagatatatattgaaatgatctcatgagctaaaagtctgaaatgcctttctacatgacttccagatatcttcataccaatcttcttgcttgtcttgcactatgcagaaatatgtcagcaacccctagaatgaagctgtacagatatgcatcgcttaagaaacttattaaatataaaaatgtaatcaaataattggttaacatgaattttttttactataaaacaggtactttgaatattgaagccccccttatacatttaaaatacttgatattagttaacctagtaggactttgacttgatattagttaacctagtaggagtagtatgggagaaaggatacttccacttttcattgtgtaccctttattgtttgacttttttactgtgtgcatgtgttacttttaatataaaaattagtttaaaaaatgtaaatgctaaaaagcgtgtatatagaagacaagtttgtatatagtgaagcatacctgtacagtgctctaccactggatatcatgagacaatcttcatacattatttagttcttcaagttactgaggatgcacagcttatttgtctctaattattgtttgtactaagccataggatattcatgtcaaagtctcaaatcctatatgacagtacaaaaaatatctagatatgcaacattctggttagttcattcttatttgacttcaataactttaataactttccttagctcagactatttaatatttatgagattctattatgtaaaaataaaatattctgaataataactatctaacttggacttttttgggcacaattatctactgatattttttatcaaaacaggaatcttgagggccattgagcaatgcctacaaaataaaagaataaaagactaggtacagcaaaattaaattgagagaggcaatgtggaagctgctgcatttgcaaattatatagggccagttgtcaatcaaattgatcccatctgttcagaggagttttctaatttagtttctagctttttagatcttaccttagcttaagtagatcttgtgacttttcctattgttggaggagatcttcccatttcctctggttcagtcttctcatttcatctagttcaatctttttattttgcattttgctactattaagtagaactaggactattggacctgactttgttgaatcttagttaagtattcctttattattccctgtatcctctttgatgaaaagccttacatagaatgtgtggtagactcttggcattgacagtttatactgttcacctgtgaccctgaaggtctcagaatgaacaagtgaaaatccatgtcctgtagtaattggtcatttttctatggtaagaatttgaattatacccacattggaaggttgctgtgtgggaaactgtcacataaccagtaaatgttcatgagcaatgaatggcctttgcatcctcacttgattgcagttccacagggaaaaacagaaattctggtgtcaggaactagacttgccgacgtaaagggtctactgtgtaggagcaaagggagaagcaaaagcactccctgttaaaagaaggatcaatttttagaggcaaggttttagcttgataaaatgttgtaggtattaagtataattttgtgtttgccttcatgatatgttaggttgggaatcagagtgacttggaaaagttagtggggatggctttttgcattaaggactttaagagcttttaaaagactaagtgggacaggccaggcgcggtggctcatgcctgtaatcccagcactttgggaggctgaggcaggcggatcacaaggtcaggagttcaagaccaacctggcccatatggtgaaaccccgtctctactaaaaatagaaaaattagccaggtgtggtgacggatgcctgtagtcccagctactcgggaggctgaggcaggagaatcgcttgaacctgctaggtggaggttgcagtgagccgagatgtggccactgcactccagcctgggtgacagagtgagactctgtctcaaaaataaataaataaataaaaataaaaaataaaataaaatactaaatgggacacacttttacagtgcatattagaatatctgtagagcttaaattttcattgttttggctgttatgcacaaaagaaaaaactttagccgtttctttagtgaagcctcctttattatgaatgatctcttgataaaacgttgtttccacatacatgtagaatcgcagggtctgttagcgagagaaagattaggaaaagagcatctgtagtgtgatttgattgtcattattctgattttcttcattaccatgtttctgggcgaggataaaggaaattacaagaaattatcttctttgattattatcttcttcctcctttgatgaagtagagttctttgtggtggggtaaagaggcacagtgcactgacagattttttttttcaatactctgcagtgtagcctcgaagttaagaccttttcaacttaagactctccttctctccctgtaactgtcttgtctttactccaagcagacttggaagtcttcagctcctgaatggactgaaaccacgaaatctgagttccattattaatcatgtatttaccttagctaattgtgttttcaaaactttcatcctttcgtgtagttttatagggtatatgctctgtaagaattctcgttttcaggcttattgcttttcctatgccacagactccttcctttcttccttcaaacatgtaaagatctcttatagtgggtaacagtatgtattctagagccaggcagtcctggctgaagtcctgacttggtcctggctatctctgtgaacttgagcaagtttcttaacctctctgttttagtttcttcatctgtaaaatgacaataataataattcctacctcatatggttggagtggggattacatgatttaatactttgaagtacatagaagatgcctgatacataggaagtagtcagtaaatgttactattattatcattatccttttcatcatctcccatgctcagtcactgagatttgttaatttttcttttttagactctatcacatttgcttctctttgcccaccagcactgatagagttccagaccatgacattagtacctcatgcttgggtagagtactgccacaattttcaagagagcttctattaacaccctcctgcctctaattgctagtttgtgccagtgcttttcagtactagactaataacagtttgatattgtcacacccctgcccaagagctcacagcatttttcagaatcttgttttatcaagcccctattcccttacctgactctggcttatcattactctcttcctctactcaggcctgtcttgtattttctcatctaccttatgtacttggacatttgctcatgttcttcctttagtctttaggcccttccttaatgtccttacctttgtactcttattatttctgtcctagccatacataaagaatccaatgattctttcttttcttgttttttttttttttaattttgaaataaagtctcgctcagtcacccaggtggagggcagttatgggaagaatccagtgtttctaagagcctttctggatgttaagaactgagcttggtcaggaacaggattggtagaaatgggagagactcagactagaaagacaggttgatttagagatcagagtatggattggggattagagcctttaaatttaagaatgacaaagaggagctaaagtctgaaaagaagatctaaggtggaaggagcagtttaaggtgtaaggattaggaagtgaagggatggtatatgagtgacaactgagagcaaaatttctagggagtgttgaacatctgagatgtcgctaaggtttgagatagagctgggcagatccagatggaccagctggttttaaggtccacatggacaggcaagatggcgtacttataaactggtaagagaactagttaagatcaagaaccaggtgttagcagtctgaagcagtgagcagtgacgtctcaggcactcagagactggagttgtaacagaataaaataggtctcctggtaaggctctagtatcaaaattagcacaggataacatcaaaactgagtgtgctgagccaaaagactactaaatttccttctggctaagatcagaactgggttgtgagaatattgctgttttgaggcaacttgataggctcctttaccagaggtatagggctagagtgactacgattaattaaggccttcactgatttcagtgaacttagtgtatgttccatattattgagctcccaattaaacgccactactatcttgtattgctgtagtagacagctgtgagtctcattttctccattcatatcttaagctacttcagattaggaccatttttaaaaaagagccttgttgtgatatgattggcataccaatgtgtacatttaaagcacacaatttgatgtttgacctatgtatgaggataaaactatcacaatcaagaaaacgaacatattcatcaccctcaaaagtttccttgtgttcgcttataattcttcctttctgtacctgtacctctttttcccctctcttcccctttctatatatatatatatatatatatatatatataaattttttttttttttttttttttttttttttttaaagaggtggtatctcgctctgtcatccaggctggtgtgtgggcgtgatcatagctcactgtaatatagaacttggcttaagcaatcctcctgcctcagcctcttcagtagctgggactacaggcatgtgccaccatgcctcgctattttctagaattttatttaaatggaaccatacagaataagctatttttgtttgactttcttccattcagtatatttatttttacccccttaaaaaaaagtatagttattttgagtgtcagtagttcacttctttttattgctgaagagtattccattgtatggatatatctctattttttcatataccttttgagaccaggaaacagtcattctgtgcgtgataagagaattgactgaattcggagaccagaggatgaaagggaaaaatagtatggagagaaaacgagaataattatctttgtcttcgaaggaagtgagttgttataatagttgtagggtatttgttttggtctgacttgacttcctgttggtttatcatttttctgtaatagtctgctaatgctactgaagaggagtataaaaaaactcagttataggccaagtgcggtggcttatgcctgtaattgcagtgctttttgaggccaaggcaggaggatcacttgaccccaggagttcaagaccagcctcagcaacagagaactcaggtctgttaaaaataacaaatgagccagataatggtggcatgcgcctatggtctcagctactgaggaagctgaggcaggaggattgcttgagcctgggaggttgaggctgaagtgagccatgattgcaccactgtattgcagcctaggtgacaaagtgagactctgtctcaaaaaaaaaaaacaacaacaaaaaccaacctcaataatcgtgttacatagcaacttcaagtaaacttgaacacctctaaatttgtctttcagacaaaaaaaaattacaaagtatttttaaagtttagaattggaacacagtatagatcatgtgtttcctaatttcttctagaagtcacatcattaactacattgttatttaacatatgctctcaattctgttgtgtttaccataggtactgtatttatttcaaggtttttctttctagaatatcttgattttgaatctgatgattaagtttaaaaatattttgttttgtagccatgcaggatatacgtactgtgggtcttgtgctgcccatgcttataaacaagtggatccgtctattacgtaagtaatgtagttttgttttaagtcggagaagcttgagaatttattgctttgttatagaagtaatttgctttttatacttattgttattatgtactcaatttcatgagggatttgacttttgatgaattttactatactttgtataggttactgaaaacttcaatacttcttttttgttgttgttggagcatttgatttttaccttccctttggcatgtaaaatgtttagttatgaaggttaaatattttgttttttgatatttctttgaaaacccagagatgagcattcttaagaaaaatgcaaagccctctgatctgttttaatcatttcgtaatttaagattctttattgtacttgttaaaattgtggttactgaaaggataatttctcgttgacaggataaggtatttgaaatattttagaatctgacagtgaatttaatatggtgtttgaggcatattaactcttaataattcaatgacagctctgaaattagcttagaaaaaaaaaaacttcctgggaacttgagactcttttaatagtatactactctgtaagaaacttgtgaacttacaagaggttttgctggaaatagtcactcattttatttacacagttaatttactagatatgaaccaatatctggcccttctttgccagatgtacaagctatgtgaataggtaaagcgatcatcttagttctgtcaaatactgattgttaggtctgaattagtagagatgtaggatagttattcaaaagaaatagctcatagcagccatgatttaataaagaaaatcatgcacagaccacttgcctttgagcagttcattcaaagttttaaaacaaaaaagctgttctttcaaatttttatgtagcgttctctgtacattgtattataattcattgaaaattatttttagcaagtttttactaaaaataaagcaataatatttctaaattggtgaggttttggctagccctgtctcatttatgatgttttgaggagcattgttaacaattattccttgatacatgcttaatatataatcttaagtaatttcatgaataagagcaaatagaagttaaattgaaatgattttttagtctgggcctggtggctaacacctgtaatcccagcactttgggaggctgaggcgggccgattacctgaggtcaggagtttgagaccagcctggccaatatggtgaaaccccgtctctactaaaatacaaaaaaaaaaaaaaaaaaaattgccaggcgtggtggcacacgcctgtagtctcagctacttgggaggctgaggcaggggaatcacttgaatccgggaggtggaggttgcagtgagccaagatcgcgccaccgcactccagcttggcaacagagcaagactgcgtttcaaaaaaaatatatatatattttataagcttctttcatttgacttgggcctataaaccagctataataaaagttagtttatataacagccttttctttttgaaaccttcctctatttggcagaagttttattgataaaactcctgtgctgatgggacaccccagagttaaattaggtttaggaatttgtagaggggtatagatagagtttatgttcatagaagtggaaagcatgtgttaaataggttaatggaaagtgagaaagaaggcaaaaggaaagaggaaaaaatggaagagcgccaaggactaagaagaggaagatttaagaagatgagtagaaagagaggcaaatgatggctgatgtgatcgaattattttattctaattaattaattaagtatttttgagacacagtctggctctgtcacccatgctggagtgcagtggtgcagtcttggctcactgcaacttctgcccccaggttcagtcagttctcctgcctcatcctcccaggtagctaggactacaggtgcacgccaccacactgagttaattttttgtatttttagtggagacacgctttcgcctggctttggccaggctggtttcaaattcctgactgcgggtgatccgcccacctcggcctcccaaagtgctgggattacaggcatgagccactgtgcccagcccgatcaaattattttttgtaattagtatataataactgaattctgaatgaataaattttaaggtctaagtgtaaaattaataattgacagtcacagttgaattctcttgaaagaggcactctctgggaattatagtgtctttagagtgctttgagaaagtagaggaagaacatccttagagaaaggttaaattctatactaccactttctattcttaccttccacattaatccatttttgttctatatttcagccaggatcatcttttgaaaatgtaaatgataccctgtcactttccagaatttaaaagtgggtggggggtacaaatatgattttaaaaggcattacaaataacaggtaaaaattattccaaaattgatgatagaatgctgactagcagcttggaaaaagaattggtttagaacctctgctaacaccatccatcaaagtaaatactagttagataagggtattaacatatctggagaggaatttcaagccacagctaatttggaacacaatatgtcttaatgtttatgagacattgttgggaagagtataaaacatgataaattataattaaattacatgaaaaaataactcatgtcataatgtaaccagtggaagcgatgaacggaatgggaaaaatatttgcaaaaaaagacaaaggataatatcaaaaataataaaaatcatagtacttagaggctaaatcatcaaagaatattaactgaaattacaaaaagtaaatgtaattaataaaaataaaaatggaaatatgttttatttttcaaaaaaatggaaataaaaacagtagtgaggtaccaatttaaatgaacagtttgaagaacaatacagctatgtaattcctgtaatccagaactggctagattatggcaaaattagttttttataaaaaaatgcatttcaatggactatatcaggttaatactttaggaaagcaatttgataatatatattaagagtcataaaaatgtatatagttactggcttagaaattcacgttcggaagctctatcctaataagtcccaaaatggaaaaagttaaatgtgttaggttttctacagcagcattgttttttaaagagtctaagtttctgatagtgcattgactaaataaaaaaagcggggtataacattgtgtaaaattgggaaaaaagagaatgtactatatgaggttaaataaattattataacgaatgctaatagtttgcatgtgttttcttatatgagaaatggatatatttttatggtaaaaaatataaaatttaaaagcatttgtgcaaaaatgattacaagttgtggggactaatgattcttaaactgacagaatgattctttgatttataataggactggtcagggtctaataagatttttctttttcttcttctttttttttttttttttgagatggagtctctctttgtcacccaggctggagtgtagtggcgcaatcttggctcactgcaacctccgcctcctgagttcaagtgattctcctgcctcagcctcccaagtagctgggattacaagcgtatgccaccaggcaggcctggctaatttttttatttttagtagagacaaggttttaccatgttggctaggctggtctcgaacacctcaccacaactgatctgcctgccttggcctcccaaagtgttgggattacaggcatgagccgctgttcctggccaagatttttcttttcacagtaactattagggggctgataacttaatggggagtgtgagaggcagcttttgaggtgataatgaagattgtttacaaacaaacttgcctgttctatgaagaattggtagcaaaggttttcaggtgttgttttccaagagaaatggatgaataaattaaagcatatttattttaaaagtttattaagtgactgctatgatccagatattgtggtagtgctagagacacagtgattaataaaacaggcatggttttagccctgtgctgctaaattggtaggtgagatagatattaagcatatgataatgaatatagatatcttattaaaagctaaaaatttaattaaaaagctgaaagtgaaatacagtggttctcaaacatcttggtttcaggaacccttaacttattaaggacaccaaatgtagaccacatctacctttgtggaatgcattcaaaattaaaatgagatacttaaaaaattatttaaaaaagtaaacaaattagaggttaataaaaataacatttttaaaaatgagaaataaatacattttctaatagaagatagtgggaaaagtggcattgctttacttttttttttttttttacaaaatataaaaatgtcttacagttttactagttattaaatctccttttaatgtttggcttaataaaagacaactatgttttcatatctggttatgcattcaccctgttttgatcatttgttttagttgacgtatatgaagaaacctcacacagatatgtagttagaaaaggaagaggagtagtgtaattacctttgcagataattgtggatatttttctttaatactacaccaaaactcaacaaatggtagtttcttaaaggttagttataatgcgaaatctgaagttactatcaatgaatttttgtacttatttttttgagacaaagtcttgctctgtcaccaggctggaatgcagtggcgctatctcagctcactgcaacctccacctcctggattcaagtgattctcctgcctcagtctcccgagtagctgggactacaggcgaacgccaccatgcccagctaatttttgaatttttagggtttcaccatgttggccaggatggtctcaatctcttgaccttgtgatcgacctgcctcggcctctcaaagtgcggggattacagatgtgagccaccgcacccagccgaatatttgtactttgtataaattcattgtctgttttacagtttgaatggctcttttaccctggcataattttgtaacgtgtggagcatttggaaaatttttattggattatgcagatattttcaatgctggtatttcattatatgatagtaaaaaatcactttttgttttgttttgttttgtttatttttcttttttttttgaggcagagtttcgtgcttgtcgcccagctggagtgcagtggcaggatctcagctcactgcaacctccacctcctgggttcaagggattctcctgcctcggtctcccgagtaggtaggattacaggcacatgccaccacgccctgctaatttttgtatttttagtagagacggtttcaccatgttggccatactggtctcaaactgctgacttcaggtgatccacccacctcggcctcccaaagtgctgggattacatgcgtgagccactgtgcctggcaaaaaataacatttcttaatgtcaccatgtattttatcagaaaaaatcattaattctttggaggctatcaagcttacagtgataaaagttttatgaaagtccaattttcacttgaaaaccttaattttatcattgacaacaagtatattattttctttaaagtgctagattctgtttttttttttttttttcccttttgagacaggatcttgctctgtcacccagtctggagtcagtggcatgatcatagctcacgcagcgttgaattcccaggctcaagtgatcctcctattccagccttctgagtagctaggactgccagcctgtgccagcatgcctggctattttttaaaaatttatttttgtagagatgtggtctcactatgttgctcaggctggtcttgaactcctggcctcaagctgtcctcccacctcagcctcccaaagtgctgagattacaggcatgaaccaccgtgcctgacttccattcactttggggaaatcttctgccagctacctaaattggaatagccgtaatttatctacagttgtcttttgaagtaaaaattttgttccatgaggaaaatgtctggttcagcttacaactcaaaactacacaactgctttttcctgaaacatacttccatatgcagcagaaatgttttatcaccacagattgaatgcattttgtcatatagaatattaaaaagatacctactcgagagtcaagatttaatgaaattaggaactcccttttaaacttagtgtgagtaaggttaaaaaataggactgctagtgcatgttgatgatactgctttgatctttgttctaatgggccagtggttttacgctcccctcacctttgcaccataagtgcaaatgaaaaaagtaaataacttccttgcattcttatgaaaatagttttaattttatggactgctgcatagggtcttgaggaaaaccagaattccagagttcacagtttgagaactattgtggtagaccttaagagggtgacttgatttaaattgtgggaaaggtattggggaaagtatctccgggaacagattttttttttttttttttttttttgagacggagtcttgctctgtcccccaggctggagtgcagtggcacaatctcagctcactgcaacctctgcctcccgggttcaaacgattctcctgcctcagcctcctgagtagctgggattacaggcgtgtgccaccacgcctggctaattttttgtatttttagtagagatggggtttcaccatgttagccagatggtctcgatctcctgacctcgtgatccgcctgcttcagcctcccaaagtgctggcatttcaggcatgaggcactgcacccaaccgaggaacacattttttaagccagggtagccaagcaatggggaacaatagcatgggtgaaaagtttgaagtaggcaaagttgttggtgttatcaaggaactgcaagaagaccagtatacatcaggtattatgatcaaggtgggcaagagtaatagctaatttgctagggcatttaagagtgtagagcccattttaaggattctagattttatcctgtgaccatgaaatgccataaaaggctttaagcaaggaaagtgatatgatctatgtttccagaaaatcactttgactgtttaaggaagtttaacaatgatacattttagttcttttccatattggtagttgactattattaaaactctaaaaactcagaattcaggatgtccttaggtagtagtaacttgattttgatacatatttttcagcaagccttgcaggacagaaaaagagagcaaaaaggaatgctttttggggccagatgacattttattctttggttaaaatgtcttcacttcctgtgaaacacgtttacaaaattacttatgttccattatttggactaagtagctgaataaacagtcatgagggtacacactcaggcagcttatacattgggtgcacagactatcattgcaaatgtgaattctctattatagctattatatatgaagtacatttatttctaagagaatgcctactgatcttgctccttccccccattttttcgtgttaaaggttttttttttttttaacttgtgtatcaccgatgatgtgctaatattgaaaagttacgcctttaaagacaaagcaccttgcagtcaaataaaggaagagaaagtggcattgcttctaatgcctctattatttatttctcttcaaaatatccctgtggccttggtgtttacggatctagcattctaacaaagaaaatgcatgaactttaatgtacactattcattttttttgttagcatttagctaacaaggagacccattttgagattacggctggtttaaatgtcccattttactttcctttcaatgacatttagctttttctggttttgtttttagatatattgcttttaagggttttatattgaggggacttaaacctttttttcttattatttcttttaatcaaatatggaacttgatttggctattggtgagttttctaccaaaccagaaagaatctgtagagtacagaattggttaattcagattggtggggctctttttccttcatctagattggggcagacaaaaaggcaaacaaggaaagtagtcaggtatcagaagagttaattaggcttccagcagacctctggtgtttatttctggagcagtgtatcttttggctattgttagaaccttattacacttacttaggaaatttatgtatgccttgaatttagattgttattttaaaaatcacttcatattttgactgtgtgtttcagattttccaggagtgctctgatgttaaatatcctttctctctgtcttttcatattttcctcaatcagaaaaatgccctttctcattatttgattcttggttcatatactacctggccctagtcaggctacctaaacatttctgagttaccattctctatagcccacgtaagcctttaatttaaaacaaagtgtcatgttatttatgtgctattaagataggtgaccagagtgctatcttttagtttttcttcatttagaaatctatagatttgactttttttttgaaatggttctcgaattgatgatagaggtgatgacaagaagtgaggattagcagtgctaataattacatattgaaggaagagaggtagaaagattctgtcgtctataaggaacttaaattaacgagcaagaaacaatccagttgaaaagagggcaaaggacatgaacagacacttttcaaaagaagatacatacgtggccaacaagcatatgaaaaaattctcataatcactaatcactagagagatgcaaatcaaaaccacaatgagataccacctgataatagagtggcggttattgaaaagtcaaaaattaacagatgctggcaaggttgtggagaaaaataaatgtttatacattgttggtaggagtgtaaattgattcaatcattgtggaaaacagtgtggcgatttctcaaagaacttaaaacagaagtaactctgggccccgcagtcccattattgggtatgtacctgaaggaatgtaaattgttctgccataaagacatatgtacacatgtgttcactgcagcactgttcacaatagtaaagacaaggaatcaacataaatgcccatcagtggtagactagataaagaaaatgtggtacatatatacactatgtaatattacacagctctttaaaagaatgagatcatatcacttgcagcaacattgagctagaggccattatcctaagcaaactcccgtaggaacagaaaacaaatactgcatgttctcacaagtagaagctaagtattgagtacatatggacgtaaggaagggaacaacagacaccgagacctactggagggtagaaggtgggaggaggatgaggataaaaaaactacttatggaatactaggtttattacctgggtgtccaaataatctgtacaccaaaccttggcaacacgtaatttacctatattacaaacccgtacaggtacccttgaacttaaagtaaaagttaaagaaaaggataatctgtttctgaccagaaatggcctgtggatgaagtcttaatgtttgctgtatgtgctgtcttaaggaggttttgggactctaaactgagaatcacttacccacaactttcttttttttttttttttcatagcagaacaacttaatatccacagctttatctcctccctgcaatttatgaagtaacatataaccaataattggttaattttcttagctgtaatagaattttatgagaataaatacattgctaaagcacacattccctggcctgcaaatttttgacagaaaagaactagctcatctctcagcttttgttcattaattgagcaatcagtaatacttttctagctacatagcatatcatatattttcttctcatagttttggctttatgagtctgtaagttttgtatgtgatgtgggaaggttggttcatatgaattttggagaacagagaaaattgatagttttggaattcagattgtagggcaggtttgggtatttgacagaatgagaggaaattaacattactcttgatgtcaagataaagagattgtaaagatttaagctacactttagctcagttcttttctttagactacagtgcaaataacacataatctagtttctttgtttttgagaatgacttctacttgaatgggaatagagaaagcttattatatagaattcttttcaacaagatgcctttttcaccctaccatggaagaaatatggaaatagctttatcagaatgcttttttataatggatattttgtatagatatttagaattttatgctattatgcatttttattaaaatcatggtggatcttagaaggttattttagaatgtgttagaattttgaaattttagtagcttaaatgcataaaatccatttaataaaatacagcttctgaatacctgttgcatccttgtcattgagagtatagagattattttatgcatagtgggttggtttactgtattaattgataactggtatttccaagtattgaatatgattctcttaaaggccatccaacaaagacagaaataaggaattgaacttaactgaggagcaagtcattattaggtgtattagtttgctagggctgtcataacaaaataccacagattaggtggtttaaacaacacaaatttattttttaacaattctggaagcttgaaattcaatatcaagtttctgtcagggttgggccccttctgacatgatcatatctctgtgcaggcatacttctggtgtctctttttcctataaggacaccagactcattggatgaggtccccactctaatggcctcatttgaacttaatcgcctctttgaagaccttatctctaaatagcactacagtctgtgctactggggattggttcttcaacatgtgaattttggaggggaacacagttcagccattaacagttggtaattaagaaggaaaacaagtgatttgtaagaattacttttttctcttttatttaataaggtttgtgtagaagtgcaattgttacgtgtttttttgttgtgtatctcctagccggagaattttcatccttgggccttctcatcatgtgcccctctctcgatgtgcactttccagtgtggatatatataggacacctctgtatgaccttcgtattgaccaaaagagtaagtatatagaaatattatagctttcaaatagctaatgttcttttaacaggacttgtaaattaatttaaaaacttatgaatatcataagtaatatctcaatatttaaaataaaaattgttataactaatctgcataaaacagcaaaaaaagaaactcttccatatccctaaaaggcaactagtgttttttagctagctacagaaatctgtcagatctgccagtgtgcagattgtagtggttacattaatattcagaaaaatgccatgtactcagtgtaccaggagacaaaaaattagtacccataccaatttcataaagattctgggcgtgttaatttacttccatgtaacgccacttttctcactgtaaatagataatgctgataatatctttattttctttcaaatgatttttatgggaaaaaatgagcctttaattatgaaactctgaaagaaaggtgctatataaatgataaatatattttatttttaaacatgcctacaattttggttgatttatttttttccataggcgtccagagtcacgtttttatttagtagttcttacacaatagatgtataaagtaaaaatcttttgattttataaaggtattttttcttttgggggggggagtaattttaaaaatatagaacagtataaagagtactataagaaattaactgatgtacttaacatccacaatttattcagaatttctcgctcatcctgaacccaatttaccttcccagaagtaaccaccttcatgatctgggtatatgtcctttcagttagtcaaattattcacacacacgcatgtacacacacacacacacacacacacacacgtgtatgtgtgtgtgcatgtgcatgtatacatatgcatatatatgtacacacacgcccatatgtgtgtatatatataaacacacacacacacaccccgacacacacatatatatatttttgtttttagagatggggtctcactccgttgcccaggctggagtgcagtggcatgattatagttcactgcagcctcaaactcctgggctcaagtgatcctcctaccccagcctcccaagtaggtaggactacaggcacacatcaccaaacccaattaattaaaaatattttttttggtagaggtagggtcttgctatgttgcccaggctgatcttgaactcctggtctcaagcaattctcctgtcttggcctcccaaagtgctgggattatcagtgtgagccactgtacctggcctcaaattatatttttaagtatgttaggggtgctattgtttcaaagaattttgcagaaatttcttgtatagaataaaagagtcaaggcctagtgtggtggttcatggctgaaatcccagcactttgagaggctgagatgggcagactgcttgagctcaggagtttgagaccagtctgagcaatgtggcaaaaccccatctgtacaaaaaaatacaaaaatctgctgggcatggtagcacgtagctgtaggttgggggagggcatggggcagcgaggtaggaggatggcttgagctccggaggtagaggtttcagtgagctgaaatcattttgctgtccccagcaaaatgctgtcacccagcctggcctgggtgacagggtgaagccctgtctccaaaaataaataaataaatataaaaataaaataataaaagagtccatttgcaagaaaaaattcttctttcttatttttggcataagttttcataatttgaggctttaggtatcacacaatattagcaatttgttaatgcgtcttattaatgaaatgagtatttctaaccttacttcctgagagggttttagggaacacattttacttttaaaaccttgttggggcattcagaaaattttaattttgggtagcttgccagtgaagaaatagagaattttttcaagaaaagaggtcatacaaccatttatttctttctttgatacaggtaaacccatttaaggatctaattataaaattggttctattctatgctaaaaatattcttatacatattttttacatgttaacttttatctttttcttgttccacaatattcaattttaagcacagttcatcagaaaggcctgaattactaggtgttttaaagttgggacggtattgtggcgaatttatattttgatccatcctacaagcttaattttgaattttcaggaaaatagcattagtgagaattttctcttcttggtatggcagaaacctcaggtgtgaaataataccacacattttattaaaaaacaaaactcagaaactgtgcttttgacctcatgagttaaatagactagtggtttttccatatttcagtaggaattctaattatgttcttgctagcatgtactgattaaagtcaaggaaaagcctagacccgaaggtgattttagaaataatgaaaggagctgatgaagaatttaaattatcattttttatataactatgtaacatatacaaatgatgagtaagtctttacacgtattactgttttacctgttacataaaaactagttctgtttttttctctttctccttactctccctccttcctttcctttctttctattgttttgttttgttttaataaaaatgagaatattatatggtgtttctgtctcttgccaaaaagcatgtagttttgtgttactgggtggaatctcacaggataaggatatacattaatatatttattttactgtattttgaaatctctttagtttacggagaactgtggaagacaggaatgtttgaacgcatgtctctgcagacagatgaagatgaacacagtattgaaatgcatttgccttatacagctaaagccatggaaaggtatattgattgatataagaaatccccaggaaatcatagacattaatttctttggtaatttaaaactagtaaatcctagtaattatcagggtaaggagattaagatgtgagataaaaaattgagacaagaatgtcttaaggtggattgttggttttgaatagtttgcctatgaaggctgaacatacgaattgacatgatggttttattaggtggaagtattaaaaaacccatgggtatgtgagtgtatgtgggtatgtatatatcttgctttgcttgtattttattcattagacatttctttatctcagaataataattacattcttttatggtacaatgctataattaatcgtaaaattttaggcttgtatttaatgttggaggtcatttatttcaaccttgtgcaaggtacatgaatctcttttatggtatgctcgacagactgttacgtggtacctgctaaaggtcttcctgtgatgggctactcactgtactgtgagccgaacgaggacagggacaatatctattttgttctctactgtataccccaccgcctagcacagtgtccagcacatagtagttattatgtattttgataaaataaaaaaattatttcaagggttttcttcttttagtgaaacatttggattaggaggtcttctcttttgtaggtttctctaatttttaaaaccatttcctatatatggacttaatatttcatatttagtttggcagttctaagtatggtaagatgattccttctggatttgttcattatattagtaaagtacatgatgctctgtacgctctcagtaaatattaattaaatgtactaataaagtctaagataacattatattttttatgttgatgtagcttactgttggcaaatgtacttgtgatcagccaaagcccaaggccttttcataatattcagatggattattttctgttctcagacttttgtgtggttatttcttttttaccctaaatatgtatgtcttctcaattattgctgtttagtttttcttgtttagttcattatcgcagtctttttggattgttttccactctaattctgtattcaaagtattatttacttttctcaatcttttgtctgcttctgctcacaatgataaccatgaggaattatataaatctgaagaattttcaaaaaatcagtgtgatactacattataagcaatataattttagggtttttaatacatcctaattcttcagaaatgtgaaaccatatatattacttcttgaattgttgttgtaatcagaactttctcttcttcaaccggaaaagacaattgaatattgttattcactgagatgtttgcatattttgtcatgagaaaatataatttagacttaataaatactaatactttgggtgcagtggtgcttgtctgtaattccagcactttgggaggcggaggtgggcacatggcttgagcccagaagttcaagactagcctgggcaatgtggcaaaactctgtctctactaaaaatagaaaaattagcggtgtgtggtgtcgggtgcttgttgtcccagctacttgggaggctggggtgggatgattgcttgagcctgggtggttgagactgcagtgagccgagattatggcactgcactccagcctaggtgacagagtgagaacctgtctcaaacaaacaaacaaacccaaaaaacaataagaccaataaactgacaacaatatcctcaaggaggttataacaaaataacatttttattgttattttaaaagtaaaacatgtatattgtggaacatttaggaaaatagaaacttaaaagccagcaaaccaaattcctatttataattcccccttttaaatagtatcaaataaactactgccacattacattagggtccctaatattgacccttagatagtacttagtgtcttttctttgtagcattagttggactcattacctatgtcagttatttattactaagtaacaaaacctcttacttaaaattacctatattagttatcttttactaagtaaaagtaacttagtaaaacttagatttaaactgtgacttaaaatcacagctgtttattgcctaaaatttgggggccaggaattggggcagagaacaccttgctccggtccacaagacactgacttaggtggctcaaatggggctacagtatctcagatagcatcactcctgtgtcttgggccttagtgctggctctctgttgagacccctcatttcttctccagctgacctgtttgttcttcaagtaggactttttttttctttcttttttttgctactctctagaagaatagcttagacttcttcttctttttttttcccccttctgtttttggatcaagagagtaaaaccagaagtttctaggcctattatgtcctaggctggaaactacatagcacatttccagtgaattgtgttttccaaagcaaataagatcactgtgtcagccaagatttaaggaaaaaagcaatatattgctcctcttgatgggaggagtagcatgtatatacaggaataagagaaactgttgacagccgtctttgctgatagtctactacagttcttcctctggtggacaattcatgtctctttaacatgtcatatacacccagccctcccaggatgttcagaaatcttacttgctatgaccctaggctcaaaatctattatcttgtgatctccatcaagttaggatgtgaatgaggctccttgagtgtggtttctctttttttggagaagtgggtgttgggggaaagagtctcagctctgttgcccaggctggagtgcagtggcatgatcatggctcactgtagcctctgcctcctggtctcaagcaatcttcccacctcagcctcccaaagcaatgggattataggcatgaaccactgtgcctggcctctttttttttttttttttttttaaaaagagacagggtctcattctgtcacccaggcttgagtgcagtggcacaattataactcactgtagccttgaactcctaggctcaagggatcttcctacctcagctttcagagtagtggcactacaggtatgtactaccatatctggctaattttaaaaactttttttttaagagacgggagcttactttattcctcaggctgatcttgacctcctggtctcaagtgagcttcttacttcagcctcccaagtaatgtcttagttacctattgcagcataacaaatcacctcaatgtatgcattttttttaattgaaaacaaattttttaatttttgtgggtgcatggtgtatatatggggtacatgagaagttttgatacggtcatgcagtgtaaaataatcacatcatggagaatgggatattaatcacttcaagcatttatctttagtgttccagacaatccagttatattcttttagttacttaaaaatgtacaattgagttattgactatagtcaccctgttgtgctaccaaatactagttcttactcattttgttttgtatccattaaccatccccacctaccctttagccctccactattcttcccagcctctggtaatcatccttctactctccacgtctgtgaattcagttgctttgatttttaggtcccacaaatgtgtatttttttcacttacgattctatagtttggaaatttggtagggtcagtggagataatttgtctctgtttcatctgctgccaattgaggcagtttgacttaggctaaagactccaagatgccctagcttcctctctggggccgtggtgctggttgtcttcttgaggcacatcagttttcatcttggttctcgtctatctctgcctgttgacactcacccttcaggacttctctcttcacgtggtgaatcctctctagcaggatagcaattgagcaaaagtagaaatttccagccctcttaatatcgaagtctagaactggcacagcatcacttatgcctcattctactggtcaaaccgcatcataaggctaaattcaaggagagggaactagggatgctatttttgatgggaggagtgacattgagcattgagaggtgggaagaatttttggtgattggatttgtagaaactgtggttaaatagttgacggattatttgtatataagtctgtgtcccttccatggtagttccataatgttttctgcctggagcaactagtcttgaccgtatctgctatgcatagcacagtacctggtacacaaaaagatttcagtaattgattgttgaatgaattaataactgtcttgccattttcagtactttaattatttttccaaaaagtggatcaaatgttctttttttaaaaaaaaattacatgtttttttaattttcaaaaaataaaaaaaaaaaaaaactcttaatcatctttggctacaaatactcttgttttaaactgcttttcttgtcatgaactcatttccctgtcatttttttactccactttataggctatacctgagactttctagtaaagatccttgtaatgctttaatcagttcttgaccatttagcttttaagcttccccccatttttcactattataaaccacattttgtattttttaaaaaatagatgtctaaggtattatttaaatttctgcttttttttttttttttttttttgagacggagtctcgctctgtcaccaggctggatcatggctcactgcatcctccgcctcctgggtcaagtgattctcctgcctcagcctcccgagtagttgggattacaggcacctgccaccatgcccagctaatttttgtatttttagtagaccttgttggccagaatggtctccatctcttgacctcgtgatccgcccgccttggcctcccaaggtgctgggattagaggcatgagccaccatgcctggctgcatgtttttaatagatttaaaaattgtattcattagagctttttaaaaaaatagtagtctaaaggagaaaacataaaatgacttacaatctcattgctcagttaactctactgacataaaaaatatacgtgcatggttagaaaatgtaaatagagtcaagaagtacaaaatgaatggtggaagattctggttctactcagccagtgtttactgccagtaaaggtttttatgcatacactaacatatatttttgcatatgtaagtttgtgtatatatgtaaaatttatacatacacgtttatgtttgagttaaaatatataaacaagagatcatatcttatacactttgttctgtttttttgcatatattaaaaagtttttttcttatgattactttcttttgtatgtcaccatatattatctttaatattgaaatgcataataaattttactattataattgctttttttttttttttttttgagacagagtttcattcttgtcccccaggctggagtgcaatggcatgatctcagctcactgcaacctccgcctcctgggttcaggtgattctcctgcctcagcctcctgagtggctgggattacaggcaagtgccaccatgcccagctaatttttgtaattcttttttttcttgaggcggagtcttgctctgttgcccaggctagagtgcagtggcatggcacaaccttggcctgctgcaacccccacctcccaggttcaagcgattctcctgcctcagcctcccaagtagctgggattacaggcgcccaccaccacgccagctaatttttttgtatttttagtagagacagggtttcaccctgttgaccaggctggtcttgaactcctgacctcaagtgatccacccgccctcggcctcccaaagtgctagggttataggtgtgacccaccgctcccagcctataattgctttttataattgctcttgagggaggttcaattcagattcagttaggatatatagaaatcatgtagaaaaaattagtatcttccaaaattaacagcattaggctgggtgtggttgctcatgaggcctgtaatcccagcactttgggaggctaaggcaggaggatttcttgaacccaggagttcgagaccagcctgggcaacaaagtgagtcccctttctccaaaaagtaaaaaaaaataactggatgaggtggtgcacacctgtggtcccagctacttgggaggctgaggtgggaggattacttcagcctggaaggtctagttatgttcatctgttatgtttatccatattgatgatatttttgagttccctaagtgagaatgctacattagatgcttttatatggcattaaatactactcctacctaagcggtttttcctgttcttaacatcttgaattagtatggtacatttgttacaactgatgaaccaatatcgatacattattatattaactaaagtctatagtttaattaggattcactctttgtgttggatagtcttacggtttttaccaaatgcctattatgtctctgttgttataataccatacagaatggtttcagtgccctaaaaatcagtgcttcacctattcatcgccttcttctcccctctccctgagtgcctagtaaccactgatcagtttactgtctcagtagatttgccttttcttgaatgtcctacagttgggaatcatgcagtatatagcctttcaaattggctttcatttaacgacataccttcaagattcctccatgtctttttagagcttggtaacttctctttatcactgaatagtatttcattttttgtttcattttgtggatgtaccatagtttgcttatccattccacctcctgaaggattgttgctatatttaattaatatctaccttacttactatccttttctaatcattgccaatcttctccccctttttttttgtcttccacttttttcctgccttctctggttttaattgtgtgttttatatgactataattttttcctctcatcatatcatttatacatatatatgtttatattgtttttattactgtcttttagtttttgcagcatacatttacaactaatttacaactttctttattttttatttttttgagacgggctcttactcttatttaggctggagtgcaggggtgcacaatcttggcttactgccacttccacctcctgggctgaagggatcctcccacctcagcctctcgagtagctgggactacagacatgcaccaccatgcctggctaatttttaaattttttgtagagacagggtctcactatcctgcccaggctggtcttgaactcatgggctcaagtgatcctcctgtcttgtcctcccaaagtacaggattacaggcaggagccactgcacccggctaacaactttcaaataacactatactgcttcatgggtagtagaagcatcatgtgagggtctttctaatttctccctcctgtcccttatgacattactgtcatttgtttcacttatccataagctataatcaccaaatacattgctgcttttattaatttgaacaaattatttgttagatcaattaagaataagaaaaaaatgaaataaaatattttattttaccctcatttgttctttctctaatgtacttgcttgcttgctttatgtagatatagttttctgacctatatccttactcttctctgagggacttcttttaacatttcttgcaaggcagatctaatgtctaaattgacaaactccctcaatttttgttagactaacaaaagctttatttcttctttaattttgaaagaaatttttcctggatatagaattctaaattagtgggtttttttctttcgctatcagcactttattttatcacttcttgcacggtttctgaagagaaatcttacataattcttatcatttttatgtttcttatcatttttatccatgtttgtctattgataaagtgtttttgtcctctggtttctttcaagatcttttgtttgtctttggttttttgcagttttaatataatatacctaagtgtcaatttcttggtatttatccttcttggagttctctgagcttcctggatttgtggtttggtgtctgtcattaattttggaaacttctcagtaattactgtatttctttctctccttctgctattcccattttatatgtgttataccttttataaattttaggatttaaaaaaatttctttgaagaatgtcattggtattttgataggggtttcattaaatatttaaattgtgttgggtagtatggacatttaaacaatattaattcttccaatccatgaacatgggatatctatccagttttttatgtcctcttcaattcctttcatcagtgtttcaaaattttcctggtatagctcttacacttctttggttaaatttattcctaggtattttgttttgtttttggtagttattgtaaatgggattgctttcttgatttctttttcagtttgattgctgtttgtatatagaaatgctactgatttttctgtgttgattttgtatcctgcagctttactgattttgtttatcagatcttagggtttttggtggagacttcaggtttttctaaatataagaccatgtcacctgcaaacaaggataatttgactttttcctttacatttggatgccctttatttcttctcttgactaattgttctggctaggtcttccagtactatgttgaattgaagtggtgaaagtgggcatccttatcttgttccagatcttagtggaaaggctttcagtttttccctgttcattgtgatattagctgtgggtttgtcatatgtggtctttatcatgttgaagtatgttccttctacacccaatttgttaagaggcttgttagatgaggtccaagtcctgcatttctttcagttactttcccctgttattacacaggtgccctgttgatgtagtggtaagatgaggagaggagacacattctataattctgtgatcagttgtaattcttttggtgagcctgtgccactggtctgtgacttaagaagttcttctcagattttctcccactttaggtcagacaagaaggctggagggggctggatttgggtattacttttactccaagtctgttaaactcttgtaaggcccaattttgttaggctctggtaaaatagtttctcttgcagttaggcatttttgtaaagagaacagaatactcagtgaagtgggtatttgttggggcccttggaagtaaaactttcataaagccttctacagcttgattccttggctctcaggagtttgtatctctcagggtagtccacatttagtctccagcaattagttcattaccctttaagtattcctgctagctccaagggtggtttaggattctctgattctgtccatacttccagtttttggggcattggtttgctctgtcacctcaattctcagatagatctgataagagttattggtttttaattcacgttttttttttcctgtcaggataagagtaataccttctaaaatctttacatgttaggttagaaactggaaatctctttcattgttttttttactctcaccatatgggaggaagtctgaagtttcctgaaatcttaactagcacctgtttatatcactacctgttttcattcttaaggaagattcagtgcattctgtagacagtcactttaagcactgtgtgggtaggactggagttaggaagagagggtcaagggtcaagaatgtttaggaaaaaaaggtagacatttacaaatctgagcttctttcatttttttaaagaaaactcctctaaatgaattattgaatgacccaagtaccatgtaaaggaattataccagtttatagctctaatttcactatttaaaatttgctattttgtggtggttgtaaaaagaattttttttaccatttaactttaccaccttctgaagaatacacagaataagagactcttttctgatgtctctcttaaccacagattaagaataatgcattttatatgtgggagtaaataaataagttaatgaaactcattttggcttccaaatggtaatttttcatcttttctgttttgctagttgtactagttgtgtgtatgtgtgtgtgtgtgtgtgtgtgtgtgtgtgtgtgtttaagacacggtcttgctcctgctggagtacagtgatgtgatctcggttcaccacaacttccacctcccgtgctcaagtgatcttcctacctcagcgttccaaatagctgggaacacagatgcacaacaccacacctggctaatttttgtattttttgtagagggggtttcgccatgttgcccaggctgatcttgaactcctgggctcaagtgatctgcctgcctcagcctcctgaagtgctgggattacaggtgtgagccactgtgcccggacttactagttatgttttataaaaattgggttgtttttaagataacatttactgtcaacattttaagatttttaaaattttggttaaattgaatttttcaaatatagtagatgtacctaattgtactaatctatgtttaaggatggagaatacaaaaataaggaaacaccctatttgttttctcatcttgtagccttgtagaagagataagaaatgaatataaatgattataatataattcaaaatgtactaagtataattaaagagttacaggagcagagagtagggatttgggaggaaagaggtaatagttgagttagggaagcacagaaagggcttcattaagggggtggcatttgaatggattttgaaggtgcctgcagttttcatgggattaggcataaggttttaatgagaaagggagttatgtacacacaaagtatttagtagtaggaaagcccagagcttatttttaatagcaggaaactatttggcttaacttgcaggagttgtaaaaggcttggctagtaactgagatctgtttgtagatgttttttgtctgggttgcatagttagaaaaaaatttttttatacagatatttatagctagatattggtcctaccattccctattatcttacaccttgtctaccttttcacacatacgtaacaccaccctggggctggaggcatttgagtagctgacttatagagatacagtataagaggggcagaattagagaactggaaaatagattggaaccagattatggagggaattgaatgccgttgtaaaatacttgtattttattctgtgactggtacagagctaataaaagttcttagcaaaggaaggagtgatgattgggactgaagaagaatagcactcctaggctgggtgcgatggctaacacctgtaatctcagcactttgggaggccaaggtgggcggatcatgaggtcaggagttcaagaccatcctggccaacatggtgaaaccccatctgtactaaagatacaaaaaattagccaggcttggtggcgtgtgcctgtaatccaagctacttgggaggttgagaaaggagaatcgcttgaacttgggaggcggaggttgcagtgagccaagattgcgccattgcactccagcctgggcgacagggcgagactctatctcaaaaaaaacaaaaacaaaaacaaacaaacaaacaaaaaaaacaaaaacaaaaacaaaagaatagcactccttggccgggtgcggtggctcacgccggtaatcccagcactttgggaggttgaggcgggtggatcacgaggtcaggagttcgagacaagtctggccaacatagtaaaaccccatctctactaaagatacaaaaaaattagccaggtgtgggtgtgtgcctgtatcccagctactcgggaggctgaggcaggagaattgtgtgaacccaggaggcagaggttgcagtgcccgagattgcgccattgcactccagcccaggcgacagtgtgagtgagactccgtctcaaaaaaaaaaaataaagaaaaaaagaatagctctccttgatggtgtgatggcaatatgaaggatggattggagttggaagaaataaatagaaatagtgtagtaaaaaaatcatgggggctttgaaccaaggcagtgacaggtggggtaacaaactgaacagatgtgggagatgtttaagggttagaatcatgaggattctacacagaattctatgcagatagaaatgttcctatgtgagacagttaagatgaattgaagagaatatgaagttcaaggccttataatattgccattatcagaaatggtaaagccagaaaagagtgtaagtttaagagaatgtagggtatggaaatgttgacttgtttttaaaaacatgcaggaatttctctatgattctgacagcaaacttggccagtttataagattgtgttgcttcatagtagcttcaaatggttgagttttaaaaatagagtttagaatggctctctagtacctgaagtatgccctttcttagaaaaactttcttatcatcatgcctatttaaatggaaatttggaaagatttaaaaattaattttgggaatctcattgcattcatttaactgatcaaacagtaaagatttataatgacttaaatgttaattttagttcagtcattgacagctagcttacccttcttcttcccctatcctctacttttttccccagttctttgcctctgatgttttctggatctttttttgtttcttttttggagataggatttcactctgttacccaggctggagtccagtggcatgcttacagctcaccacagcctccacctcccaggctcaagcgatcctcccacctcagcctcccaaatagctgggactgcaggtgtgcacccccacccctggccaatttttatattttttgtagagatggggtttcaccatgttgcccaggcttttcttgaactcctgggctcaaggaatctgcccaccttggcctcccgaagtgctgggattacaggcatgagccattgcgcccagcctgttttctggatctctgtagtttattttttcttacatgaatcacagtattctgcttaaattctatatgcatgtctctttggtctgaaagtgaatttgatcaagagaaaaagatgagagttcttccttataggactctttaaaactgcagtgatgattcttttatatcactttgcctttaacacctgtttgaaactttcatgaccaccctcacatttggcgattctctagagcaggggtcctcagctggtccgtggcctgttaggaactggactgtgcaacaggatgcgaacggtgggccagcgagcattacccacctgagttccgcctcctgtgagatcagtggcagcattaggttgtcataggagtgtgaaccctattgtgaactgcacatgtgagggatctaggttgcgtgctctagaatccagttacaggtgtgtactgttctcccttatgtggaggtgggctgcatagaaagtacatagtatttctgcccaaagaaggctgctttaacatttaaaatccaggatttttattggggactggtcatgtaggcattctgcctgtgtagctagccacagctaccaaaattccaggctctcagaaggaaagtgtttactgtatgtaatcacattgtttacaaacaatctcagcaagctggtatagcagaattcagtgtcccaagtgggtaaaacagccttatcaacataagtaatattctaaaaaccaaattcacagatgctaaccaaggaccagtcttacaaacaggcccttctaaagattgtagcatcaggcctagctatgttaactctcaggtaaagctcctatgcctctttcccagttacaggctaccatattgccattctgtatttttgactctctgaaatgccatcttaacctttattatagcttaggtttcactggatcttaagatttttactttcctttctgattgtggcctcaatgaaggtcttcaaatgttagaaatagagaaaagtagatgtgcttttatataggtagtctttaaggaatggaatggcttctctctggacgtagaataaaaagaagccagagattctcttcctctgcccagtttaatgacagtcacagagcagtggcatttttcaaatgttttctttttctgtgacttttatatttacagttatttgtatatttctgcatatgtcttacagttaaatttttttatttttggttttagagcatttactgaggtttttagagcaaatgtaactttatgtttctcagtttcctctttttctgtatgttgattccctttgagtattaccatatctcctatcagcaagagcatttttaagacgtatagaacatgagtgagctccagaataatagcaaatcattctttgttggtggtaatggaatagtttcagtttctatgaccacgaaaagcctaaagaggaggtagcaaaagacatttgagaagattagaatatattttatcagcgtaaagattttttatatttacccacataactttttgtccccccccacccccctgtttttttctgtgagtattttcaaactgaaaggggagaggagaataaatcacagtggtattactatgacaacaaccttggcaccttaggggtaaggatcctgtcccttctgactggctaactgtagttgttgttacagttggtttaattctcctcacatcttaagatactgggactgcttctagactcattaggaaactggaagaatttgtataggaaggaaaatttgcatattcgtcaatgttatacagaggagaaatgttcaaattaatggcaggggaagattaagcaaataagtatttgtatatttcataaatatgtaaatatttaatttgtatatttcataaatttgttaatatttaaacaaatttaaaattttaagattttaattatttatataccacaaattaataaaccactttcaattaaattataatgttttcttatcgcgtgtatttttttattagaattcatctttttatgttagaattagaatttagaattttcatagtctgttttagtaagagcattggtaatacagtgtttctgtttttgttttaaagtgaggggctccaggagtttgaggctgcagtgagctgtgatggcaccaatgcactccagcctgggtgacagagcaagatcctgtgtctaaacaaaaaaaaacaaaacaaacaaacaaacaaaatgtgagggggaggttcttggatttcagctcttttatcttggattgatacatttcctgcagcatggtttaagctataagacaaaaaaagaagggctaaaagattcctctgtgttactaaagaattagcaagaacctggtgaggtattattaactgttttttctgtttttttcagatggcaaaattgaggcttaggatagtaatctgctgtaggtagcagcttgtgagtggcagggatggattttcttttttttcttctgcaacagctttattgaggtatgatttatacactaaaattcactcatgtaagagttcaatgatttaacttttttttttttgaggcagagtcttgctctgttgcctacgctggagtgcagtggcatgatctcggctcagcgcaacctccacctcccaggttcaaatgattctcgtgcctcagcctccttagtagctgggattacaggtgcacatcactatttttagtagaggtggggtttcaccatgtgagccaggctggtctctaactcctggccttaagtgatccgccctcctctgcctcccaaagtgctgggattacaggtgtgagccagcacacctggtctaaaaaaatttgtttttaagattaggggtcttgctatgttgtccaggctggagttgaactcctgaactcctgggctcaaagtatcctcccacctcagcttcccgagtagctgggacttacaagcatctgctacagcaccaggtctcaactcaatgtttttttttagtaaatctacagagttgtgtaaatattctcacaatctagttttagaactttttttttttttgagatgaagtcttgctctgtcacccaggctggagtgcagtggtgtaatcttggctcactgcaacctctaccttcctggttcaagcaattcccctgcctccgcctcctgagtaactgggattacaggtgcacgccaccacgcccagctaatttttttgtatttttagtagagacggggtttcaccatgttggccagactggtcccaaagtcctgacctcaggcaatctgcccgcctcagcctcccaaagtgttgagattacaggcgtgagccaccatgcctggccagaacatgttttcatcaccctaaaaagaaacctggtgttcatttgaggtcaatccttgttcttactctcagtctcagacaaccactgatttgctttctgtttctagatttgcattttgtggaaatttcatataaatggaattgtacaaaatgtagtctatttttcacttaggatactgtttttgagattcatccctgttgtcgcatgtcttggtagttaattctttttttttttttttttttttttttttgtgagacagagtctcactctttcgctcaggctggagtgcagtggcgtgatcttggctcactgcaacctccacctcccaggttcaagcgattcttctgcctccgcctcccaagtagctgggacgacaagcgtgtgccaccacacccggctaatttttgtgtttttagtagagacagggtttcgccatgttggtcaggttggtctcgaactcctgagctcaaagtgatctgcccatcttggcttcccagagtgttagggttataggcatgagccaccacgcccagctcattcttttttattgccaaataattattccattatatgaatataccacattttgtccatttaccggttgataaactattgaacatttccagtttttggctattatgaataatggtataaaaattcttgtacacatttttatgtcaaaggaaactgttgggtcatatgataagcctatattttaattctttcagaaactaccaaagtgttttccaaagtgactgtaccattttatattttaggaatagtgcatgaggcttgcagtttctttacatcctggccaatatctgttattgtcagtatttttgattatagccattctgatagacatttagtgtaatctcattatgctgttaatttgcatctccttaatgactaatgatgttgagcaactttttttttttttaaattattgtactttaagttctgggatacagtgcagaacgtgcaggtttgttacatagttatacacgtgccatggtggtttgctgcacccatcagcccatcatctacattagatatctcttctaatgctatccctcccctagtcccccactccccaacaggccccggtgtgtgatgtttccctccctgtgtccatatgttctcactgttaaagccccagttaatgagtgagaacatgcagtgtttggttttctgttcctgtgttagtttgctgacaatgatggtttccggcttcatccatgtccctgcaaaggacatgaactaatccttttttatggctgcatagtattccatggtatataggtgcctcattttcttaatccagtctatcattgatggacatttgggttggttccaagtctttgctgctgtgaacagtgctacaataaacatatgtgtgcatgtgtctttataatagaatgatttataatcctttgggtatatacccagtaatgggattgctgggtcaaatggtatttctagttctagatccttgaggaatcgccacactgtcttccgcaatggttgaactaatttacattcccatcaacagtgtaaaagctttcctgtttctccacatcctctctagcatctgttgtttgctgactttttaatgattgccattctaactggtgtgagatggtatcacactgtggttttgatttgcatttctctaatgaccagtgatgatgagcttcttttcatatatttgttggctacataaatgtcttcttttgagaagcgtctgttcatatctttagcctactttttgatggggttgtttttttcttgtaaatttgtttaagttcttcgtagattctagatattagccctttgtcagatggatagattgcaaaagtttctcccattctgtaggttgcctgttcactctgatggtagtttcttttgccgtgaagaagctctttagtttaattagatctcatttgtcaattttggcttctattgctattgcttttggtgttttagtcatgaagactttgcccatgcatatgtcctgaatggtatagcctaggttttcttctagagtttttatggttttaggtcttacgtttaagtttttaatccatttaagttaatttttgtataaggtgtaaggaaggggtccagtttcagttttctgcatatagctagccagttttcccaacaccatttattaaatagggaatcatttccccattgcttgtttttgtcaggtttttcaaagatcagatggttgtaggtgtgtggcattatttctgaggcctctgttctgttccattggtctatatatctgttttggtaccagtaccatgctgttttggttactgtagccttgtagtatagtttgaaatcaggtagcatgatgcttccagctttgttctttttacttaggattgtcttggctatatgggctcttttatggttccatatgaaatttaaagtagttttttctaattctgtgaagaaagtcaatggtagcttgatgggaatagcattgaatctataacttactttgggcggtgggctgttttcactatattaattcttcctatccatgagcgtgggatgtttttccatttgtttgtgttctctcttattcccttgtctctgataaaacagactttaaaccaacaaatatgagaaaagacaaagaaggccattacataatggtaaagggatcaatgcaacaagaagagctaactgtcctaaatatatttgcacccaatacaggagcacccagattcataaagcaagttcttagagaactacaaagagacttagactcccacacaataatagccggagacttaccgccccattatcaatattagacagatcagtgagacagaaaattaacaaggatattcaggacttgaactcagctctggaccacgcagacctaatagacatctggggaactctctaccccaaatcaacagaatatgccttcttctcagcagcacattgcactcattctaaaattgaccacataattggaagtaaaacactcctcagcaactgcaaaacaacagaaatcataacagtctctcagatcacagtgcaatcaaattagaactcaggattaagaaactcactcaaaaccgcacaactacatggaaactgaacaacccactcctgcatgactactgggtaaattacgaaattaaggcagaaataaagaagttctttgaaaccaatgagaacaaagtcacaatgtaccagaatctctgggacacagctaaagtagtgtttagagggaaatttatagcactaaatgcccacaggagaaagagggagagatctaaaatcgacaccctaacctcacaattaaaagaactagagaagcaagaggaaacaaattcaaaagctagcagaagacaagaaataactaagatcagagtagaactgaaggagatagagacacgaaaaacccttcaaaaaaatcattgaatccaggagctggttttttcaaaagattaacgaaacagatagaccactagccagactaataaagaagaaaagagagaagaatcaaagagacacagtaaaaaatgataaagaggatatcaccactgatcccacagaaatacaaactgccacagggaatactataaacacctctatgcaaataaactagaaaatttagaagaaatggataaattcctggacacatacaccctcccaagactaaaccaggaagaagtcaaatccctgaaaagaccaataaccagttctaaaattgagggagtaattaatagcctaccaaccaaaaagcccaggaccagatgcattcatagctgaattctaccagaggtacaaagaggagctggtaccattccttctgaaacttttccaaataatggaaaaagaggggttcctccctaactcgttttatgaggacagcatcatcctgatactaaaacctggcagagacacaacaaaaaaagaaaatttcaggccaatatccctgatgaatatcagtgcaaaaatctgcaataaaatactggcaaaccaaatccagcagcacatcaaaacgcatatccatcaagatcaatttggcttcatccctggaatgcaaggctggttcaacatatacaaatcgataaatgtaatccatcatataaatagaaccaatgacaaaaaccacatgattgtctcaatacatgcagaaaaggcctttgataaaattcaataccgcttcatgctaaaatctctcaataaactagatattgatggaatgtatctcataataataagagctatttatgacagacccacagtcagtatcatactgcatgggcaaaagctggaaacattccctttgaaaaccagcacaagtgtgtctcctctcaccactcctattcaacatagtattggaaattctgtccagtgcaataaggcaagagaaagaaataaactgtattcaaataggaagagaggaagtcaaattgtctctgtttgcagatgacatgattgtatatttagaaaatcccattgtctcagcctaaaatctccttaagctgataagcaacttcagtgaagtctcaggatacaaaatcagtgtgcaaaaatcacaagcattcctatacaccaatagtagacaaacagccaaatcatgagtgaactcccattcacaattgctacaaagagaataaaatacttaggaatccaacttacgagggatgtgaaggacatcttcaaggagaactacaaactgttgagcaatttttatgtgctgattatccatttgtatatcttcttttgtgaaatatctattcatacatttttgcccaatttttattttggtaatttgttgttttattgagttataagagtatttatggagacaaattccttattagatatatgatttacaaatatcttctcctaatgtatgacttgagttttcattttcttaatgaagagcagaagtttttcattttgttaaattcagttatcaactttttttcttgtatagattctgtttctggtatcaaatttaagaaaactttgcctcctccaaggtcatagaaattttttcctttgtttcgttcttgaacaagagtcagcaaattttagcctgtgaaccccatctggcccacagcctacttttgtaaataaagttttatttaaacatagccatacttttgtatttacatattgtctatgcctgctttttctctacctgaactgttgagcagttgctatactgtactgcccagaaaacttgaaatacttaatggcccctttcaaaaaatgtttgctaacccctgttctagaagtgttacagttttagctcttatagttctaggatccaattttaattaagttttgcatatggtgtgaagcaaagagacaagttcattattatttttatttttattttggtgtatggatatgcagttgtcctagtactatttgttaaaaactctcctatatgttagaagttattttcttctcgctgctttcacgatttttttcttgccaggcacggtggctcacgcctgtaatcccagcactttgggaggctgaggcgggcggatcacgaggtcaggagatcgagaccatcctggctaacacggtgaaaccccgtctctactaaaaatacaaaaaattagctgggcgaggtggcgggcgcctgtagtcccagctactcgggaggctgaggcaggagagtggtgtgaaccccggggggcggagcctacagtgagctgagatctcgccactgcactccagcctgggcgacagcgagactccgtctcaaaaaaaaaaaaaaaaaaaaaaaaagatttttttcttgtgttttgttttcagctgtttgattatgaagtatctgggtgaggatctctttgtgcttatcatactttggatttgttgaatttcttagatctgtaggttaatgttttttcatgagatttggaatgttttcagcagttatttcttgtaatatttttactgttccctttctgaagttcccattatatacatgctggtatgcttgatgttgtttacaagtctccaatgctctgttctttttctctgttctgattggttaatttctttatctgtaatttcacagactgtttcctatataatatcaaatctgctcttcagaccatctggtgaactcatttgaattttttatttcggttactattcaactctaaaatttccacttggttctttttaatagtttgcatttatttctttgttgatattccctatttagttatatcatcataactttgagcatggcttcctgtagttctttgaatatataataactcctttgaagtttttgtctgctaaatccaatatctgctcttactcagatacaacttctgctggctgcttatttttcccgccgaatatgggtcatagtttgctgtttctttgcatgacttataatttcttttggaactggacattttgtgtagtatgttatagtaactttggattcggtttttactcattttttcccttgcaggttgtatttatttatttattaggaactttcatgaacttcaactgcagaatctgtctctcccactatgtgtggtcacttatgtgtctccccagcttttaaaacttcttaatttttaattttaagcttggctttgtagggttcccacctgcaattccttaatttagtgcttagctaattattggttgaaggctgtacctaaacaccttgagccagaaagactttcaccctctgctgggagattgtatggaggctgtgaagggaggatcacttgggctcagagtttgaagctagcctgggcagcatagtgagaccccatttctcattaaaagaaagaatcaactaagtatagtctgttttcatgtttgtttcttttactttttattatgttgtcttagacctaagaccctgtgcacgtacccaaattttctgttagccaggcgtgtgtggagagctaggtctctcaggtttccagcttcccctgtgcatacgctgccagtctctcagcctgcgttttgtgtggagcttaggaccttatgggagtcccctgtacatgcgtgcagcctcctagtcagccagtgttgtgtggagggcataggtctctcttcaggatgtgtggaaaatttatcaagtctctctatggctgtgccatttctaggatctgtctattaaatttctagttagtcctcaggtttctggctcaccccaacaacagcaatctcggactaagaaatctgcaggcttttctgtttcctactgagtgtgggttttccactctctgctccaagtcaaagtcatcccctttttgcaatgaaggtgctgttccttgatggaacttatacctcagtggagctagggtaggggatggaggcagctcctggtaagatgccaggtttccattgttgttaccaagaagttctgtagtttttcatgaacatgctcttctcattgtttttgtttgtttgcttgtttgtttttgcctttagttgatttccataacacaaagatggttgtttttgacgcttttatctagttttataattgctttttgggggtgagattttgtattccttcactggaagttcaacttcagaacttggattttaaatcctagtagtattacatttcaaagctaaatgctcttttctctaattcatgagtatttgtctgtggagatagagaacaagtaattttttaaaagagagatgacagaggggtggataaatgagcctcgattcaagtcctaggtttctacagaggatagaattttatacctccttacagatagatttgtaagctcaaactgaggttaattgaagggattaatggctcttgtggagagtagacatgtgttgtttattcagagtgagccaactcttgtgacgaagtacctttcctatagtgttcttcacttcataacaattttatgaagtaagtattgtaattatgatcattttacagatacggaaatatatttacaattcgggaacttacctatgctctgaacatttgtatgtggtggggatggcacttgaacccatttcttctggtttctccttgttctttatactctgtataactgtttcccaatcatatcataattactcacagacactttgattatcttaatgtatttttttatgtaggtagtagttgaggttagaataattaattcttttctttcaattgacaatcagtcttaactaattgaagagcccctattcagtcagggagttatttagcaaactggtaacagttagagaaagagatcctgtggcagcttcctctgccagcttcctttttttctcttactccatagatgcagattctgcccaagaagcccctgcattgcagagggactggagatctgtatgatctgtttatttcgcaattgacagggtaagggggccttatgggggaggtgcttgggtgccctaaatttagctttatgcagctgggctaacatttatttggggattatttaaacttagtatttttaaaaacttttgtgaattttgtttgtcctacatcagttaagtgccagattatcatattaaaaagcatttattataatggtgatttttttaaaaaggtcctgttgagaacaaatcagacaaacatgattcatgcttctaaaataccaaatctgggatcatttagaatataaataatattgaatatatataagtaaaatttcacaataacatttttaaaaaaggttttgaatgaacatctgtttctatagctcatcatagttattctttattaatctactttgtttcttttccataaatctgtcaatctgtagagtgaaaaagggacttgtggatatgccataaacattgtgggtgggtgtggtgtctttttctgctgctagaaattaaaacttacttcctttaattctttgtctattctagatgccaatgaaatttgagttgtatttcagactgtcttgtatctgatcattaggataagtgtaaaagtgcagttgataaaacttacgggagccaagattaagtttttaggtctcacttggcaggtttatagagcaagtgccagaaatgatggtttttataataggataggattaaaataggtgaggaagagtttaatggtcttttataatcacagaaggatttggcagatgactgtagccttgataagtacttgaaaagaattgaattggtgctcttctgatgggcttgtttttattttttgagatgttattatacctggtagtaaaatagctttttttacctaaagaggtagtatatatttctgtagtttaaatggatatttttagtattctgtatgactcatatttttaatcgtacccttgtaccctttaaacatttaatttatggattttaagaattcatcaataataattacatatgttatccttaccactattaatacatattccactttctaatgccaacacatttggaaaactttcatttaagcatcttaaatgacattttttttttttctgttttctttaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtaagttctagattttaacatatcatggtagatgttatatacttctggttaaaggtatcttttcattctaagctctgattttcagttttttatcactttccttggaaagttttacttctggcagcagtgtttaaaagtgaataaaaaatcttttgatcctttaaaaaggatcagattacaatagtggattatgggtacatttccaaaggcgactggtataattggattcacactgtgaaggcatccttgtttagacacttatttagtgggagttaagatcttttaacctcatttccaagtaggtgtgtatggtagattctctgaagttagttttggtggataaatccaatgttctttagagtatagaagagcactgtgtgctgtgccagtccttttccacatttccttttttgtaattagtcttttttttttttcccctttggtgcttagtttttactcacaattgccatcagtttaaagctaccctccaaagattataaaatattggctattaagcactgtggtcatcattggtaatgtttttataagggtaaggactcttgagtgattttttgattattgtaagagcaaggacacgtcacagtgagtacgttgtaagagaagtgagctgtttgtggatgcctcttttagtaaacgttgcttctacagtctttggatgcagtttgctttcctttatccattactgtcccagaatatttctaagttttgttcgttttaggacatctctttgacctattaatttattggtttaagatgccaatatctgttcatttatcacttatttctttgattataaggaaacctaaaatgtaagaccataatttttaagatacaacgctagaatagccaggagaacatccttagtgaaatatagggagccatggcattttatgtgtcttacccactgattgccagaattgattcaacatttatctggcctgcttgggctggtgtcttctcttgcttctatctctgaatggccttttcaaagttgagatctcagttcaagagaactatcttttgtaatggtacagattagttttttgcataaggtacttagcctcaactggagtgattttactctcaggggcatttgataattcctgaagacagttttgatcaccacaactgggatatggtttggagggtggcaatactaatggtatctaatgagtagagtccagggtagctgctaaataaacatcctgcagtggcacaggatggctcccacatcagagaattaccaggcccaaaatgtcagcagtgctgaggttgggaaacccagatttttaggatatgcaggtagttgcacttcctttccaaccccccagagaagctctcagggttcttcttctttttttaaatctgtttttaatattcagggttctttaattactgattttattggttagctggtttgctacctttggcagaagttacattttatggatataagtatactacttagatctgaaggctaggtagatgcttaaaaggagtgcctttctgtggaattttgaaatgtaataagtgaccttgaaaacttaagtatcattactgcaaaacagcatattttccttaatattgtgaatttgtgttggtaacaaagcatgtctgtatgttttgaaaattaaaattcttgaagcaagtgtcccacacctccttcatttttaaggctcttattaatcacttgatttacataattagttcccttgatattattttttagaacctgggctttctctctaggttggcaacctgtgcaactgtaacataaattcacataaaacgtcagtaaacatttcaatattgctcttttctgtggaatcatcctttttacctcattaataaagaattctaaagtaaccaaagcctagtccactgctatatgtaactacagtggctgagagagaaacataaatttgttttaccttctacctagattcttagaaaattattgaggttgttttgtctcctgatttcttggaaattttggtatctaaattgtaagataggatttccaggtgatagttacaaaaaagagctcaaaaattttaaagactcataaataatagttataagaattatccagagactaaaacattttttagatttatgtttggtgtttaagtagtagaacttttcaagtgttcattttttagtatcatcatcattaataatactcattaaatgttttctttgtacttatggaaagcaccgtgctactacttattgagaaatatgttggggttctggggataagtgaaaggtgtaacatagataatattccaaaattgatagtcttttcactaccacagtaattcttgtaaagtgagatacattttctcttttgcatgctgactaaagtattatgaattattgaccagttatgggttaagctatctaaagaattaagtttcatgtttctcacattcatattgtagtggcgatgggtatctttcctaaattagtaagtgtgccatattatcatctcaaaaattcagctttttctcatgaagataatacttaatggtttttctttctttttaaagagatactatacagcttgatttttattatatagaagcaatcataacactgacttctaaatttcacaggagggattcagttcctcatgcatgcagaggtcttaaatggttcattgagtttcctcttaacacactataaatacctgaattttttggggaaaaaaattattgcagtacacttgaaaaattactcagctacacacagtggaagtttctttgttttgattattagattactggcagtgactacactgttcatttctagtcattggttctctctatattgtgcctaccttttgcagaaagtgaagtgaaaaccttggtgatagagatattccagatttttatctgtaaattggaaagatttttcttgttgaccttatttgttagccagtgttctttataaacatgatttattttcttaaatttattttactttaaagatgttcatctttcagatgccttgtagcttttatttagacttgaaaagagacattagagaaataaaggtagacgtactgaagtactctcaagttttctttctagttgagttaagccaagggagagacaggaacctagattccattatcccccttctttcaatcccctcatttgagttccccaaaaagaaaccctgcatttcagttcctgccttttattgcatcaccagtcttgtacatatagaaatgccagattatatttctcaggcaacacttaaaatagtttcacctcatttcatcctttctgttactagcaggaagtagattaagtgaaaagacatttgccactagtctgtgtgctttaccatggttaaataaattgttccaatactttttgtgcttattaagttctatatcctataggatggctccgtatgagagaattttgtctggacctattttaattttttcagttagtagaattttcattctgttttctcaagtttcagttttggccttcttcatatatgtgattgatatttgtgttttcctgaccttcctgaaatttatatttctaaatttagattgttggcagctttcattaacgtaattttcacttctaagaagtttctaaatgaaattggatttagtgaaaatatatttttcaaaagtggagttatgaaccgggtatggtagtttgtgcctatagtcctagctatgtgggaggctgaggcaggaggattacttgaatctagcctggagaacaagtgagacctcatctctaacaaaaaataaacaaaaagtaaaagtggacttcatgctttatttgatttgccttttatggtggttttacaaatcagtttagataagtttacttggtgaatatttatgacatatatttttttaaatatgagaagtttactgtagtcttttcagcaattttgaatttttatgcatacatttatatttgttttggtttacataactacctttttataaatacataccacttattaaaagtggcattcccctaaatatttatgaaattgataacattcagatttcttctttactgtatattaatgtgattattcatgcatactcttcctttctgtcagtctcttgggtataaggctgttgctattttctaaatagttaaataggtttgagtgtaagttagctaattcttaaaatgtaccttaaccaagccatcatatttgtcttctcaaatatttgtacatgcagattttacatatttagtttttgactttttgcagatttgagataaggctaatacttatacattagcacttcagattgaaagcatgatcgtatttagcttttaaaagagattaccttatttgatgctacttacataatatttcctttatgaaatacattttttctttggtagtgatttcaattatgaatgtccccaggttgggtccttagtatagaatggcctaataatttatctcacaaggttgttgtgaggtttaacttaaatatttgaaagtggcttagcatataaacgatgtgattaagtaaatgtgtgacagtataatttttattttatgtatctgaaaatctatcttattgactgatcttttgggggctttatagatcaactttccaaggtcattatttatttttgcagttcagtgcatagcttaatgttgaggtatttactgttcttttaccttttgttttaaggtacttaaaaagtagcattggttcttgtaccattcattgttatgtttgtcctcattagttgattgttgtgtgttaaacagacatccctggagcttattctccacactctgtgaatccactcattaatcaccagtcacctttggagatgggaaaattacttacctgtatttctttttctcagaaagcgtgctctggaatggattcacaaatgagctaccctccttccctcaaagagtaaggtttctgctttacaggatttttttcttgggttatttttcctctcatcttttgaatttgaaaagaactgagggaaggcacctgaagaaactactgacatactcactaggggagttccaaagcttgtgctgcccctaggggcagtgtcaatggctcttaaagctagaaagctcatacttggagttgaaacaggggctcaaagaatccattttcccagtgtaccttctgaaaggataagtttcaggtaagtaattttctcttactatgtgatacgctttattcatacttaaaaagtacaaaagtccagttctccaggtacatgggcaattgtatttgtttatagtttagattcataacctttactgaatgtcagaaacacaaaaacttataaaaataaaatatatttgctcttgagatacatataatttattttaagtcaataatacatttttagttaaaggtgtatttatgatcagtttattgtacttgtgctataattttctttattattaaataaaattttgagacacttttaaaataataaaaaccaaaaagtggtattttaaactcagtttctaaatgatgattgactaaagttgtgtgtgtgtatgcagacatacgtaaatacacacatacatataggctatgatgatgacaactatttacttcaaattagatgccttctgtatgtatattgaccagaatacattgctcaagtgatttttaaatatttgtataatttttaaaaattaccatgagacgatttgagctgttgcaactaaaatatttattcagtgtagtagctatatgtagtgtggatttagctacttaatcgaaacattctttagagtccttcaaatatttatagtcagtttttcagttactaaatatgaggtggctactaaagagtaacaaaaagtagatggcatttactgccattggctctctgtgcatttttgcattctcattaaatcccatgccgatccagtattttaaagtatttcaaacatttcctctttttttccttcagaagcagtttttaaaaagtgaaagttacatagaaaatggtccatatgaacaagatagcaatttaaagtatagacttttcacttactgttaagtctgggttgaccaacttcagccatttggaacagcaactctttacttggaattaagcagaaaagacttttgagtagcaaacgactatcatgtagtatatgcgtttttctctgaacctgggagtagcagtagattatgtcccagtttcagggcttactgatagtagccaaaactaacagctatttccagaagcagggaaaagagaatgtattagtgtaaacctaaagcagttcaggttcaaagaattgaggtgtatactaccttgatttcctccaagaatattgttcttatagtgagagtgagtcagaatattcttgtctaaggtgttcatttgtttcagaaagattttggacagctttgtcaaaataactttgaaatagaagtaaaaatttagtatcaaatgaattgaatcgataaattattataactgcactttagatttggcactgagcagccttctcacagccacctggcaatgagaaaaatagtgtcaggctgggtgtggtggctcacgcctgtaatcccagcactttgggaggccaaggcaggtggatcactttaggtcaggagtttgagaccagcctggccaacatggtgaaaccccatctttactaaagatacaaaaagtagctggatgtggtggcacatgcctgtagtcccagctactcgggaggttgaggcaggagaatcacttgaacccgggaggcagaggttgcagtgagctgagattgcaccactgcactctagcctgggcaacagggtgagactccatcttaaaaaaaagaaaaaaagaaaaatagtgtcaattatatagttattagataattctcattgttatgtatgaagtattaatatatacattctttacagaaaaataaagctataccttactctaaattttaaaagaaatgtttaatgaattatcaatatagaggcattgaacaataaattatcattgttttaagaattttttttttagttcaaagactatagttgatctcatagctaaggtaacatgcagtaatctttattgttttattcaggaagcagatattgtttcagtccctgttgcccaattctaggatatcatcagttaagttataagatgcaatattgagtgaataatggctcttgggagagaataaggactgctacattgagtaattatgttactgtatacgaaaagttaaaatgtgaacattaaggaaatatgacatattttagaaaggtgaccatcaaaggtgatcagtatcaacaaatgaatgaagtgtttcagttctatgatgtgtggtttttcagaaaaggacatcaaagagggttttataattttgcactgcccatcatttacataatttttttagtaagatgaacagaaaacttaaaaatcttaattatctagccgaagagttccatgtcttcaggtgtgagggtggtaactggatatatcaacattgctctgaacgtgaagcacaagacacatgatgtgtgtacatgatttgtatggtctaattcctttagaaatgcattttggtcaatctttaacattaaggaaatacaaaagtaatgagttcttagaaaaaaggcactgctaaaagatttaggtgtatctgaaatacgttgcagtcagttgagtaatactccccataattagttaagaaaatttttaacttgattttcatgtaactagtaggaaacagaatttattttctgagacttttgttttctgttttctctttaagcttctttcattttaccttctctattctttggagaatagccaaaacattgaatgttctatgcttataatcttattgagattttatgtcagggtaggaatatttattatatttatattatatttacccttttgtgtattctgttcacgttgcataaggcacttgtattgatccttttccaagttgtgcaaaaatgagataatttttaaaaaatttacttcataaaagtcacacaagtcacagtatttgcgacctcatggtttttttttttttcccccgtaatagagatcaaaactttgtacagcaaaagctaaggcttttagtgatttgttataccaagatagttttcttaaaccaaatattcttaagtaatattctttgggtttactttccaatatagactgataaaatgtttaacaatgcttctaacttttaagctattttgtttccttaatcttgtatttctggtgattttaaggtttctacaatttgaaacagttcttaacatcataaaacattggtgatatcatttctttattaccttcccaaatgtgccttttatttttatgtacaagggctcttgggaatgattctctcagaggcttaagctgtgctttgcctttcatgagaactgaaattatttggtaagcgcttgctttctttttagcttctaatttttccctattttattttgtacatgatatttgtttcaaggtcaaaggttccgttacagttactatgatgaatcccagggggagatttatagatccattgaacatctagataaaatggtaagtctttcaggtgtgggattttaatgctctaaggctttttctttaatttcagattagtaattcaagacttaacatgttgaaataatatattttttccctatctttaaatgtacaaaatgcaatgtgtcatcatataaatactgactataagaataatccctattctagtaggaatttccgtcatcataattttgtttgattaatgagaatatttaagaataatatatacggatttaaaatactttctagagaagtactttagctttaggaacagtaagatactaataccattatttactgttaagcagtaataaccatagcagatgatgggataccttgactctaattcctgtttgtttcacgactacctgaaatatttttttttgagtccttcttttgactccttctgaacagcattgttgttttttaaaatttattaaataacttagtatatttttagttttgatagcagaccaaattactgttcttaagtgatgatgaagattttatgaattagctaataaaaatctgtattctgttggaggaattatatgtaaacttgaagtaaataacctgaaaattttagactgaaagtctttattttttaaattattgcccctttacctctggaaataaaagacatcatagccttatgatgacagtgtgcaggaattccaatatacacaaaatgtagctaacttgaatcttgtctgctatgctgaagggatttatacatatactttattttaaaatttaaaatttcaggcatgtttgttttgttttgttaatttatttttattatttccttggaccagcagtttgacctgacagaggcatatttattttggaactactttttttttccttcaaatttttagaagctctcaaaatctaaaattcagtggaattaatattttaaacataataaactcacatcattgatatatttctgtaaaatatcctgtaaatcagattgttatatatctaatttcatttttgttttgatttgcatttcccattgatcttaagcatgcatattaagatatttcttttttcctttttttaagagacagggactcattccgttactgaggctggagtgcagtggcacatcatagctccctgcaacctggaattcctgggcttaagcaatctcctgccttagcctcctgagtagctgggactataggcacatgccaccatacccaactaatatttatttatttatttatttatttagagagaaggtctcactctgtggcccaggctggcgtgcagtggtgtgatcttggcttactgtagcctctacttcccgggctcaagcgattctcccacctcagcctcctgagtagctgggacacaggcgcctaccaccaagcccatctaatttttgtattttttgtaaagacagggtttcaccatgttgcccaggctggtctcagactcctgagcagaagtgatctgccagcctcagcctctcaaaagtcctgggattacaggcatgtgacaccgcacccagcttttttcttttcttttctttttttgtagagacaaggtcttgctttattgcccaggctagttttgaacacttggcttcaagcaaccctcctgcctcccagagtgctgggattacaggtgtgagctgccgcacttggcacatattaagacttgaactttatggcctggagccttcaggtatctattaaaaagagctataaaaaaagcataagaaaacaaaattatttttacagatgcaaataatttgtttttttctcttcatttgtccttttgctctttttacaaattcttagtgtattgtcttgtttttgggccatttggatttttctttttttcctttttctgttttttttttttttttttttttttaaagacaggctctcactctatcacctaggctggagtgtagtagcaccatcatggctcactgctgcctcaacctcccaggctcaggcagtcctcctacctcagtctcctgagtggccgggagcacagatgcataccaccacacctggctaatttttttttgtagttttttgtagagacgaggtttcgccatgttgcccagactggtctggaactcctgagatcaagtgatccaccctccttggcctcccaaagtgatgaggttacaggcatgagccactgcacctggcctggatttttcttaaaaggaatttcaattcgttgttctaaacacagaatttttaaatataattatattcttacctagctaaggagtacagtagatgttgatcctactgtctttttttcttgaagtgccatggtagtcataatattttttcttttccttcttttctttctttttttatttttttgtgagacagtgtctccctctgtcacccaggctggagtgcagtggcacaatcacagttcactgcagcctcagcctgctgggcttaaacagtcctcccacttcagccacccaagtagctgggactatagacatttaccaccacgcccggctaattatttttatttttattttttagagatggggtttcgccatgttgtctaagctgatgatacttattttaattttttaaataacacaaataattttaggatttactcataaatagtattaaatatagcagaacagctctaacttgctctctatgaccactgacagattattttaatactctagttttcatttccttatctggaagaagatagacttggactaaatggtctctaaattgtctttaaattctgtcagcttgtaagtcttcagtttgttcaaatcagctctaccaatgtgttaagccttatgcatatgttttagtacaagattatttggtttaaagtagatcaaatattttagtaaggaatctggatttgaatgtataaatagaatatatcatgtagtatattttattaaagccaaatgtaatgaatgtaaagttggttacttagtgtgtttatcatgtttaaacttaccttagttgctactttaaatccaattattgtccaatacttttacctttagaattttatttggattttaatgtattaccttctttttggcttcctgatgttttcatttcagttgtttaactctcctttgacttctagtctttttattctgaggtttagttctcagttgcctcagaaaactttttctggctttttccatatagcaaatgattaatgattgtcaaagcaaatggttaatgggtatctgctatatgtccggtactctgtgcagtattgaggacataaagaagagaaaacatagtccgtgacttaatggagtccagtggttgaacatacttacaaagaagccattacaatatagagagctgagagacatttaggaggtagaatgaaaaggactttagggattaattaggtgtgtcatgttaagggagtggtgggatgtgggatgatttctggcttccttgtgtacatagatgctgatactcactaatacagggaatataagagggacagatttaaggaaaaagatgagttcagtcttatacatgggttttgtgttatgtttagaactgcactttttgatactgtagccaccagtcacatgtatttattgagtatttgaagtgtggttatacaacttgaaatatactgtaagtgtaaaatatacactggattttgaacatgtagtatgaaaagaacaaaaatatctcagaaatctatcttgattatattataaaatgatactgccagattgtgtttaataaaatatcttaaaattaattttacctgtttattttttaaatatggctataataaattttaaaattacatatatggcctgcattatatttttattggacagtactggtttagaacatgaaggtaggtctggatggagataaacattttgaaattattggtgtatgaggagtggatgggaagaaaggatgttaatgccattgtttagagagtcaatctccagagagagtataaggagtaggaacaaagggggagttagatcagatggacataccagcattaagtggaagaggagataaagcagagccagtagagttctgcttagagagaactgagaatgagcaatatcacagagaggatgagctttatttagcaaagagggaggaagagtatcaaatgctgcacagaggtgaattaagaaccttgcaagagcagtttcagtggaatcagcttagaatctaaattggaatgaagaggcaaaaaccaaatgtgaaaaattattctctactagtttgagtatgacagaaaggagcaatgtttaaatgttaactgatttggtagatgacgagatccagggaaacacagtcacaggaggagtttttaaagatggaaactatgagattacttcagaatttccagtaacattaatccctaatttgaggtattggagagatttgacttaagattatatcagctatatgattctcgtttctcctcggtttaacctttcttgtgttacattttattcatttaggaaagaatctctaaggaggaatggctgcatatatgtgaaatataaattattaatggtatgcatgtaaattttcccgtcattaaaattgtctttttttggttaggtaaccatacagaaaataattttgaaagatacctcagtactaaaaattttcaaagtaaataaagtcttcctggacatggtctttagcaagtttgtactaaattttatgaaagtaatgctttttgcaccaaaaatataaaagaactcctgccagaagcacgtgctcaaacaccgtacataatttccacttggatgtcttataaacagctcatactaaacatattccaaacggaattcctgattttcttcccaccaagacctgttctactcataggctttcttaattcaaatgatggtggtcctatccttccactttcctaactggtcttcttagacctaccctggtattcttcagtctcaggtggcttaaagtaggaaccaaagcaattattttaaaatctaaatcagatcatgttactcttctgccccatatctcctgtaaaattgccccctttcagtcagaataaaagccagtgtctttacagtgggtagacaaaaaggaccaacatgatttgcagcccccaaatgttaagagccctccattttcttacttttactcttccttcactctaccgtggacacactaatctccttactgtgccttgataatgtcatgtatctgcctagcttagggcgtttgcccgttttgcttagctctcaccttctcactggggccttctgactactctatttaattttgcatcctacatcctacccttgcagcattcccagtccaccgtaccctgttccactttttcttctaaaaaactaaatacttaattacatttctgtcaatcaggatatttgttttgttctccgatgtatacaaagtgcctagaatagtgattagaatataagtaggtggtcaatacatatttttcaaatgaataaattaatggatataatcttcctgtacgcagtttaaaaccatgactttcctaactgtaacatgtaaaggaaataaaaggaatttataataaatatatatttaagaatgtaaatgcccagtcacaactaaattagaaggtacaatgaagtatttaaatatttatgaatagtattattaatgtaaaaacagcttcaaatacacacttacacacgtatgtattagtgactgaaattactaagtgccattgctagtgacttgattttccaaaatggtgaacaattcttagtaaacttgtaaacaaaaccagtacagtcttccctcactttacatgatagttttattcctgggaaactcattgtatattaaaatcaatgcaaaacttatttctgtttgtatatgaagtggaattaatgtatagataattaaggctgtagatattctgtagtcttatggatggagaacagtctttgtgtatgaaactgtcttgtgtcagcatccctggaatcccactgagtcccaatagcatcttcaaattattgtgacagccaaaaagcgtgcatcattttccattagcctccttggatgaacagctgttcattggccttaccctgctgtatttttattctaggtatttattactgcatgacttactcatttgttgatttgtcttggggttatctccctcactggattacgtaagcttcatgagaacagggactttgtccatttcccatcctagtgcctgtcagtgggcacacaatatatacagttgttgaatgagtgctggataaatggatggggagggtggtgagaagtgaaacttgaagactccagaacagctatcttgaaggatcttacatagggaagtgataaagttggttttgtatttgaatagatcatatggctgcagtgtagcaaatgggttggaaggaggctggaagagataacgtgtagaccagttaggtagtccagatgagaaactatggtaatttagacagtgggtagggtgatggtggtagaagagagggacagaaatgtatatattcagtacatttaggagacaaattgatgatgggacttggaggtggattgagcttggggggtcaaggaaatgtcaaggatgactcctaaatttttggctatgctgctggttcgatggttgcattatttatttaggccataaggaccaaaatgtttttggtgggggtggggcaggaagataataaattctattagggatatgttatgtttgctgttgcctttaagacatctaagtagagatgtcaattaggtagacatttggattttcattttgccaattatttttgagtacatatacatcctgaggtgttggtggagatacagcagtaagcaaacatggttcttgctgtcataaaacttctaattggaggagatatgtgttaattttaaaaggtaaggaaatatattaattagtttcaagtaggaatgtgtgcagaaaatacctaaaaaggtaaatgatggtaaatgattggaggctgttttggattgagtggtctgagaaagactaccttgaggatgaaaattaaagtgagttctgaatgataagaaagcaaatcaagtaaagatcagcgggaagagcattttagacaggagaagttgccagtgcaaagaccttaagattggaaagaagctggtgtgttagaagaaaaggaaaaagcctgtgttgtgggagtatggtgtgtaagagtaagaagagtggtgtgtataaaagaggcagggagctgataatatagggtaataattgaaggtaagaactttatataagtacaataggaagtgaaatgatataatttgaattatttttaaggtcactgtggtagttgtgtggcaaatggattacacaggagggtcagaggtagcaacaatggggctgggggcggtggctcatgcctgtaatcccagcagtttggggggccgaggcgagcagatcacttgaggtcaggagtttgagaccagcctagccaacatgacgaaaccccctttctcctaaaaatacaaaaattagtcgggcatggtggtgcatgcctgtagtcccagctactcgggaggctgaggcaggagaatcgcttaaacctggtaggtggaggttacagtgagccgagattgcaccactgcactccagctctggggacagagctgagactctgtctcaaaaagaaaaaaaataaaggaagtagcaacaatgggccattggcagaagttcaagggagagatgatagtaacttggactgtggtgatgttggtggaggtagaatgaagtggatggaggtcagatcttttcagaaataagagtcaaaaggactttgctaatgggttgactattttggtttggaactcaggaaggctttcaattggactagagatgtaagtttgggaggtctcagtagatcattaaagccaggacagagatgagattgcctactatagtaatcattaaccttatcattacaacagaactcacttgtggtactttgttgaaatttgctgagaccctgtctcaaaaaagaaaaaagggaataaattgtacagtagaaccacttagcccaggttgacttctaagtttgcatctgatttaccttactttagatatcccaaattactggaacataattttaaaaattttatttaaataccctggaatatgatttctgaataaatattgagtatttgcttcatattaatatgcttgaatttaatatttgattttaacatttggacttggagtttatttctgtggtccatttgttgagatatatttatttatatatagaatttttaaatggctcataagtgttctattttattagtatattgttgattcaacttataagtcaattctgggagttagaatacatgggtcaaaataataagacccgtgtatggttagctctagacataaacttaggtgtgtttatattacctatgtatatatatatgtacacttgctgttaggcagacttaaatattgtattgtcttaattgattaatcagatggtgaatgtacttttgcatatttattttctaagagattattttatattataaataatttaaatcatttgagaaccaatatcttagttttcatatgtgatcttttcagacaaaatgtacttggatggttctctgtataagcattataaaaatgttaattttgaattccaataatatacattttggaagtttgatagagtaaaaagaaactaagtataaaattttagattacatctgttcaaaattagcatgttaattaagttttggtcctttttaactgaaaactattactaaatatagttattacaaggctagaaaataaaactaagttgcaaaagaaaaatagctattcttattgcaaaatgtttatatttctagcacttgaatatcttagaaattaattatgtgaaaaaacacataaaatataggagaacaaactaccgaatgtagttgggaaaaactatgtaactgtagcataggatatctaaactctgaaagtcttgtaattttattggctatagaccagtgtttttggtaattagtgctttgcaatgtcaataattactgtgactaaagcagaacctagttggagatactgatcttgtaaactttacttacttgaaatattagtcatagttattcatatgagatggtcataggttatcatttttattatactactttttttggtgtagaccagtgtttcattatggacattggcaaattatgattcggcaaggataatctgaaaatgtcattgtattcatctgttataacttctttttcttttaaatttatcagttacttcacttaatttgaatgtgaactacttttcttccttcctactgttttaaaagtgaaaattgttccttcgtcacctcatacttctttctcttgaacctaagccaatagctttttagtaagttttataacatcacttataagatagccatttattagtacattacttagcactgctatttttaaggtgagttttttccataaaactttcactgttactattttatcttgatacctcttaaagaaactagaatatttccttttcctaccccatgtcactaaatgtatacttatctgcaaatataaatatatatcctttaaactataaacccacaaatctaatgatttgataatatggtgttaattatgtggttggaattaaaagatatgattctggtttttatttcgtaagtgcctctaaaatgttttgctactcctttgcatttgttacttttgggagagatttccttctgggtgataatttttagattgtcattttattaaatataggtaaacttttttaaagagggaagataatttgttgtcttatcagggtcctgaatctgagctttgtcagttaatactgcctatttagtttggggttgccacttggaatttgacatcacaaatattcactgattacttgaagagtcaacacaatgatagactggctcaccccctaaatttagggagttagctttcaatttgtggatttgtttctgaaacttaaattcctcagaaacctgtatccttgatggatgggcttttggtgtttataatgtctgccttatatcttagcgctgaatgggtagtatagtgacccatttcactcctccacattaggttaagtttatgtgaacaatcaaattttcactatactaggccttaggaagctctcattgcctggactttagacttactgatcatatcttctactcttttaagaaataaaacagttaattcagcctaattggggaaggatattctttttcatcttcttggacttttgccaacagcattgaactagcatttctatctttttggaattttcctaatagtaatctcatagctgttaacataaaaacataggtatatctagaagtgtatttgccagtatcctgtattagttaataatgttccatttctaaattttatcattattgcttttgtttgcatacttcatgaatttttcaattagagaggttcacttatgagaaaagccttagttttcccatctttccttataaagaggcatacctcttaaaccatcacttgtgtcagctgagtataattgaattaatttttgcactactaagtttatagcccactttaaagaattaaaatttttgtacatttaatttcttaactcccatcatctcaattttttattttctgtcttgtaatttaaccagtatatcttcatttttaactctttacttagtagtattttttctgcatttaatctcctgtttttctatattaggttttcttgaccagttactttgaattcttggtcttctgaaatgtgattagttttcttctgtttaaattcatatcagtatataaatgtgatgtttgttctgaatgtgctttgagattttaatattaaaatgtacattagaatctcagtgtcacattatttattaatgagtggatttataaggtaagctgtcctagatagacttcattcaggagtattaaaagttcacctacaacatgtatgcaagttgtagctatgtaagtgttcaaagaattgttagtatgagtcttgttatactttagtacatcagagtagagagtgagaaagagcctacaattagaaatttagaatcaggacttttgcctgttttgtgcctctgttcatttatctctaggggagttatatcttgatcatccattatttatggaagagatttataactccatctctgcattactacaatccattcttgggttagaaatgtactgtaatgtttttggcatcagaattatgatatagtttatataggtttaactttgtgtgtgtgtgtgtgtgtgtgtgtgtgttttgagacagagtcttgctctgtcgcccaggctggagtgcagtggcacaatctcgggtcactgcaacctctgcttcccaggttcaagcgattctcctgtctcagcctcccatgtagctgggattataggcatgtgccaccatgactggctaatttttgtatttttagtggaaatagggtttcaccatgttggccaggctggtctcaaactcctgacctcaggtgacccacctgcctcggcctcccaaagtgctgggattataggcatgagccactgtacctggcccatcttaggtttaacttttaagtttgtatttctctgagcttatataccaagtgtcggtggagagtgttgacctggaagtcctgtgattggcaggggacaaccaacttagcattacaaactgattgtggaccaatctgagagtggctaattgatgtgcaagcaattcaaagttgattgcacatgtatatgtctatgtttcagatatatatatatgtgtgtgtgtgtgtgtgtgtatatatggaatattgataatgtttgtgaaggagtcgaatattctgaaggaaagtttttttatagaattaaattttgatgctgccactgtaaaatttctatgttacccactgattgctgtcattttccagatgacttttacttttaacagatgtttatctgattactcttggtgcttttacactatacctgttttgttaaaatgtgaaataaaaacaaaaacaaaaacacagaataaccagttaagtccctagttaaaccaccatttgcatttctcccacagagtatgaatccagtttatttaatataaagtgttttaactgaataagaaaataatataattggtgtatgtataattagctagaatcaataatttatttccccgacttggtgagttaaagttgctctatattaatgagttgtaaatacattatttgaatgtatttggagattgcagaatttagtgtaaactaatgttcaagtcatagtggttgttttaacaatagtctaacaaattttattatgtattaagatgttgaaaacaaggcattctggcttaaagaataaagagataaaaagctttcctttattattaatcttgttcataagagacctgtgttgtaggccgggtgcagtgactcatacctgtaatcccagtactttgggaagctgaggtgggcagatcacttgaggtcaggagttcaagaccagcctggccaacatggtgaaacctggtctctactaaaaatacaaaaattagctaggtgtggtggtgtgttgtctgtaatcccagttactcaggaggctgaggcaggaaaattgcttgaacccaggaggcaggggttgcagtgagctgagatcgcaccactgcactccagcctgggtgatggagcaagactccatctaaaaaaaggagatctgtgttgcttaagcctgcctttatcatgagctttaaattaattaaaatatgttaacttttttcttagttcgtgtcatttttttccacaaacctagattatttaatgctggtgatttaaaataccttacatggttgatatttaagtatatgttatggaaatagttcaattaaaattatctcttgatttttcatgccaataggaggcagaatataatggatatggagaaaacagccacaaaataaattaaattttaggtttcatacacaaattttcacagcagatttacttttgtgtattctttctatggaagaaagatataatattatgaaatgtttgaggattgtgagctaaatgacaactggttaaagtagtatagaaacatacctggagtttggagaaaataaactggggattaaaagttttctgttaatagagagttgactataatggtggtaatagctttgatgaatgagtttgatgtttcacaaggtttatttaatctgttttctttgtgtctccctaattgaagaattatgtttaagtaacagttttaaaatataattaggaaataataaatattgtcttcttcttttatttttttcttcctcttctttttttttttttttagggtatgagtattatagaacaattagaccctgtatcttttagcaattacttgaagaaataccataatactatatgtggaagacatcccattggggtgttattaaatgtgagtatccttaggaagccttgacttttaacatttggtcatatgatattccaaaatattatcattgtgatacaatggcatcattggttttatgtacctatggtcaagtttctttttagtatctttaatataatttggagttccattgcttttggttacttgaataaagttatttatcattggaatacagttcaatactttctgttaaatacaaaaagttatttagaatagagacccacattttctcttgactcttagttccaatatgctctttataaatacaaaccaaagtgacctcttaagagatatggtcttattaattttttggttttatttactggtctagactctataaaaaataagtggaagattctgctcttaaactttaaatgttcataatgtaataaagcaagacagatgatgtgtgtttttctcattaaaacaaaaataatgtttatttcagttaaggaatggtaagagtcagaagtttcggttagctggattttagaaaaagaaatagcatttttttcttctaattaggaaaactattaatttcttgaatgaaaatatgacattaattaagaaagaagaaagtgtatactcaggaatgggaggagaaagtaacaatgggcttatttggagaggcagggaaataatggagaagataatgtagtccagaatagactaagttaggaccttaagtccagtattattttaatgtgatttgaaaggtaatatattgtgggtttttaagaagggtttttcttctaagctgtattgattgactcaaagaaaagcttttcaagaacttaaactaatttttgaaaattgaagctagaataaactgtactaatttcctaaaatctgaattgaatcaaataaaatttgtattataaagtaaatgctgaaccaatcgacaattaaagtaaaaatcctagcatataccttttagatttggattttaatttgtatacatttcaaatttagtcaaagtcagataaagactccgacgtcttaagacagaagtggccagggatttggtttatacggtaaagagaaatatatttaaaaagttaaaaagggtttaaaaaatggccttattacagggagagggagggtaaatgatgactgatacttaattatcaaaaaacaagattagaagttatttgagaaaatgataaggaattcttttttttctattttaatatgatgcaacaagagaaattcaagaaacaaaagagcaaaagagataatctaggcttcagctgtgaagtggacaaagtcaaaccgcaaacacattgagtgcccagttttttatgtgatgtgtgtcctaaccaaatttttcttttttctaggctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaatagtctgatttaaacttattgctctgtggtatatatgaaaattgttttttattaattccatctcagaatttttgttaaaaatggtaaacctcagctcttatgtaaaaatatattaggatgtattttatattttatatatttgtatgatttttttaaatcagaaattagaatcatatgatcttaaagttaactttttaaattacatgcagtttgcctttttgtctgtgacatccctttgtgtcattactatattgtaacagaatatatattcaagattggtaaaagaacgtagatgtaatccttgacttcaaagatcatgtttgatagtctgcaaatgaggaaacattgaagagtgttcttagtgtttttcaaatcattgcagaccttacactgctgtgcttttttaatgctttaagcagtttgactcttttacttgaatttttagccagagatcattaacatcatcaacaacaacaagccactggattttcttatggttacacaattttttttgtcatgatttttggtgcggctcttccaactaaaataatggtatgatgttgtatttctttctttctttagcatagaccaattctagtcactttcgccaaaaaaaaaaaaaaaaaaaaaaaaaagatataatttagttaataattcagttaccatgtatgtactgcattatacctattttaacctaacagtgtctacattatattagagagtgtttatatctccagtgttatgccagagtagcacaatttttagatgccttgcaccaattttatttaaagatttatgtttcttatttattaaatatcaactttctatactcgagtgaaataaaataatgttaccttttagattcaaagtcgcccacctatgtatgtgtggaaattatattcttacacattagtgatttattttccgtaatttagatacactttttagtactattaatatttatttcttgtttaatatgaactataaaattttaaaatggacaacagtgaatttttaaaataatgttttctgagtataagactaatacatgattattttagaaaatttgaaaattactgaaaagttataaagagaaaaaattatctgcaatctcactacccagagataaccctgttaatatttttctgtatttcttttcagtctttgtctgtgctatttctatgtatgagtgtgtatacatgtgtttgtgtgtgtgtgtaataacaaacttgagattatactgaccatatagttatgtaccctgttttttataacctaacttcatacatatttacccatgtctatgaaaatgtgacttttaaaaatggctgcctaatattctattgtatgaatatgccacaatttaactacttctctctttggatattaggttgttctaatctttcaccattataaataatagtgggatagacatccttgtttgtaaaatttcatctctatattagactctttaggatatactcatgtacatggaataagtggtttagacagtgagaactttttaggctctttaaaatatttccaagttataaccctttagaaagattgtactaaattaacaatgtatgagtacccatcattctgccccttcaccagtatcattatttttttaatctttgacagttggttaacataacaatcggttgtttctttgaccattctaataagagttgctttataatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggtggcggagcctgcagtgagccgagatcccgccactgcactccagcctgggcgacagagcgagactccgtctcaaaaaaaaaaaaaaaaaaaaaaaaaaagagttgctttataattaattatttttgtctttctataattttatagttgattgatttttaaaaagacaagagggttgcctaagttgggtggactatagtacaagtatggttcttgcacttttaaaactgtagaagctggacacgatggtatgcacctgtagtcccagctactttgactgtggaggcaggaggatcacttgacagtttgagaccagcctgggcaatgtagtgagccccccaaaaccctctaaacaaacaaacaaatctgcagaatatttcagcatcactctacactttcctagaatatcaacatacctgataatgaagtagaaagagttccaaattgatgattgagtgttgggttctagttctatttctgccactaattagttctctgaacttaagtgtttcatgtcatattgaaactttctcatttgtaaaatgtggaggggatctcttaagtgctttctagtttcaaagtactttgatactgtgactttattttgtagaggttctggtgtcatttatttttaatagctacatgaataatgtagagatactatcttttgatttcaacttcacatacatggaaatgaaagtcttgttatttaacacaaaaggaaatttaatttgcattatttaatgcagttaatattacctaaaatgttgaacttaagcttttctactttaagtgcctttaaaagttttgtatttggaatctaaaatataaaggaaattcttatgtagctcta

SEQ ID NO: 635 - DNA, 106099 bp, Homo sapiens
agacaccgagaccaagagcttggccggggctgtggggcgaagcttcctgggcccttggtggggatgagctgggggggcctctggggaggggagttaatgatcctgggcacgaggccggtggccactgggacatagtcaccgagggtgatggagacttcccttagcctggagagtggccatcatggtgcgtgggtaagtggggggctcctgtggctgagccttagccagactccccttccccataacccccccatccctggctctcctcccattcctccttcatgaagggaagcttcccaatccaagcaccaccagttttggggcagcctgaactctctgaagggaaagaattctcttttccctccatcggtgctgtcctcctgggctctatggattctggtgtgccataatctccatctgtgggacatccctgcacactcagattgaaaatccccatcaggcttctgtcaacttccacgctcccccctccccactgggtttggatggatgcggcctgaggcaccagggatggggtggggagggtgtggcctgtctttccctgaggctggagacattggggaggaggccgagtttgactctactggccaatttctgtctctgtgcctcctggctgcactgaccagtcaccaacgccaacaatgcctttggtatggcctttgtccaccagagcttttgtgattcttccagaagtgttattgggggaggccctctctgcatttggcttctgctggaccccatcccaccagctcagttcctactcccatcagggtcccctgctgctgtggtccccctatggccaggcatccctctctggtgtggaaccaaggagacagcccatgtcaggctccctactgtggtgacatttgactttcagaaacgcatgggaccaaccctgccacccccccttgtcctgcggctctctccagttctcctctccccgtgccgatgagcccaggacacagcactgccagtctgctgcaggagatgacacccaggctgagagggaggtgcctgtctccccaccttgcaggtgccttcagtctcctggagatttggctttgggctttcctttggctttttttggagcaagaagggaagtgccactcctgccccatagcaacagttcacaagcctggtgatttctgagctccttttttcttcctggatgtctgcatatttaggctggtagggctggctgaggagaggatcttggggtgttggcaagggctgctggctctctttaaaatgtgggcgtctggttgcttctttgtcctgagttttgggtcctagccactaattcctgcaaaaggaaagggctcctcagcacctcgttctcctgtaggaggctcaggcaaggctggtgacctgtctaaggccctgtggtatgttctgattccttcggagactggcattaccacctcctgatttccagatatgaacaatccctcttgtcttaacatctgaggacctaaaagaagacctggggcaaggatctgggtgcaagtagtttatttggaagattatcccagagagcacagtgacggtgtgaggcagggaaaggaggaagcccacaaagggtgtgttaggcctggcacaggggccacgcctgtgatcccagcactttgagaggccaaagcaagaagatcgcttgaggccaggaatttgaggtggcagtgagctatgattgcgccattgcactccagcctagggacagggtgagatcctgtctctaaatcggaaaaggcatgttaatgaatgtcatcactgggagccgctggagctcagtccagccaggatccaaagcgacagtgcagagcacagctcagaattgtcccagcaagagacctcctgccctgtcccccattgcttgagaggggctcctggaggcactaactcaggacatgcctgggctgcccagtcaacgtgggccagatgagctcttgcaagcagtggtgtaggtgacaagtcatctgtatatgcaggagccaaccatgaggctgcaggtgacctccagcaccagctgaaggactataggcaggatgttgtctgcactgaactactctagccatgcctttagagaccagcaacaaaataaacatccctgggggaacagtgcaccacagccctgtctttcatcagctaccgacgcctgtatcataaatgtgtgcaccctggcttttcacaaattgaacatacttgtggaactggcacacagctcaagaaacagaacctgaccagcgcccccaatcccttttatgcccctttacaggcacaaccacccaaagggtacctgctcccaactttttttttcttttttttgagatggagtctcaccctgtcacccaggctggagtgcagtggcgccatctcagctcactacaacctctgcctcctgggctcaagcgattctcctgcttcagcctcctgagtagctgggactacaggtgcacgccaccatgcccggctaatttttgtatttttagtagagacagggtttcaccatgttggccaggctggtcttgatctcctgacctcgtgatccatctgcctcggcttccccacgtgctgggattccaggcgtgagccaccgcacccagcccctgctcttcacttttaacagcatagatgagtgttgcctgttctggaacttcacacaaaatgtacaaagtgcgtatgccatacttgtgtactcctttgtgtctaatttctttggctctgagctatgtctgtgagctacatccaccttgctgtatgtagttgtgaattgtgggtattcaattgtgtggtggccccatgacgcacctgcccatctccactgtcagtgggtgaggagtggcttccggtttggggagctatggccagccctgctggggatcttctcgtttgtgcctcctgcctggaggacacacgctgtcctgagtggaaactgaggagggagatttctgggtcacagcacgcacatatgttctgttttggtcccttctgccaaacggtttcccacaatggtcgcgccatccgaaactcccgctggcggataaacattccagtggtttcccttctttgtccacagttgttattttctgagtttcttgcctcttccacaattccagtggggtggagccacagcttttccatcctcccgccagccacccttgttcatatttcacaggtgagaacacaaaggtgaggggaaggagttccttactccacgtcacacaccctgtgggtggcaggatggagactgaagtctctccggagggatgcaggtggtagggggagcctggaggagcgtggagctgatttcggctgcgtgaagttggctgtggggttgagagccgcctcttccttgaagttgtctggcaggccgtatggtgacatctctccctgcccattctcgggcttgctgcagagaggctgcactgtgcccactcttctagagggaaggtcaatatgggatttggcacttgctgtgtgctttagaagacactgtggtctcaggcaggagccttgggggtggccgtaccgtgggggtcaggctgcctctgcccctcctggctgagcccaagggcttacaccaccacctccaagcatcctgcatttctcatctgtaaaacgggcctgaaagcagggcctgcctggcaggttggcatgagccgtgcatgagacaggaagggtgtatgctttgcctggctcccgcagccccatggaagactcagatgagggcctggtgcagccggggttggggcaggggtggaagggagttctcctcgaagtccgtggcatctggcattctgggcaggggcccagacattgagaagggtgctgggatgctgggatgctggccgcccacctgcccctcctcccacatgttggcatatggttttgttcagcaggagccaagctgtcgggggaagtttcctccagagagcccggggaacaaggcccctttgtctggtctggggtctgcctgctccctaggcctggaattatgggtcagacctcaggctggccatctaggggcactgtctgtgatggaggaggccggggtcaccctctgttagatgaggaaactgaggcagagagagcaagagactggtccagagagctcagtttgccagcagtggaggcaggactggctctctgcttcccaatccagtgttctcccttctccaccctaagatgggttcccagaagtccctgggtccctcagagagtttgtttgtgttggtggagccactcttctttaacaacccccactcctccagcccatccttccctccttcctgtccttccactgagagttttagagttttagagtgtggctgtgtgcagccacactcccagctaccaggaatagaagtgtaaacaaaacagtcatgatcttggccctcagggagcttgccatccagtggcaaagcctgacgaacccactgacattgatgtcacaggagtagtgccccgagacaggcgctcacaggtgctgtggctgcacagtccagggggtgagagtgagccaggagagctcctgggaggaggtgaggtttcagttaagacctgaaggctgacaaagaagcagccaggaaagaatgaggtgccctgggggaggggcagggtgctcctggcaggtggcacagcacaagcaggagctgggaggttgcagagagcagagagtgggtaagccagtggaggaagcaggagtcgggggaggggagaccgtgagcggaaacaggaaacagctcccatcaaaaacggagacacagactggagccaaaccactttaggaccttgccggccaggctgccgagtatgggcttgactccgaggcccacagggagccacggagggcttaaaatcagggagtcccatggccagattgtgctttagaaattagtgattgcaaagaagaaagcaatgttttaaggggcaaaagccatgagcagaaatttcacaaaaaagaaaatgcagatggatgacgaacatggcaagatgttcatcctcattagtaacaagggacatgtggactaaaaccacaccaaggtaccatttcacacctactacacaggcacacaagagttggtgaggaggtggcacgcttggcagcaactggtggaaatacacatgggcacaaacactctgcagcaagtatttggcatgagctgatgagcctaaatatgtgcatgtcccatgacctagctgtacgtctgccctaaaggactcatacaaatgtctacaaatgtcacagggagacaggcacgaggcggttatagcagcattatttgtaacaggaaaaacaaaacatgacaaaaaccagaaagcaatctaaatatccatagacagagaatcattcggtatgcaagagctggtcagtagaatactatacagcactgaaaaggaatgaagaccacctgtaggcactgatggatgcatctcatctcctcagtgcaatgaggaacacttaaagtatgagtctctttatatcaagttcaaaaacagccctaattgaacagattaggggtgcatacagaagtgggaacacttttaaggaaactctgggagttagtgtgactgggaaggggccccagagaggatttctgggtcaagaagcccatgcttttcacagaacccctttctagtgtttgcacatgacccgaatcagcccctgggctcatgtcacattctctcctgctggctaacatttttgcaatgggtgtaacctgcttgttttattattagtcaccaaccacaggcgacttgcttttccatcagaccctcgcagtgtgcttggccttcggttcccagcctagtgggagccaacgaccctatgagatctgggtatttctgggtatctctgggctctcattggctggatcacaggggcttccacgacttgacagccaatcactgaggagcttgatgaagtccccttctgtctgttgaaaactttagagagaacatattttaaaaatgtgtgctaaatacatatctgacagtgtctgaatttaatgtccaagaaattgacctgaaactcaaggctgcaaatttacccacccttttggggccattcatggatcgctctccagcatctgggaacagccctcagtttccacgtggagattcctcccacctgctcaggcctctggacacatatatgacctgggcagagccaatcagcacagcccatccccacggcagtgactggttccaggcctgggcacctgaattgagtccctccatttggggagaaccttaagaccagtgcaaaagtgctgcattctagctggacttgaagggttatgagttgagtgacaatgggggagaaacttgctcctggtaacatgtttgaaggactggatcaagctgtgcttgaagtccacccttgtactctgtcggtactgaagtcaatagttcccttcttgacttagcctctttgagtcaagtatactgtgacttgcagcagtaagtccagactggcaccctttcccaacttgtcattcacacctcctgagccagaaacctgtgtgtgtgtttgtgtgtgtgcgtgtgtgtgtgagcctgcccctccctttctctggctcccagcatcacaccagtgtcctctccccacagtgtctctccaatcctaccattgcccccatgccaccagccctgtctgaaccccatcatctcccacctggactcttgcaccagcctcctccagtggcttcccaccgctctcagaataaacatggagcttcttcccgtgcccacaggctcccccgtgaggcctgaccctgccacctcctcgtctccccaactatcccttcagtggactcctcagcttccggatccctttcccagagcccacttaactgtccttgagcacttcctgtgtgccaggccctgtctgatccttcccactggttaactcatggagccctcccaaagcctggcgatgtaggagctgctgttcctattttatggaagaggacaggaagcccaagtggttaggagcctcccgagtctgagttagcacacagccaggcagccgggctccagctgaccactgtccgcaccacctcccctgcagcactgcctcaaggcgcttcttattgtgtgggtgtgaggttgttggatttatatctatctcccactggaatgtgagctccatgtggtcaggggcgagtcagccctactcatggccagagccctggtaggatgcacagtacctggcacagagtgggtgtcctggaaaggtttgttgagtaatattagctaatacttattgagcacttaccacatgcaaaccacctcctaagcactcctaagcatataactcagtcttcacaacagcatgccgaggtaggcagttattttatagttgggaccctgagacacagagaggcaacttctcccaggtcccatgtctactaagcagcagagctgggcttcaaacccaggcagcctggctccagagtctgacctggtaaccacgtgctatgtcatccctgtgtgggcggatggctgcacagatggctggatggacactgaagctatgttcctgctgggggtcagggtgagtggagatcaggggcatggagccgagactgggcccatgtcccgaacatgtcgggaggccagggccgacagatggaaatgaaggatcaaggcacaccttgcgggggtcttctctacttccaggggcttggccagctggccagtgtggtccagaggatgtgggtctcccatctgctcccttatcagggccctggtgaagaggcctggagaaaggaggggttgaagcacctgggggaaagcgggagggatgggaagagaccagagggcaactcagtgaagatactcaggacagagggacagacctgcccatggccaagcagctctggaccttcagctaggaggtcaagggaccctggagtcagagtgtgttggcagcttaatacatcacccggaataactactgccagtttaggtcacatggcctgaaggctggaatgtggaaagtgaaagttctctatgggccgtgcagaccactctaaggacttgtgctcagtccctggaatagtcctggaagagggacggctgaattggccccaggatactagagcagctggggtggctcagcctgcagaagagcagccttgaggctttggctgaggagaagcagacaggccaagaggaccagagggtggggccagaacccagaagggggtcacctctctgtgcaaggatgacttttctctcaacatccagagttgctcaagaagagagggtgttgccctcccaccccatagctcagttcctggctccttcctctgggttcagctggggcaggggcacctgggctctttccacccaaggaagggggttccaggctctgtctttcctggcattccagtggcccattggggccccagggcctaagggccggatgaggaaacacagagcctgctgggccgtggccccaggcacaggctctgggctgagaggcctagagagaagagcctgggactccagggggctgtgtgactcactcatgctgcctggggggacccaagctcagctgcctctgagctgtctcagttttgttatctgtgaagtggggacacccagtgtttaaccttcagctggtggaggacatgcaagggaggcagctgtgtctgagcttcataaactgtataatgcagtgacgatttcaatcaccatttctatcattggattagtttcggtctgttaagaagcccaaagtgattttgccaagcaagacaggattagatgtgcaaggaaattttgcagggagggagcaggagaaggcagagagaagttcagagggcagcacaattctgacacttgtgctgggagaaggggaagaaggactgggcaggaggagtcttggaatgtgatgcaattccaaaaagcttcagccaggatgatgattgggcctgggagcttttccagcaggtgagtgcaaggagtcctgggtctctctgggatattgctgcattcccattcctagctctgtgctctgtcgttggttgggagcagctcacagtggcctcagtgcaaatgtgatggcaggtgtggaggagcagtcagtgacctatgctgcagagataagtcgagatctgagtgatacatcttcatggccaccataatcctaattatccaaaacccatctatacccaagatgggttgggtcaagtcctgccaggtaaccagaggttacttggagcctcagaggccaaagtttgttatttaaacagagatgtgtttcccttcttcacattcctagaaggggaggtttccaggtataactggaaattcttgccccataacaaggcaacctgctggaggaccagccatcagctgcatgggacgggcagccagaggggcttggggttagattcaagggcagcaataaatgaaggtttcatggatggatgaaaaaagaactggaatagaatataggtagcttactattctatttctatcttggaatagaggaaggctttccaagcacaatcccaaaaccatagaccacaaagaaaaatactggtaggtctgtctacatcaaatttttaaaattctatgtgtaaaaaagtatataaccaaagctaaactagaggagtttgcagcatgtgcttggcagacaataggttggcactcctgctatacaaaaaatgcttatcggttactacgaccaagatggacacctccatagtatatatgccctttgtccttgcaacttcttggaaatagacaagtgctccaaaatatagagatttatgttttattctttttctttttctttcttttttttttagaaatagggtctcactctgtctcccagactggagttcaggggtcaatcatggctcactgcactctcccatctctgcctaccaagtagttggctttacaggtgttagaaataaattttcggtgctgcaaaagaaatagcactcaaacgtgaattttctcagcaaggcaattttacttctatagaagggtgcatcttgcagatggagcaaaggtgagagcacacaagggaggggaaggggttcttatccctaacgcaggtagcccctactgcagtgtcattcccctattgactagaattggactgcacagtctaagctaattctgatagaatactggacagctattgacagtgattccaaagatttctgttattgatatctttggatatttgttattgatatctgttattgatagaaaaatgaccataatatatcacatgatggaaaatatttattagaagctgtgggcaggcatacatacatacattcatatatatcatgtatatgtataaaacaaaagcagttggggccggatgcaatggcttatgcctgtaatcccagcagtttgggaggcagaggtgggcagatcacttgaggtcaggagttcgagaccagcctggtcaaaatggtgaaacccccgtctctactaaaaatacaaaatttagctgggtgtggtagcatatctccagctgcttgggaggctgaggcaggagaattgcttgaacctgggagttggaggttgcagtgagctgagattgctccactgcactccaggctgggcgacagagtgagactctgtctcaaaaaaaaccaaaccaaaacaaaacaaaacaaaaaacccagcaaaacaaaaaaaaacaaaaaaaaccaaaagtggttggatgagattctcttgggaagatagaatctcccaatattgaatgttttattacatgtagtttctaacttagttattaaaatcagagccagtctctctcatttaacaaatggggaaactgaggttgagagtgggcaagagcctttctgggaccaggccccctgtctctgggctgccttcgctgtcctgcgggcccccttcagccccttaggatttcacagtgtggccttaggcaagtctcttccctctctggctggctgcagtggggaaggggctctgaggctgctcagcctatttttccagcctgctagggaggtcccagcctctgagaccagcaccctgcctcctcacccttccccctgcctgaagagttggccccaacagcaaggctgggccaaatttcatcacaccaggcaaaggaatgggccagcatgagtcacgagcgagccgggccataggaggtaggggctgaccattcccagacgggagttgtgaggccaggcgactttcctggaataagtagactgcttgggaaagtgcagagaaatcccagagtggaataaaagttgtaatgcctctcccccactcctctccccagacactctattctatgcacttcagccctttttgccactctgccaaggggtcacccagtccttgtccacacaccccagctccccactacctcactacgatgttctccctcttcctctagaagggcagggaaaagcgtgcggactctggaattgggctgctccaggtgggggccctagctatcatgctgagcctcagtttatttgtaaaatgggggaaatatctagtacctctagaattgtgtagaggattaaatgaactaatccgtgtaaggtgcctgttaaaatgcttagtacacagtatatggttaacagacacgagtttatttttcatcacagtcgctgccccctttatttaaggcaaaccacctttggagagagcctagacatcataaaaaatggaacctcaatggcaaacaccagtgttcaaaggggcctgggaagtgcaggtgctggacttggtgggtaatgttgtctcagtgagatgaattccattagccaaggctcttgggtgatagaagtgagcacaccaaatctcaggtgcaagaaaccccaactaaaccaactcaaaaacaaaaccccaactcaaattggctgaagccccaaagagcatttattgacccctgtaactgaaagatccaagggcaagatggcttcaggctgagctataaccaggtgcttaaacatcataccatcagaaagcctctctctccttcccctcctcctctcagcccttacctctgagctggtttcattctcagcaagttcccctaagaggtggtctccaagctactggctcacacccccagctgggcaatagggcagaaagagcgctccctcccctggctccagggcaggcacaatctgccttacatacagatgcccctcactagggccacatacccttccctgagccaaccaccgtggctggggaggggattccccagtgggccacaccacatcaaccgaatgaaccacatcaacccagaacggagccaagaaggctctgcagaggagcctcaggggctggcagctggagcaggggatggggatgggcagaaaccaaagatgtagactgcacaggtcttcttggaaggctctgagtcatgagctttggtgggagactagagaacacagctcgtctatgacttcttagtagagcatttgagctcgatattgaagtgggaggggtggttgttagttgggtgtaggttaggctgttagctatagcaaggctataaaagactcatgtgaaggtacaggccaggtgtggtgctcctctgctgcccagggactccctccatgcaaatgtgactctcacctggtaatacaaagtggctgtatcatcttttcctttaaggccatgagccagaaattgtccacattactctgccccaattcaacagcacgacatgtttgtggtcccacctggctgccagggagggtgggagtgaaatcttcagccagaaagccatctaaaatttctatagttatgtttcttacatgaatggtgggggccgatgagggtttctgccacagggtaggaaggatgtgggtaggtggaacagcattcacagtgggatggacaggcagagaggtggggaagttcctggtgtaagagaagaaatcagcttttcattgggtgaggagtagggctctgggatgtaaggacggggtgtaggtgggtgaaaggctggagatgcagtggggatccagaccagagagagcctgaactcggctcccaggagtgactgtgtccggctcccaggagtgactgtgtgcccacatgtccatgctctgctcatgctacctgccagcagctgccctcgggcctgggcctggggtgtatagactggtgtgcagtccactcttgggaggagggaagacggaaagagacttgtgcaggctttgggggtcagggccatttaagcagggacttccgggcactggcatatgatctggaaaggagtagggggtcatcagggactcctggcgggcacatctcattgttctcttagactcttcactctggggagggacaaagctggaagaggaaggctagagggaggtaccccaagtggtgtttttcaaatctggcagcacatcttacaacctactggggattacaaaaaaaaaaaaagtactgatgcccaactccaccctctggagactgggatttaattgttctggagtagagtctagacagtggtatttccaaaacaacaacaacaacaaaaaaaaaaaaacaaaaaagagaaattccccaggtgattcagatgcactgccaggtctgagaagccttgttctaaagcctgggagcgggtgtggtgtcctgggtcttcgttgggcagcaggatggcaggtggggctgtcccctgggggaggtgggcctatgtctagatatctttcctatcgtgtggaattcttcccctcgagggtcttggggggcctggacactgactttcctagtatctcttgcaactggggacagatgggagacccacactgcccccactgtggctgcagctgctgtcaaatgggaggtgggagagatgactaagcaggctcagggccgaacccactgctggggaaggagaggcactgtgacccttggagggagctggggagaagtcctggcggggagtccggggcccaccattcaaggagtgggcagccctcacgctgtctgcacccaggtgggcagcgagattttgggccctgtcactgggcctttctccccgaagcttggtttccaggcacactgtgatcacaaatttcttttctcatccaaacagctcaagttaatgttgtttgtgattaacaacaacaaacatttaatggagggcttatgatataccagacactgctgtaagcatcttaacttcaaaacaatcctataaggcaggaacttctttataggctaggacactgaggccagagggttgaagccacctgctgaaggtcatacagggaggatgtggatttaaatcaaagccattgggtcccagaacccatgctccaacgtaggcagcctccccaaggctacccagtgaggatgcagacccaggaagctcagcaaggcttctcttcccaatccaggctgcacaggtgggacaagtgagcctcatgcctgctggccctggcgcctcagtgcccagggagctggtgagattgtcactgatgtaaataacttcgctgcccactgtgatcattctgtctaggccttatcagcctgacttcctccaaccatttctcagccaggccctgggccccaaattcctggtgggtgatgcgtgctctgtctgcgataacagtcttggaagggctctgaagggacagccgctttggccgcatctccggctcagataacaggacgggagaagtgtctccactttatcttgtggaaggcgggccaggccttgggctccctgggctgcagagtgagctgcatctggctcagtgcctctcctcccaggcctggggaagggagcctcattagcagctgcccagggtctctatcaccccaggccactgcccctccttcccccacaggaggaaggattcaatctgtcatttactcatcagatatttactgagcactcccttgggtcaagtcccatccaaagtacagataatccctgacttacgatggttcgatttaggattttttgaatttaggatgttgagaaagtggtacacacccaggagaaaccctacttggaatccccaggcaatcattctgtttttcactttctgtgcagtattcaatgagttacatgagatattcaatgcttcattataaaataggctttgtattagatgattttgcccacccgtaggctagtaatggaagtgttctgagcacatttaaggtaggcttggctgagctatgatgttctgtaggttaggtggatgaaatgcattttcaacttactatattttcgatttacgatgggtttatggggacatgatcccattataatcgaggagcatctgtactttcggtttggctcatttcggttcatttgatctttccaataacattataagataggctttgatgtcgttatgttcattttacagttgaggaaataaagcccagagaggtgaagtaacttgcccaaggtcacacagctggtgtgtggtgactttcttaatgaccaggtgatcctacctatagtcatttataaatgaataagagaaatcagccagtgacaagtactgtaataacagtgcggccgagtcccagggtggagagtggtagttgctacctctgctggggtctcagggagggcttctctgggggtggtgggatttcagctgcatcttaatgcagggatgagtcagccacggtggatctggggaagagcatcccaggcagagggaacagcaatggcaaaggccctgagggaacagcaagcacagagctccaatggggaaacgggcccagagggaaggcacctgcctggggttagacacaagttggggcaggccaggcacaggctgccagctcaggctttggcccctccatccgctcctggcttctctgtgggtggccccatctaagccaatgggcccttcctggctccacctcctctctgctgtgcggccctgggcaggcagctgccctgccctgtgcctttgctcttggctgcctcacccctgtcctgggctgcagggagacccctgggggtgggggcaggcacactttgggcccatggctgctgctcagatgtgaggtggtgaccaccaggccatacgtctctggacagggatgggagagactcagagagacacagagaccaagagataaagtcagagggagatgcagagaccaagagggacaaaccaagggagacagagagatgacattagatcagagatggagaccccgaaagagacccagaaagggatcggtgtgggctgggggaagagacaccccgggggtcacacagtggtcacaggcatcagagctgggctgaggaaaaggacaaactgaacctgttccaaagctgggggctcagtaccgtctgcccaggcacatgcagcagcagtggggctgcaggcaggcccccagggtaggaagcaaggcgggtgggaggcagggcctggcctctgggcagttttgtagccgggcccctcaggccctcacaatgtgcccaaggctgctgggcccatcttccaggggtgatcactgaggctcaggctggctgaggtggccggaccccaacccctggccctgccctgtgggcagcagtgccaggtctggcactcagaggttaggccgggcgcagggagggtgcgggctccgcagcgagcgcgccgggcggcctctaggagccgggtcagcgagtctgggctctgagcgagcggcgccggcccggccccctctccggcgggcggccgagaccccgccccggaggcggaggcggagtcaggggagggggccgggggccggctggtcccgcctctcgcgcctccgccccgccccgcgcgcacacagccaggggccgcccgggctctcgacgcgccgacggccgggcggacggacggacggacgccgagcgcagtgccccgcggtgagtgcacgcggcccctcccgcccggactcatccccgtcggtccgcgcctcgcagctcaggactcgggggcgctcggacgcaccgacggctcggcggaccctcggacgcgcctcgcgggctgcccgcgcctccacccgcgccgccggtccgaccgggtctcgctctcccggtcccagcgcggggacggcccgcgagcgccgcgacccagtgtacagatgcgggcacagaggccggcgcggggtgggggccaggggtccgcgggcgggttcccccaccccaggtccgcagcttcctccgctctgggtttcacttctcccccctgggccggctcccaccagtcatcccctctggtcccactgcccacccccaccccgaccgcaggaccttgccgcccctccagtccagagggccgggtcaaccccctcggggaaagaagactagagtccctggtctaacactaccccctccatcacccccaagtcacactcaccgccacacacgcactcacacaagcagaagtttctgcacgctctgcattggcgcgcccaccctgcctgtcaccacatcctccctctcccagccccatgctcaccccgccagctcccccaggccagaatctctcacactcatctcacgtccccttagcacacaatgctccacacacacatgccttgcacattggcacccctccgaggcatgcctctagcagacagttgtgtctctgataaacacatgtgcccttactgccctctgacacgcacacacgtccgccacacaggggtagctatcacatgcatatctccatcatatgtatcacacatgtgtctctcacatgcgtgtgctcctcaaatacctggaatcacaaacactgggagtgccacacactgtgagtctcacatacgagtcacagacccccacgacttcacagtcccagcccccctggcactccatgggcagtcctcccctgtcctagggggtggggagccgattttggaggagggaggtggttcctcctgacagaggctgcttaccatgggacctgggtggctgtggggagcatgggggtggctcagcctcaggctgggcctgactcctcacctccgtgcatcctctctcccttcccctgctccagtctccgaaataggggtgccctccctcccttttttgctgccacaaggagttgcccatatcagctttgcagtgatcacttgggccagtcccaagcaggcctgagccagcaggcgtcccctgacaggccaaaaagagaaaaagggaagtcaaacaggatggtttgggtgcttgtgtctaccctgatgcccctgagatgctggtccgggccctcccagagggagccctgatgaattgggtggcagctgagaagtgttccctcagcctggcatggattgggagctggtgtgtgtttgtggctgataggggctctgggccttaacttccccatatgccaaatggggtgaagactccccagcaggaggaagagagggagggggagctactcccctggggtgcacccttgacttcccgccctccccttctgcagctgagctgtgtgatgggggtgagcaggggatgaagtcaaagaatcttattctggaggcacaaacctgccagccccggctgtggctggccctgcatgttttgtttggctctcaccatgttattattattttaaaaaattaattagctgcctgcatttacaaattggcagttttcacgtaaaagtccggatttccgtcttctcttgaaaagtcacaaggtctggtagttcaggatctgcatctcctggctggtgctgcccacccccaacccaggggatggggcaggggcgctgtttggtccccgtccccacctggccctctcatgccttctcagctcctgcctggcctgcgtggcctttgtgcggctgtgactgctgcatgcattgggctgattttgctccattgcccgcctcaagcataggcccaggctggtcctccatgcatggctggggaagccctgggcgggcctcctacccttcgaggccttagtcgttgaagcaatgagtggtgcccagggccctgggccacagggcatctttgtgatggtggcagacacttcctgctaggctgtgggggacggtggtatggggaccccgtgaagcaagagctcatgccagagagcattctccgaggcaggctttattcatcacttttcttcccagatcccgacatccctcctgcagggtggaactcttgcacctatttaagagacggggaaggggaggtagagaaagggcctcccagcaggcaagggggagagctggggttcagcccaggatcttttccctccaaagcaaagctctttgcccctcttactgagccactagtgggaggacttggtctccttggccgtggggggagtgccctgagcccatccacacctcacacgcaataggtgcttcgtaaatgcttggggcatgctgatggtaagtgaaactgggttctctgcagcaaattcgggcctaaggtgaagattgcacagccacttgacctccatctcttgacctcgtgatccgcccgcctcagtctcccaaagtgctgggattacaggtgtgagccaccgtgcccggcccctcctttttttttttttttttaaagacaggatctcgtcctgtctctcaggctggagtgcagtggtgtgatcacagctcactgcagcctcaaactcctgggctcaagtgatcctccagcctcagcctcccaagtagttgggactacagacgcacaccagccagctaattttctattttttgtagagatgaggtctcactttgttactcaggctgatcttgaactcttggcctcaagtgatcctcactcacagcaggtgcaggtgattgggtgtgatgaggagctgctggtggattctggtttggggaggggtggggtctaattgagatcctaaaggtcccttcccccacactgctgctggcagggaacaggctggagggcagctgtggggatccatgcagcttccaggtgagagaagttggggcttggattagggcagtggcagcattggaggtgagagtggtcagatttggactgactttgcaggtggggctgccaggatttcttgatggattggaagtggagtgagtgaaaggggaggccagggtgaggccggctgtcctgcccggtggtggacgtaaacaccatgcatggcttctggtccttagcagccctctgtcatccagtttccttccccaggtccccgagtgtgggtggtgcaggtgtccgtgtggctgcaggcagctctgcctccagggcgccttctgaatgctggggctgcagaggtctaccctcccaatagaccagacagaggcgctgctcctgtatgctacaggggcagaggggaccacagggctgtacctccagccaggcattatagggtggtgggagcagtgggtttgtggcttcacctcgggagggctgggagctgtgactgggtgttgtgtgggggcggccagggaggggctccctggagttggcgttcctgctttagcagctctatgaaaccctttgccagggagtgtgcccagggccttggattctcttcatcaccccacagtgctggcagtagcctctggtgtgggccaatgctgtgccaggggctggtgtacagaggagcggaacacagggccccttttaaggtcatccccaggggtgcctgcatgggttgctctgaaatgctttgtcggggccatcctggaggagaacgctgaagccatgggaactgaggaggcatctagctgagcctgggtggtcagggagggcttcctggaggtggcgcaggcactgtgatatgaaggtacaggggtgaggggcacctggggacagaagaaagcctggcttctttcagagtgggggcttggaggaagagtgggaagtaaggctggcaaggccaactagaccctgaaaacggaggccctccagtcctggtctgcgagcgagcaacaggcagcctcagggcgttccgagcagaggaggcgcggccagactgtgaggttgaagggtccctctgcagcccaggtgtaggagtgggcctggagaggacaaggcggcaggtgggagacctgtgagagtgacagggccgggaaactgaggcgcagagtggggcgtgcttgcctgcagtcacatagcgactgaggaggaagagctgggacgggagccagctccgtccacctccaggtcctgcctggcgagctgccctcgtgtacggggcaccactgcacgcccacaccacaaactcgcctcagctgggcacgtcctttcccagggcccctcgtgggtcaagccgtgcgtcattttgtgccattgtcttcagttattggaatttggaaacgttgcagaaatgcctctctctcccctcatatatggagattgttgcaaagcaagtgctggtttggggaaaggttatttccttcctcgagggtggggagcctggctttcctgagaggggctgtattgtaggcggccagtgcgtcccgcccaggtctgtgtgctggtgaggaagtggtgccacccacctgtgccgggccagggatgtggaggggagcacccatgtgctcaggcagaccctgccagtcccaggtctcacaccttgtcgggcttctggttgctcatctgtgaatcgggggcgcccccctggctatgctgacattgttgcccaggaagagccttgaaacaggaggagggctctgaagtgtgatgaggcccagctgggcgcgtggggagcaccgtgggagttgagcattgcctgggcctgagcccccggagcctgcatcatgagggatttgtctcctatccttagcttctcaatctggaaaatgggcctggtggtaggggcccccagtagggttggtgtgaaggctgaaggatgaatggagagccccaggcccactctggggaggcggacagtgctgctggccgtagctggttcttgagtgtggctgagtgcagccacctgtgtctcccgtggcttctgtcttctggccacggagacaccatcatctgtgttggggccagcccttgggcttgtgatcggggtaccccagtgcttgataagcctcccagagttcttccctccttagcctgggacccccatcctggccctgaattcccagccccaaccttggtcccaagttgagcttttagatgatccagaaagttctgttcttcttagagtctcctcaaaatgaaaacacatcgtcaaaaaacattgatgagcatgcatgcgcgtgcccacacacacgttctctctttctctctgtctcttgtctgtctctgaagatctcgctcatcactgtgttttcttagacaacttccctagtcctcgtggtggttggtgttggctgagcatctcaatgtcctccctcatctctgctcccctgcatggctgtggaaacaaattaatttcaccgttttggcccatgggcatcccaggggccctgatggctgttgtctgattatggggctggtagaggcagagggcttctacggggacctgtgcactttcttggggaataagccagagggtgtcagcttcctttctgacagagtgaggatgagtttcaccaccgtgttttcggctgcatcctcctacctcctgtccttgacatcatacttaataacttaatgttattttaaaaaatcccttccctgttttgcttatatttacttttttttttttttttttttttaaatactgaattttactctgtcacccaggctggagtgcagtggtgcgattccggctcactgcaacctctgcctcccaggttccagtgattttcctgcctcagcctcccgagtagctgggactacaggtgcgtgccaccacactgggttaattttgtatttttagtagagatggggtttcaccatgttggccaggctggtctcaaactcctgacctcaggtgatccacctgtcttggcctcccaaagtgctgggattacaggcgtgagccactgtgcttggctgcttatacttacttttaaaggaaacctttgatcacaactgtagacagaaatcaggatcacttgtcctaaaccagcaatacccataaaaataaatatggcactaaaaatacagtgcttagcatcttagccaccttgtatgccctgccacagccttgagcccgagtgagtgttccctgttttttttttatttatttttatttttattcatttatttattttttgagatggagtctcgctatgttgcccaggctgaagtgcagtggcgccatctcggctcactgcaagctccgcctcccaggttcataccattctcctgcctcagcctcccgagtagctgggactacaggcgcccgccaccatgcctggctaattttttgtatttttagtagagacggagtttcaccgtgttagccaggatggtctcgatctcctgaccttgtgatccacccgccttggcctctcaaagtgctgggattacaggcgtgagccactgtgcccagcaccctggtttttaaaaagaatggttggcaagcgtctgagaggtgtgggaggcacacccgtgctgtctagagacggtctccaatagccagattggttcagagggattcgcggggacatttcctcacaagatcaccgagcgttggtgcttgtccctgaaatcagctgtccttggaacagtcatctctatccctgcccaggaagtcccctgtggtaggggcgtcacatacctcacatctcctggggctgccttggcatgtttcgtgctaggctggggttgatggaggaggccccagccctctagcaggaatgtcttctctgagaccaagtgtctggctctcagggagtggccatgtcctctgtgcccccagctccgtgccctaagactgtcctggcgggttccggctgctataacaaatgtcacagatgagtcggggaggagattgaagatggacatttatttctcagttgtggaggctggaagtctaagccctagatttcgttcctggtgagagttttcttcccggcatgcacgtggctgccttcttgctgtgtcctcacaaggtggggggtgggaagcggcggacggagagagagagagaagggaagagagggagggagggagggagagctagtgagctctggtctttctttctgtaaggacactaatccacacatgggggctccacccatgtaacctcatctaaacctcctaatggggggccccaccccctgataccatcccactggggtcagggctttcacatagaaatgtagggaggacacagatgttcagcctgtaacagactggtttaatgaactgctgaggatggaaacactgtaacaccagctgccagtccctgtgtgaccccaaggcagggtgtggtggggaggccatggcttcctgtgcatgggatgggaggagtgacccctctttggccctagacgttggggttcccagggtctggttgggcatcagcacatgacactgtagcccacctatgacctgggcttggtcccccacagtgacttcggaagttggcctgcccattgctggaagcaggggcccctttgcacaggcttgtctgtgtctgaggctattcaggagacgtaggggccccactacatcctcctggaaggactagtgatctgtcagccctgggtcaagttgcagccaccaggactccctcacgccccatctttcttttgtctctgcctttctctgtgagcctggttgattctctcgaaatgaggcccgccacatggcaggaaatgtgcccaccttcagaacttgctgtttcttcctctgcaggtggtctgtgctttcttttatttccacttcaagagctcagggaggagctgtgaccagcccagcctgggaagaacatctgccctgggccagtcagctgtggctggggagggtcaggaggtcatgcgttgatgtggccccaggcgcatgtctggagccattccctgagcctggggactgagcgaggcagcctgctgccctaggaggggtctagtctactgcagggacacataaccccagcaactcagacattttggggttaagtcagccatgaatacaagaaggtggttcttctttctttgttttcacaaatgtcaggataattttggttacaggtgatagaaagtacaatttcagcaaaaaagtcatggaactaaaaaaatacagggtgtagcttcaggcatggctgtatccagggcctctgcagatgccatcaggaccgggtctccatctcttgctctgctgttctctgtgttccatactcccaggcaggctctgccgtgtggtggtcaggtgccccagcagctccaggctcaccctcgagctcagaagctctggagcaaggcagcctcctcccaggagcatcagcatgggccatgtgactgggtcgtgtgactgctctgacctgtcactgtggatggggcagggactcctctcattggccatccagcagtccacgtagcctgaagtgtgaaggggggttccccagaggagaaaggctgcagtgattagacccactgtgcagatgaaagcattgctgctcagagggtcacatgctccgaggtgcccagcagcctagtggcagggctaggttcaaatttgagctctgatctctgggagtccagagcttggtcctgctggctgtctcccttggctttggcagcaggggctgactgccttgggggcctccaaggctcttgagcccaacggttataccacagactgggccagaccccgctgttggttgtacactggccgcctcactggcagccctgagaaattcctaaatttcagggccgtgcaaataaattgggcacagcaaaggcctgagggactcgcagagagactgggctgcccgctcccctggctgctgcctccttccagatgctgtggtggccaagggagcctggttctgccgtaggccggccccgcctgcctgtctccatcgctgtctgtctctggctgtctgcttggctttcggtctgtgcttctctccatctctgtcttggtctctttctgtctcactaatggatctctttccttgtctctgtcagtctctgtgtctctctctgcctgtcttttgctggcaccactccccccaccccgccacccaagtctaggatctcagccctttgtgagactaaaaggcggacgcaggagtgaaagtgcctctgtatgaaaggtggacacgtaccttggttgtttaggtcacttagccagtgactagccaggtgacttcagggaagccttttctgtttctgaaggcccttctgggatactcacattcataattcatcccatcctctctgccagccctgtgctcgggccatacggattaattaatctacccctctccactcacccacccatccatatacccacacacccatccatccacccgcccacccacccatctgttcacttacccacccatccacccacctacctacttttttagccacccatccattcactcgtccatccatccatccatccatccacccatccacccacccacccacccacccacccacctacctacccattcatccatctacctacttatcccaccctcagggcttggctttaaagcatggggtgggatttgggtgttcagggttctaggagagtttcaggagagagggcatcgcaggttgagctaatgatgagagaaagataaggggttgggaactagagagagttttccagtttagcaggagttgggtttgtggaggacaacagagggggatgggttaggaaagctaggtggggttagttggtgaagggctttgaatgtctccgttaggagttttttctttatccttgggccacaggacttcagccaggggtctgtgagtggactgcagggagtctatgaaactccctcacatagcagttttaggtatgtgcccatatgtctgttaaggctcttggttgcaagggacagaaaacctggtccaagttaggttaatcaaaaggggttcatgtcattgtgaagttcagtttttcagttagcttcaggcatggctggatccaggtgccaggcagctatcactatgaccctgtttctctttcttggcttttgtgtattttatgagcaggtgccagcctctgatggtctccacttgatgacaagatggcttcaggtacccttgatgttaaatcatcttagtctaatacagtaggaaagagagaagctgtttgcccagtgttttacctgaggtgggtcttatagtctctaattgtcctggtgtccatctctgagtcaggtgctgttgcaaggggaatgggaagtgctgattggagctccagcagggtgatagggccacagaacgaaatctaggggctgttcttggaaagaggctgaatatgtgccaggtggtcagaaaccacccagtgtcgctgcagagcttggttcattatgtgctttttttggtggagctgggtgtgtattatccatagctttttgcacattctccagggggccagagctgatggagaaccattcagggtttggagcagggatgagaggtgatgagcagtccctggaggcaggatctcggtccaggagcagaccatgtggagcatgcctggggattaggactccccccgccccaggcggggcatgggtgtgcctccttctagggtcgggtggagggtgtgtggagcgccaggtggggagggtggtgatctcagccttggccgtgggcagcctcatttctcatcgctcccaccctgggagtgtttcctctttgcagaggagtaacttgtggggaaggaaaataccagctcccttcaatgccaaaagcaacattttctttctcaaaggttgattaaaagtcacggacattaatctttgtaatttttcacgtgcttatgttggtaatgagattagtgattgtgtatgtagggtcagctcttacctaaaatttagggagctttttattcatttcttgttttttcttttttttagggaggagagggaagggaggggagaaaaccctggctgttccacttgaaagattatttttcccagggttttcatgagctcaccctgttgaaggaaggcccagtgaccagtgagcgtgtgaggagcatggggcacctggtaccctaagccccacctgcggcctacagcttggtctgtacttcacgtgtagggcttgccctggacctgctgtctccctcctcctccttggggtctcacaccacccacctgtgtcatcagcctcacctgttcaacagaaaggaccacagacctctcctcatcctcctggcccggtagccctttcctcgcagccaagcttctggtcttttgcacatcgtgctattattaagacatttgcccgcgaggaaatgaaggcaactgtagttttcaagattgaagccaacttgattactttgctctgataatttgtgagtttcgaatcatttcccttccttccgtttctcctgccaacaccttctctggcttttgtttcctttttctggattactgcaatggttcttttttattttctttaaaaagtctctctttctctctctgtcttttagatacggggttttgctctgtcacccaggctggagtgcagtggtgtgattatagctcaatgcagcctccaactcctgggctccagtaatcctcccgcctcagcctcccaagtagctagatacagagtctctttgaagggaaaaaaacacaaacatacaaaagagtacctaaaagtcggtgtagggtggtagaggaaattcttggataaccaccacctgggcaaagcaagaggatactgcccgcccccataggtcctctgatttcccttactggccactagactttgatggtgacaactcctgcttgactttctagttctggttcctacatttgcagtccctaaatgatgtagcttagatttcaccaggttttgtactttatgactggaatctgtcccagatttctcaaaaggggtgtctacagtctgttcttgaattcccagtgtgctgtgacctagtggtggccctgccaccctgttgggacaacatccactaaatgtaccagatgttttgctgaggtccctgggccccggattcagtgactgactgatcgccctctccttggcatctcttcttccttgatgtgtgtccccacccccccgccacctctatcatttttctttgtgctgctcacttcccagcgaccactctcttcctccttccctgcatgccggctgcagtgtgtcaggctggtttctgcctcagggcttttgcacatactgttagtgctgcttaggataccattccccagatctttgcatggccaccacatttttgcatgatatcagcaagtaggttgcctcctaggcctcctcgtctgaccattcttgccaaaggagcatgcggtctgtctctgtcacaacgcccttatctcttccccccatcagaacattggctgcatgcgggtaggactttctttcatcttgttcgctgccatatcccagcacctgcagtgggctggccggtagcaactgtttgatgaatagctgcaaactaaaggactctagctcaactttctcggccagacagacctgttcaaatccccacaccttttactacttatgtggccttggacagatcatttactctgtctgggcctcagtttcctcatttgtaggtattaaatggttaaggaaaataaatatccctggaaactcacagtccagtgattggcattgtgttggcactgaggaagtgatagttagacacgaacttgattaacagctaaaatccctacttgatgctttgtgccaagagcaagtttatttttcccagtgaactagatgacttcctcttatcagagaaggagcaccgggtcaccctctaatttcccttttggctttggctgccaggaagcatactgctaaggggaggtctcaggagcagcccttatttcctgtccatcttcagtgcagttcttcttccctttcttctccctgttctttggttatttacgtttggctctacagtgcacatttgtgattattgtcctttattttggtaaaatatacgtaacatgaagtttacttttttttttttttttttgtgacggagtcttgccgtgtcgcccaggctggagtgcagtggagcgatcttggctcactgcaacctccacctcctgggttcaagcaattctcgtgcctcagcctcccaagtagctgggattataggtatatgccaccacacctggcaaatttttgtatttttaatagagatggcgtttcaccatgttggccaggatggcctctatctcctgacctcatgatccacccgccttggcctcccaaagtgctgctgttgcaggccgcgcccggctgcgatttaccattttaacctgcttgagtgcacagctcagtggcatcatggaagttcacgttgtgcagccgttaccactatctatttccagaactttttcattatcctgaacagaaactgtgtccccattaagcaggaactcctcctgcttcccacctccagcccctgcacccaccattctactttctgtctctgaatttgatgactgtagatatctcatagaagtggaatcacacaggatttgtcctttggtgtctggcttattcacctagcacagcgtcctcagggttcatctgtgttgcagcacgggtcagaatgcccctcctttcaaggctgataatgttgcattgtatggaatattttgtttatccatccatccattgatggtcacttggcttgatccgtgtgactcgagtctatcatgaataacactgtagtgaacttggatgcgcaaatattatttttaaaaaattactttctgggcctcaggtggtctcaggcccactaataaattaagggtagatttttggacagtttctaggatcaggctgtcttccctgcctctgcctggtgtgtggctgtgtgtctgtgctcagtaaactccatggccactgtgggtgcccacccaggtctctcacctggaggtgcacatgtctcccagcggccacaggtgctggctgctgatggctcacacctgtgccttctccagctgcctgccctttgctggcaggtgtcacttccccgtgaagtgcctgggaggtcactctccatggtctttggccagtgactgacatgcctctgagtgggatgcacccggggtgccccccacactgcatggcttctcgtgggtcactggactccagctgagatgcagtcttgcccagctccccctggctctgcctgctttcctttgcccttctcctgagcgctctcccccgacagaccatgccctcaagcgtccctgcctcggactctgcttctggggagccccgtctaagacagtgcgcagctcacatatccctctgagcactatgggtcttgcattactgtgggcgttgggttggattctgatgcagctgacctactgaggccaactacaccatgtggctagaggtggtctccttggaagagggtgagaactcccagcatctatcacatatagaagaggcaggtcctaacccaggaaaccaagctattctggaggcgaccctggggcggggtggttggaggggcaggagctcccacctcatccaggcctctctcctcctggtgtggacaagagacgctcaggccttggagtgttcaggctggtagagatgactcaggaagcccaacgatgccaatgggaagggagtgtgcatccaaattagcccagggaagccctgttgctgggccccacagcttcagtgtcaagtgtcctgacattaaatgttatcattttaaactaattatcaatgagtaatattggcagctaatttataaagcaccatgtgggccccacaaacacatctgtgtgtgaacaggctgggtggctggtttgtgcctgctctctgcttggacttgggcccgggggcagccgtgtgggcacagccagcgggccaggtggtactgattatgggtttctttgtcactgtcttgtctgtgagtgtcttgtgtgtttatttccctgctgccatccctagcagtcccagtttgcaagtcccagtgttttgatatagctgcttattatttttttaaaagagatcccctgcaaatatttaaaaaattttaaagccatactggcgccaacctgagactttgttcttatctacagttgcctcatcaaatggaggttgcccagttaagttggaatttcagataagtgacagatgtgtgccaaatactgtacaggacatccttaaatgctagacagttctccatcatttctctgagatgcctgtgcacatcccagatctgtatttgctggatctcatcagagccagaagggtcagaactggaggtgggaagacctttccttcctgatccagtgtcatatcctgtggcctgtgtgctcactaaggtgggacccccccacctttccacagtggcagcactggggatgtccccccaggtggccttgaccttccagtgtcctcgccagcccagagaggtttcatctggggcctgctgtggatgaatgtgaaggttaatttatcaaaggaggcagtgttgctttactataggatgcgtgtttgtttttgtggtaggttggggcccagccctatcaggacagcagagcgaggagcttgtggccaggtgagagaggcagctggggcctgagccacatcctgaggcacttctgactctgatgtgccggagccctccctccccatcctgcctgccccaggtgccttgtgaggagtgggcaggtctctaggagactcacactgtgtgctgagtcacctgtccctgctggacactccctggggagaccctggctgaatgtctctccgcccccacattgccctgtgcacgttcaagtgatggccctgagtacgtaaccccaggtgtgaaccctgctgccactttagaataccctggtccccccacccacagcagggatttgatcaacaaagaccaaagctgtgatagccccacctgccgctggtcctgtctggagcctgctcttgtgtctccactccggtggcaaagccttgctcacagtgctggatgcactcccagatgctaagtgctgagtgccacttcatggtggcttgacgtcctcattgtcacctaaatgtccattgtcattttggctcttcctgtgaagaatgggccgccaaatacagaggaatggctaggcgcagaggctcacgcttgtgatcccagcactttgggaggccgagacagggtgattgcttgaggctaggagtttgagaccagtctgggcagcagagcaagatcctgtctcctgcctattttttaatgccgtgatatatgttacgcacatgatacgtaaagcgttcatcttttaaaaatgccagcagttgccaaccctcacccctcctagggttgcagcctgaggccagcctggacagtgactggcccggtggcctccacctgccaacctttcctgtccccagatggcagcccggtgaccaccaggggccatatggacctggtacagacgtctctgagtcgcacactgggcgtcagaagcacagggtcatggagtgcatgtgctgaattctcacatgggtactgccttgcaaagaggctgctccaggtgacacttcggccagtggcataagaatgataataataccactatcctagtgtttgccttcctgatgggtgcaagggagaggctgcagtggttttactttgtatcttgttgtttcttgcgtccccacccgggagggctggcttggtgcagtgtgactgcctggctggccaccgcagccagtcccaggggctttgtttgctggccaggctctgactgctgggactgtccccccgcagggaggtcaggcctccttccccaccccatctccaggggcttcttttttcaggttgctgaggggtgggagctgtctgcagaagccggggttgtgggaaaactcagctggagctcccaggaggggcatgtttgattctgtgaccctgcagtgtagagactgtgccctcctgcttctctcttgtacgagtgtccccagccctgcttgcttatctctggcgatagatagggagctcactccttcccagcagcctggtcagtccctgccctggagggagtgttctccacttggagctgacatctgccatctcctccatgcccccacctcccgccccacacatacacgccccattgggagcagctgtggagatgtgaggacagtgaggtctgctattctcccaggtgagccaccccaaggggcctgggccccctcaccacgtgggccactccctctcgacacatcccagatggtcctttcccctcctgagtggacatacaaccatcagacagcaccaggatactctgagctgcatgcatttgggggggcccagacgacttggggaacctgggagctcacaccccatgtgacatctcagggtggccagagctctgtggcttgaaacaggagttggaaacctgaatttttatgtgaacgttttcaatttatgcatgctggtaaccaatttaaaatgagaaacccactgtgtgagccaaacgaaagcacttatgggccagataatgctggtgggcccccgactatgacctgaggtatggtggaacacgttcactgggtggatgcagaaccagggctcagagagggccagggccgtgcctggggttgcgcagcaaatgtggaaaatgcagagtcaggcttgggcctgatgttctttatcattgccctgggcctggagtggggagatgggcaagcctgaggtttgggattgcttaagcatggacagaatgtgatgctgggggcctggggggccaaggggccaggtcaccctgggggctgtgccggtgagcagagcaaggggatggacttggtggaccgggtggtggggcagggtgggctgggaaggaagttcttctggaagaagttctaggacagccctgtgtcctgtggctggggtactgtcctctcaggacacaacgttcatgcctaggtgtgtgatgcacctgaaggcaggagggcagggagcttgggtctcagttcaccaaagatttccttttgttttgagacggggtctccctctgttccccaggatggagtgcagtggcacgatctcggctcactccaacctccgcctccggggttcaagcagttctcctgcctcatcctcctgagttgctgggattacaggcacacgccatcatgcctggctaatttttgtatttctggtagagacagggtttcaccacgttggccaggctggtctcgaactcctgacctcaagtgatccgcctgtcttggcctcccaaagtgctgggattacaggcgtgagccacctcgcctggccaaagatttcctttcttaaaagacactgtcagctggcacggtggctcatgcctgtaatcccagcactgtaggaggctgaggcaggagggtcgcttgaggtcaagagttcaagaccaatctgggcaacacagtgagacccttgttaaaaaaaattagctgggtgtagtggtgtgtgcctgtagttccacctactcagaaggctgaggtgggaagatcgcttgagctcgggaggttgaggctgcgatgagctatgatcacacaactgtgctctagcctggacaacagagtgagaccctgtctctaaaaacaaacagaaagaactgttgagagtggacctgagggcctctcccttgcagtctggagggtccttgcttttgctgactgggagtaaaggccctgattctcccaggggcccattcctaatgtcagtggctttacggagtcctccagcttcctgaggtggcacctcagtgtgagggcaggggcgtcagccctcgaggccccagaggctccctagcactccgccggccctgagcctggtctgggcatgggcttccatctccctgcccgtccatggccctccaccgcagccttccctgcctcggtcacacaactcccccttccaggcgctcctggacttctgtcttctgtccgctgcatcctatccatcagcaaatcctgtgggtcctaccttcaaaatagatcccctgtgccaccatctcctgcctctcttcgctcactgccctgggctctctcacctgctccctgctggctcccgtgtctcagcgcagtgggcagctgggtgggtcccttgcactggagagtcccaggctccagcgcttacaggcacgcccagaggccctcacagcaggctggaagcccgttgctctgcagttaccacccgtgtgctgatgtggctcagccctgggggccctctctgtccttcacctttctgctgctggtccggcctcagccccttggccctgccactccctgcctgacgccctcctcagagaagccctcctcttccgccggactgacacgggctcccctgacactgccacgtcctccttccgtctccttgattcccttcatttatttcatcatggggctcatgcctgcctggcgttcagttctctacagatttgctcttgggtttattatctgcccctccacccctgagggtgtcagtgctgtgaggacgctgggaacctgtcttgctggctgataaacccctggttcctagaggggctgggtgcagaggaggcgttcctttagaaatggggcaggcttggggaccactgctgtggtaacgagtcctgctgtccctctgtcactgccctatggggctgcgctttaggctgggagtcggagaaggagctcttgcctgtgactttggggagcacgctgtctataagagtcaggtacggccactgggtcacaagtggggctacaggcactggggacttgggccagggtggaggagggaggaggcatgaggactggtgagaaggtggcatttgagtggcttgtgcaagatgagaggggagaagagcccttgggggagttcaggcctaagggcctgtgggagggtcgggttgggatggctcctgcagggccttgagtgccaggctcagctgggaatccagacctttcctttctggccatgggaaactggggcgggctgtggggccgtggcatgtcggggccagctgctctcaggccagactgggttccctgggaaaggggaggagtggtgggcagggaggtggcggggctgttccagtggagatcagagctgagactggagtggggacagggcctagagatggaaggaaggggtagagaccgtggggagggagtggagacagattgcggggagaatggacatgactgggggagttggtggggtgttagggacagcaaggcatcaggatgcatttgccagtgctactggggagggggacaggagcgtcccctggggctaagcctgcagtcccgagggtctcagaggtgtgttcctgagtcctagggtctgcgggctggggctgtagggggcgtcttgttcttgcctagcatttccccactgactgtattttctggccagcagctgtggtgcgtggctggggactgagtcaaggatctggggggagggattggtcgggtgtgtgcgtgggactgtgcgtgtgagaccgcccagggtgtgtactggcacgtgggcatgctgtgggtgagacagcgtgtgtaactgcatagaggattatggggcatattgcctgacgtgccctggtgagtgtgaccgagtgggtgtggggctgtgcatgtgtgtgtgtgggcacgagggctcactcagaggacctgcctcagaatgcaggtgaggatggaggatggagtggcccagcaaacacgtgtggggctgtcagcgactccaggtcaacacctgtggcgcccagcgactagacactcacctgtgtgtgatctgacccatgtgtggcggagcctgtgtgtgtgtgtgaggcagtgcttagtgtgctcctggggatgagcgcatgcgtgtgaggtggctgaggctgggcccctgcccgcgtgcgtgccggtgtgcaccgtgtctgtgtgtgcacacccagtactgacaggcttcctttctgattcccccagggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggtaagaccctgtcctggttccttcagggcactttgtgtgggaagggcagccttgggctctggccgctgccccaggtctctgcctggggctggggatgctggactgtggggccaggcctagggtggccaccccaggcccttggtttgggcaggaggctgtgagagtgcatcttctcccaggcccagctcttgggatgggatgggtgggtgggagtggggttcctgttgtgggaggtgctgggccccctggtagggctgcggtagtggtcaagggtccagaaggtgcacatcttcagagctgggggccctgaggagggttcctgcctcagcccggtaggcccccacgtgtcctggcaggaaatgcgaagggcggtctcttctcagctgccccggtggctggcctgtggcctaggagcctagcatggccacctctgccaatttttcaacaaatgtcagccagaaagctgaattttatgtgacatcttcccatttctaagtgtctgcagcaaatcctaatctcacaagcatgtgttgtagaaagaagtgaactcgtggacagaggcgaggtgggtgggccatttgagcaggggcgctggccatgctgggccagtggaggtggtggggccacaccagctgtaccctcactccatggaggcccctctccgagctggtcaggcagcttcccatcagtccttccagcagcaccgagtgcttactactatgtacgctgtttcaccagtgaggcaactggggctcgagggtggtgctggaggctcaggtcacacaaccagtgagcagtgggcctggaaggccctggagcctgcactcctgaccctatatcctccaagccacctgccacagagttcaatacactccatcgggcacatcagagcaggcagccaggaccagggcacccaggcttcagatagggaccggcccaaggctgtgcagaggctggtaggcggcccaggcctcttcttgcccatccatgcctgctcccagcaggtcctccatagcccagcacagtcagacaccccatttgaagaccccatgagctgtggcgagaaggggaatggtccgctgagcctacctaagagccgtcctcaaagggcgctgctgctaagcaggggccacagcccccacgaggctgaccccttcctgcttactttaggagccttgaactcctgcagggggtgattctgtcacaagagctgggggcttgcagatccagaagcctggtctagcttccatggggacctggggtgatgctcctaagaccccacgcaggtttgaaacccccgtgggccaacactggagaggagaggcttcaggagtcctctagcaaacaggttaatctgggtggataaccctgtgctgccacagcctagggaatctgggggcctcacagacccacagacattggaaaggcccagagctccgtcagtgtgagaggggacagccccgcacctggggggagcgcctcaaacacaaatcagatcatgccaccttctgccctatatggctccctccggccggcccctccccagcctcttctcacaccagtcagagcttcctttcaatcaagttcaattccctctggctaaggggcctttgcacgtgctgtttcccccgcctggagcacccccttctcaccactgcccacttatcacctcatcctctacattgcagctcaagtggaagctcaagactccctgcagggagccttccctgacccccaggaggagtcagatcccctgagtgaggctcaccacttcactcctcagctcgtatcactgctcagaacatcacacctctgtgactgctggggtctctatctcctcctcaaagccccaagctccccaaggtcagggtctctgctgggttttgtgaaccctgtacattcagcatcttaccggctcctgtgcacatgctgggcactcagaagccactgtcagagggtgggccgggcgtggtggctcacgcctgtaatcccagcactttgggaggccaaggtgggtgggtcaccagaggtcaggagttcgagaccagcctggccaacgtggtgaaacctcaaatctactaaaaatacaaaattagtctggcgtggtggcaggcgcccgtaatcccagctacttgggcggctgaggcaggagaatcaccacctgggaggcagaggttgcagtgagccaagattgtgccattgcactccagcctgggcgacaagagtgaaactcaaaaaaaaaaaaaaaaaaaaaagggaaccactgtgagaggttgaagagctgaagaaggcagaagagaagcctgcttccaccactttctgcccctgtgtccacaggcggtggcctgagctccctgtagcccactctccactcctgtaaactaagagggctgttgtgaggactacgcggctcagcaatcacagagcgccgagcacggtgcctaacagagtcaccgtgttgaggggcgtctgcagtggacagcagcagtcatttgagttttagggtttccctgttagccagagcatcacagcattcagatactcctgccctgcagaacctgcgtgtgtgaggccctgaggaaggggcccctttcctgccatgcattcctggggccacaggctgtgctgagaggccttctgcaggtcaggggctgcccccagctgctctgggaacctccgacctcctgagggccgccctgcccgagggttcctccgtgtggccctccattgtgccagccctgcgggaaaagccgccctcacgaagccccttgagtgacaacagacgtcagaccccttcttcccagcccagggagccgggcatgtggcttccattaggccacatctggacatgctcagaggcagggatggcctggccgaggcagtctggatccctggcagggctccagctcaaagacaggacccccagcccagccaggcctggggcactggctggaaaccccttctctaggccccagggctgccatggcaacgcggctggaggggtcacttctggccccattacctccctttctgcagggcccagggctgagcagggcaaagccacctccccagcttctcctcaccaagggctgctccatcatctagatcccccaaggcctcccccaacaacagcagccaggggcgctagggtccaaaccccacttcccccaagaggctcagttgggcagcccgatcccccacccgctgggcttccatctcccacccctcccatgctgcgtgcacatggccgtgaccagggataaacctgcctgtgtacatccctgtaacgccctcctcccccattagactctaaacgagggcgaggttgcgtctgccttgctcactgtcgcagccttggctcagtgagggtgctctgtgagtatctgttgaagatatcagcgggtgggctgaggacagacggtgactaatcatcgtcgcatttctaattgctcagcaagtcctcagctgagtgttggacacaaattagctcatttaatcctcaaagcagccccatgatgcagggacttccctgctgcttacaggtggaaaaactgaggcacaaaaccataagccgcatgctcagattctgtgggttgagccagagcccatgaattcgtgatgacaagtgggccatgggtgggcagaagggtgagagttggggtgcggctgtggatgtttatctggccaggcctgagcttctgggtcccctttgaattcatcctctacccctgggtccttaaaccttccattccctgcacaccaaacgctgcagctgcctgtccctgccctaactctggtctctgggcctttgcgtttgctgggtcccctgccagatcagccgtcagacaagataagggggactcagttgggggcctaacagccagcagtcctcatcaaagcccacacctaaaaaatctatttgagaaagctcagggcagaggggaaaactggggctcctgataacaaagctgctctctaggatcccacagcccagaccacagagaggcctcgggcatcaagaggcaggactgggggccaggggtggggctgcttctatttcagaaaccctggaagctgcactgcatgcaccacgcttctgagcctggctgcatgccctccctggcacacgtgcacttcattacacactccacccacaacatgcatgttccgctcctcccccatcccagcccaccacctcccaccaccaggtcccgcctgtgacctggtgctgctagccacacctcttggactgtgctctgctgagaatagggagatggagcctacctccccagcttgttgggaggatcatatcacagaaacaagagccgggcacccaggaggtgctcggcaagggcgagttctgtgccctgcccaccgtaagcaggctggaagcagagttggcaggggtggcagccggtaggcctggaggaacccacagagaccccagtttcaccctcattgcatgtgcatgggctttgcacatggtccatgcccagcaagtgctgtgggaggacttgggagatgggaaaacaggatccaagctggttaagagccttgcccaaggccacagctatgggcagcagaatgagtagatgggaacactgctgacactgcagagcccctcatgccccctccttcaggaagccttcccagatatcacacaggcctctcttcctcacagcccccagtctgtgaaccaagtccatactggttcatctctgccttcccagggatgccaggacatgctcagagctgacacctgatgaaggctgtagagtaaatgatatgggattgaacaagacacaggcatccaactgtggggacagatctctagaaacctcagaagggagacaggaagaaagtagagctggagctgggggagggggatgagtgaaggcacaaagattcaggaaggcttcccaggggaggtgctatctgagctggccaggaacagtgtaagcaaatgcttggaacagaggggagagaggtcggaatgctcaggatggcaggagaactagggtgaggaggaattactgagagaaggggtggtcagggggatcccccccccccgggttcactcatttatccacccagtatttatagcgctccaactgtgtgcaggccctgctagaggcccttgggctctgcagagaatatgagaggtatggtccccaccctcacctcacagtgctgacattctgttggggaagaaaacagtaaacaagtccatgggaattatctgctgtaatgtcaggtattgctaagagaaattaaagcaaggtgaggtggctcacacctgtaatcccagcactttgggaggccgaggtgggtggatggatcacctgaggtcaggagttcaagaccatcctggccaacatggtgaaacccctgtctctactaaaaatacaaaaattagctgggtgtggtggtaggcacctgtaatcccagctactcaggaggctgaggcaggagaatcgcttgaacccgggaggcagaggttgcagtgagccgagattgcgccaccgcactccagcctgggtgacagagccagactccgtctcaaaaaaaaaaaaaaaaaaagcacagtgagaggaagggtggatggacaggggagtcctccctggggcggtgacccgagcagagagctgaaaggggaggagcgagccacgcgtgcacctgaaagagggagcggcgagtgcaaaggccccagggcaggaaggtgcctggacaggaggccagtggagccgagataagtgggggagagggagggggataggagatctgggaggtcactggggcaggctgtccagggcctgtggccaccatgaggactttggcttctactctgaggtgagagctacagcagggtgttgaacaaaggggtgacactggccaacttatgtgttaacaggatccctggctaggaggagtggcagagttggtacagggccctcacaaggagctcccaaaagggaacacatcctctctgttgtcagtacagagacccagagcacagctgtgcatagaggctctgctggagagaatgggagcaggtggctgccccaggtccacagagctccgtggctggacaggtgccctgcatttgctgcagtcccctccaggccagctccccaggtctcattgccaccagcccgggggcagctgggttcaggccctctgctcaggggcatctgtcagaaacagcaagtttcaccctgtggcaacctggagatactctgcatggacatcccatttcatggaagagaaaactgtcatcttggggctgtagcagggggccccagtctcccagtggaggaggagggcttgtggttcccatgggggacctagaggtacaagtgggtctgggtggctggtagctgggtgctccctgtgtttgcctgcctgggcaaaatgcgtgcatttcacagccggacccaacccatcttgagggtctggggccaaggctaggcctgcggtgggtttctttaattttaaaaactaactctgttagtttatgcaaataaaaccactttattgagatattatttgcatgtcataaagtccccactttgagggagcagaatctagtgggttttagtagatttggagttgtgcagacatccccagaatctaatctcagagcattgtcatcactccagaaagacacccacatctgtagcagtcactttccattccctctttctcccagtccccggtagccaggaatcttccttctgagtctatggatttgcatattctggatatccctggactctctgggaatcatgcactatgtggtttctagtgtgtgactctttcacttagcacgatgttttcagggtccatttcatgtggtagcatgtgtcattaattccttttcatggttgaataatgttgtatgaatataccacatttcaaaaatctgttcatctgttgatggacattattcttccagcttttcagtattatgagtaatgcagctatatatattcatgtgtaagtttattatatggacacatgttttcattcatcttgggaacatatctaggagtggcattgctgggccacatggtaactctgtgtttaacccttagaagaactaccagcctgaggccgggtgtggtggctcacgcctgtaatcccagcactttgggaggctgaggcagacagatctcctgaggtcgggagttcaagaccagcctgaccaacatggagaaaccccgtttctactaaaaataaaaaaattagccgggtgtggtggtgcatgcctataatcccagctgcttgggaggttgaggcaggagaatcgcttgaacctaggaggcggaggttgtggtgagccacgatcacgcctttgcactccagcctgggcagcaagagtgaaactccgtctcaaaaaaaagagaactatcagactgttttccagagcgactgcaccattttacattcccaccggcagtgcacaagggttccagtttcttcacatcctcaccagttgttatagccatcctagtgtgtatgaaatagcatctcatcgtggtttagattgcaattccctgatgactaatgatgctgagcatgtgttcatgagattgctctagaaacttctagaatacgcaagcacacatcccattagcctcaaagtgatgacatcatcacactgtcatgtagtctccagagaagtccactatacactgcactgggggagagtgtatgaagaaggcaaccaatgtcctaatgttatgacaaacataattttgaccttatggatccctgaaagggtcttggagaccctatagggccaggaccacacttgagaaccactggtcagtgcaactacaagcatgtaggtgcgtgcacgtattttcacaagcactaacataggacgcacagcgttctgttctatgcctttttcaaataacaatggatcttggagcttttccctgtcactgcatggaaagtcccctttctgtgtttgatggccgtggtgccccacagcatgcaaaccccatctttgatttaccggttcccttactgatggatattcaggttggttccagtcttttgctcttaaaaagcgatgctgctgtgagcatctctacaccatgccccagtgtggaattgtgaggtcgatgtgtctgtgctttttttctttgtacgctgttcattgacacataaccactagaacctgtcagaagcacacaactcaaatgaattttcccaagtgaacacacctgtgaagctgaccctcagctcatgagacaagagccggccctaggaagcctcctttgtgcccctcctaggaaaccacctctcttgacttctaatggcagaggttagttttcctgctcttaaacttttataaatgaatgaccgtgccattgcgtgtatcgggagggggtctttttgattgttgcatagtgttccgttgcagggatcgaccctgcctagcttgttgttccccggctgggggcattggggttgtttccagtggaggccatgagctttctctgccaggcttctggtccttatgcctgtgcatttcagttgagaggtgctggctggctcagctctaggagatatggatgtaatttttttttatatggacgtatttttatagccctggtagacgttgttcacttgttcgccctggagggtgtactggattttacttacacctgcagtcatgagaatgtctctttcctcgttctattcatgcgacaaatatttattgagtgcctctctcaccattgcaggagccggggagacagggtgagcaaaacagacaagactggagctgccagtcgtggggtggggattcacacagtcaacaaaatgaacatctgaaatctggcacgttagatggtgaaagtgctaaagaggaaattaagcaggttctggactttgccagtctgagaggtggggagcagcctctcctggtggttttagtttgtgtgtgcgtagctctccacccacctcgtctgatggttccccagtgagtctcactggtcacactcccaccaacactgctgtggggtggccttcctgccattctcgctaaaccaatgttagtctttcctccttggacacacctcggccatgtataaattacccattgtcacaggaatgcaagtgaggcaaccacagctcctccgtagcgcacacagtgcacatttattattgctcccaagtccacgggccagttgggcagtcctgctaacctggccaggcgtggctgacacctgctgggcctgaacgtgtgtctgtggtcacctggcagctcagctggtccgggatggcctcagccaggatggctcatgtctgtgccacgtggtctccagctggttagctctggcgtgttctcattgtggaaacagaggtccaagagaaagattagaaacacacaggtgtttaatttaggatcttgaagatggagagcactccttcaatgattaagatagacttgagatggagattgagattttattacttcctgggggatacgtggtgcacctgggggccacacacacgcggggaagtcaggggcggcaggtggggggtgggggggaggtgtgggcctggggcactggctttcactggggtccaggatggggaacatgaaagtccggtagtggttgggcactttaaagcaagcaggcctgagatttgaaacaaaccaatgcaaagtcctttcctggacggaggtgttattttggaatcctgctggcctggaggtcaggtgtgggtttggggaaggagctctctgggctgaagtagaggaaagacagcaggaatttatcatctaagttaggtggccaatcagacgtggaggctgaggtagtatgcgtgccgtaaacctcaacacccacagactcttgcacctgggctccgaactagcagggccgctgcttttgccacattgtgttggcagccagtcaagaggccagcccagggtcaaggctcctggccacgagagtcactgcagagtcctgctgccatggtggggattaaggagggggagaatgcaggcggtcagttcagtgggtgcccccgtgcctgaccaccaagccccagaccccgtgccagtgcttcacgtgcctcctctcatttagttcccatagtgaccctacagcaaagggattacgagtcccttcccaccgtggtgtcaacctgtgcctggccatggcctagggcgaggaagtgttgagcccagctctgaacccagatctgttgacataaaaggcatctctgtgttttctgcttgggtcctggcacagggctccccaggttagaggctggctcgacccttcactagctgtgtgacctcaggcaaattgcttaactgtcctgggcctcaagatttctcatctgtaaaaggggcttactgttggcttcctcccagagctgtgttctcaatgggaagaaagcctgcagtggacaccaggtgcaggggaggcctgccacagagcagagctccactcatggctggcgtcccggatgctgtggttccaagtcctgaggccctgctgagagggtggcggccttcgagccctgggctgcatcctgttcacgcacccaggccaaggcagcagatgcggctttcctgaggctgaaccatgcctaggagtccttggcctcctgagccttccagaatcctgggggcctcagtgagctggagttcaggatctgtgctgcgagtttccctgcgggcaatgtcggcatcctctacctgccagcacctcctcgaggctaggccaggctgtgggcctctaggacctctggcctgcagcatccggggctttgaggtgaagcttctggttgagatcagaattgtgtgggctggggctctggtgggacctccacccccttgtccactcctcggcctccatgctgggaaagtgggcttggggccaagttgcagtgagattgagcctgctttggccctcagagagtgaattcctgcctctgccgctcgtggctgtgtgacctcaggcaagcgactcaccctctctgagcctcagtttctgcatctgtacaatggggcggtcctgttagtctcaggattactgagaggagcaggcgggctaacggcagccagcacagagtgctgctccgggccacgggctgcttgcctcatcctgccagaggttctgcaggaactggggtggcgggggagggatgagaagagggctttgtgttcttgtttcttcaaacagatgtagatgtgtatcttctggtggccagaagttgtcccctctggcaaaagagcagaggagccaggcctggcagggttgggcaggggccgttccgctgctatgtttgccactccagctgcctccagatgtgcagcagcgtgttcctcactggctgtctccctcccatgctgcactcttgtttcggcccctgccaactgcgtcagcaaacgcgcgagctgcgagacccctccttcagccatactgcctggctgcaaggctggcttcccacagacaaggggaggggcaccctcctctactgagtctgcatgcggggccctctttgccaccctcacaggtcaccctgcatcagtggagcatttattatgtgccaggcactgtgttaatcactggacgcgtatcagtccattatgtgtcgtgaccccgtgaggggatgtcatcattatgtccattttgtagacgaggtgactgaggcccaggcaggttaagtgaattgtccatggttcctgaaaccagtgaagtagacgtttgccaacccctgacttggccccctgcaccgggcacttccacctcctgcctgctgactccctgagtttgcctggctgcccagtgtgagcaggcatttccctgttgtgggcagactgaggcttcaggactgtctggatggctggccctcaaggggcaaagctgagcccagggcaagctggcaggcctcaggctctgcactcgcccccctgccccaacccctcaggcctctccctggtaccttcctggtcaaggtctaggccggtggacctggtgggactgtggttccaagtatagtcaagggccacataaggacgttttggtcagtgatagaccccatatataaaggtgggattagcaggtaggcaagcctgcctggcacagagggcccagaacctgggggtggaggagtagggagagagggagtgagaggctttctctcctgcttccagccccgtcctctagcctgcccccctcaccttttgggtgccagagattcagcaggaaccacaaaggtgaagacccttagggatgagggtccctgctgttaactccagcgactgtggccagctggcctttagaatgcatgcaatggagaagcagcactagaagtctgggagtgaaacagcttgttggaaagtgggggccgtggggaccagagactgtacctagaacacaagggcagtcgctcctgctgttgccctggggccgtggaggcctggcatggtccaagattttggattttctacaagaagcctgggatctggaacttcatatgacagctcccaatttgtaaatattagcaattcgttcacatatttttaaagcacccacaaagtacactacaggcacctgcttgctgccatagcttggactctccctctgccacccctcctgacaccactaggatgacacagaggtccagtgctgggtgaggagctggctgagagctctgcaggtgcagaggatgggggcccaggagccctgactccaacccaggctctctctgcccagacctcccatcccagctgagtcagagctggtgggatcagtgtcatggtgaggctacatggagggctgagggcagggacctgcaggttactgtgcagtacctggaccagcaacagtgggagctccacccctggcctgcaggggagactggtgagagccgaggctccagggagtagccgtggccataggtagaggcaactgtgcctgtatggggaccccaggatgccaccctccaggccagcctccctcaagaaagagcagggctgacgggtggaaggtgggtctagggcagatagggagtgggcagtaggctttggggaggatggccgtgcgggtatggtggttgggaatcagggactgtccgcaatgccaccacacaggcatgggcgtgagatgagcagcctcaagctcatctctgtgtgctcctcacatgctcacacgggaggagttagagtgagctcagatgcccaggtagagatgccatgttggcggtgggaacttgagcatggagctcagggcacaggtctaagctagaggtggaagctgatcagagaatggctgtgcttctgtcccttccccaccaagctggcccacctggcagttggggctgggttggtggtgggtgagtgatggaggacgacctcacaattcctcatctgtcaccgtgtggcccctggagcctggatgcaggagcagggaggccaagggtcttgccagaggttgcttggctggtgggggcatggctgggctttgagtggagctctctggcttcctggctttgtgcctcacaccccccaccagccgtggccatcaggatagaagtgtttcctgcttggcgtgaggctggtgagcgtgttaccctgacctctcctaggcacctttgatcagtgctgattgcttcactttgagtgtgcagagtggccagttattctgcaggagcaactagacagaggaaggatgtattttagtggggggtgtgcatgggggaatcagatcaatcagtgcctggtcaagttctaggaaggcgggcctggtggtacagtcaagcgctgcataatgacatttccatcaatgatatactctatatgtgatggtcccatacgattatggtgaagctgaaggagctgaaaaatgccttttgcctagtgacagcgtagccattactcgtgtttgtggtgatgctggtataagcaaacctaccgcactgccagtaatacaaaagcctagcacatgggctgggcgtggtggcttatgcctgtaatcccagcactttgggaggccaaggcaggagaatcgcttgaacccaggaggcggaggttgcaatgagccaagatcgcaccattgcactccagcctgggcaacaagagtgaaactctgtctcaaaaaagcaaaacaaaacaaaacaaaaagcctagcacgtgtagttagttacagtgcatcatacttgataatgaatgtctgtgttaccagtttatgtatttactatgtttttgttgttattttggtaggcctagggcactactgtgcgctagtgtgttatttggctttctacttatttgaaaaatagttaactataaaacagcctctggcaggtcctttgggaggtatccaggagaaggcattgctatcataggagatgacagctccctgcatgttactgccccttaagacgtcccagcgggataagatgtggaggtggaaggcggtaatattgatgatcctgaccctgtgtaggcctaggctagtgtgtgtgtttatgtcttagtttctttttttcttttttcttttttttgagatggattctcgctctgtcccctaggctggagtgcagtggcgtgatctcagctcactgcaacctctgcctcctgggttcaagctattctcctgcttcagcctcctgagtagctgggattacaggtgcccgccaccacgccaggctaatttttgtatttttagtagagacggggttacaccatgttggtcaggctggtcgtgaactcctgacctcgtgatccgcctgcctaggcctctcaaagggttgggattacaggcatgagccaccacgcctggcgtatgtcttagttgtttttttttttttttttattgaaatggagtcttgctctgtcacccaggctggagtgcagtggcgtgatcttggctcactgcaacctccacccctggggttcaagcaattctcttgcctcagcctcctgagtagctgggactacaggcgcatggtgccatgcccagctaattttttttttttttttttgtattttagtagagacggattttaccatgttgcccaggctggttgctaactcctgagctcaggcaatccgcctgtctcagcctcccaaagtgctgggattatgggatggagccacctcacccggcctatgtcttagtttttaagaaaaaagatttaaaagttaaaaaaaaaaaattgaaaataggctgggtgcggtggcttatgcctgtaatcccagcactttgggaggctgagggcggatcacctgaggtcaggagtttgagaccagcttggcccacatggtaaaaccccatctctactaaaaatacaaaaattagccggtcacagtggcgcagggctgtaatcctagctactcaggaggctgaggtaggagaatcgcttgagcccgagaggcggagtttgtagtgagcccagattgggccactgcattccagccggggtgacacagcgagactccgtctcaaaaaaaaaaaaaaaaataaataaataattaaaaaaataataaaaacacatatagagtaaggatataaagaaatatttttctatagctgtacaatgagggcatttatgttttaaggtaagcgttattacaaaagggtaaaaaattaaaatttataaagtaaaaacattacagtaagctaagaggaatttattattgaagaaagaaaaatattttaaactaaatttagtgtagctgaagtgtccagtgtttctaaaatctgcagtagtgcacagtagtgccctaggtcttcaaatgcactcaccactcactcattgagtcacccacggcagcatccagtctgcaagctccatgcatggtaagggccctgtaaaccaaaaataaaattctaaggccccccgccaccaaccatctaactggacttccttctcagcaggcgctcttaaaatttaacttgaaagactggttcaggccatgaagggaagtgggggtcagagaggcctcattatatctctcacattaacttcagcacagactttaagtctgataagaaacattttacagcctagctaaaagcttcatctgcatgataaaactacaccatgcacaacctcttatcccaacccaaacatcattcctttctattgatcccaggtctttagacaaactcaaccaattgtcaaccacaaaatgtttaaatttacctgtggcctggaggcaccccccaatcttgctttgagttgtcctgcctttctggaccaaactaatgtgtttcttaaatgtgcttgattgatgtctcctgcctccctaaaatgtacaaaaccaagctgcactccaaccaccttgggcacaagtggtcaggacttcctgaggttgtgtcttgggcatgtatcctcaaccttggcaaaatactttctgaattaactgagacctgtctcagattttctgggcctgcaggccctatacaggcgaaccactttttatcttttatatcatactcttactgtgccttttctgtgtctagctttgtttagattcacaaatacttaccattgtgttccagttgcctgtagtactcagtacagtcatgttctggacaggtgtgtcgcctaggagcaaggctatatcatgcagcccaggtgtgtagtagtctatgacacttaggtgtgggtaaggacactcttatgtcctcacacgatgacgacaccacctaaccacgcatttctcagaacgtgaccccttcgttaagtgacgcatgattgtgtggggtgaagggaaatggaaagctgccaggcggaggcacggggcgtttggttctggaagggccccagcctggccctgtggcttctcattgggaaccctgagctccaggtcccagaccaccttggctttgctctggcagagcacggctggtggctgctcccagggtacctgctgcctcttctccaggcaggacttctgagtcaacgcctccccggccagcacggatcacccgaggctttgcagaagaccacgctggacagtgctggtgccccactgcctgtttacttctaagagaaaaaaagatccagtttatattatgtgatatttttactttgattttttatcaatcattatttatgtttctaaaaaggtatgtttacgtttctcatagtaaatactggtgtgggaacaccaaaattgctatgtagttaaatatctcttattaaactgtacgtatgatgggctggaaattaagcgagaaagaaaaagcaacagaattaaatcatttataagattcatctataagtaacacaaaacatcattctaagaatcagaattacatcaaacttcagtttgagcagaagtatagtctcttaggtaatagcagttccttaaataataatgaaagagagaattcatagttctttctgagaagggacagtgcacacttttagtgccttgcaagttccacacattctttttaaacagagttaaacttgtcaagaatttctgtgcttctcctgaatcagggcaggccagagttgtgcaagatacttttctctcttttgcatagagttggcccctagacatcgcaacaaaaataacccatgaaaatgcggatgacagtcgcacacatcactggctccctggaaggctgtggaagggtgaggcttgtccatgggtcctctgactgcgaacataccactttccagagctttctaaggagcagctggaagtcaaatactatggggtctcacagcccctcccacccatgttgttgaagcccaccatcaagccccctttggtaactgtgactctcccagccacagctcactaacatcccagggttccacctggaaccccagtccacactaagcagctgggacagactttcagtggggctatttgagggggaagggggctcagtgaagaagggcctcagcctcatcattgtccagtgctctctctcatttgggacacacacacacatggatatttcagtcttgacactgtatcttgcaactctaaaaaatagcgatattctctaatattatcacataccatgaccctatacttcacacaattaccaattccctaatgccttctaatactccaactatattaatctctctcttcttcttcccaaagggtaccgtatagctcgttttataaaagcaatgtctaatcaaggatgattagatatttggtttatttttggttgttaatgtctcctgagtttccttctttcttaaagtttctattgaagcataatgtacatgctcttgagtgtcttttaatccagattaatataacagtactcgtcttagagctttttattagagtaaaatgtatagacagtaaagcaacaagccttaatagaacagcccagcaagtttcttcttatgtgtaaacccaggcattccacagtcaagatagaaagcatttcaagcaccccagagttttcctggtgccctttctcagttcttaaccccatcgctgctggaaaccattattttgacttttatcaccatctattactcttgccaattattttttatttttttgtagagatggggtctacctatgttgcccagctgggtctcaaactcctggcctcaagcaatcctcctgcctcgccctcccaaagtgctgggattataggcaggagccaccatgcctggcctaactcttgcctagtctttaatttatttatttatcgagacagagtctcactctgttgcccagactggagtgcagaggtgccatcttggctcactgcaacctccgcttcccaggttcaagtgattctcatgcctcagcctcccaagtagctgggactacaggtgcccaccacgatgcctggctaatttttgtatttttagtagagacggggttttaccatgttggccaggctggtcttgaactcctgacctcaaatgatctacctgcctcagcctcccaaaatgctgggattacaggcgtgagccaccatgcccagccctgttttgttttctgttcttgaatttattttgaatgatgggaacatacagcgtgatcttgcttgtgtttggcttctttagctcaaggtaaggtatttgagactcatgcatattggtgcatatagcagtagttcatttttagaaaattactccttatgattccattgtaggaataaatcatagttttaaaaatcagttttagtgtcgatggacatttgggttccatgctgcacactgttgctgtgagcattctcgtctgcgtctttggaagacttaggcatccatgtctgttggatacatactgaggactggagttgctgcatcaaaggttatgtttaatgttagcagatactgccaaatggttttccaaagtacattgccaatttgcatccctaccagccatgcatgagagttccatttgctccacatttctgccaactctggcggttgccattctttgtaattttggccagtctggaggatgtgcagtaatagctcactgtggcctttatttgccttctcttacaagttatgatgttgtctacattttcatattactcttggctattttgttgtcatttgcctattttaaaattaagtttctttgtcttattgattcataggggttttaaaaatatgttctggttatgagtctcttgttggattccacataggtgatctcattctatgacttgcctttttactctcttaataaaactttctgatgaattcattgcaaatgttgtcatctgaggaacacaagttccaaattggaatgaagtatcatctattgatctatatatttatgttagtacattttgtattaacaaatggcccctagacatctcacatggggtttcaccatgttggccaggctgcccttgaactcctgacctcaagtgatccacctacctcagcctcccaacgtgctggggttacaggcgtgagccaccacacccggccaatgttttctggcctcttttttctgttccattatctgtctttgcaccattaccactccgtcttgattactgtagccttgtagtaatttttagtatctgctagtgagagttttccagcattgttcttctttttcaagattttgtgtcctgtttaagaaattgatgtctctcccaaggtcataaagatatttttctgtaatatcctagatgttttattgttttaccttacacatttagctccttagtgcatctggaacttgtttctgtgtatggtgtgagtaggaatcaaaattcagttttttactgatagacattcagctggcccagcaccatgtgttgaaaaggccatctttcccctactgcgttacattgttagcttctccaggaatccagtggctgcatctgtatggtctgtttctggcctctcttttctttttttttttttttttttattttgagccagagtctcactcttgcccaggctggagtgcagtggtgcaatctcagctcactgcaacctccacctcctgtgttcaagcgatcctccttctgcctcagcctcccgagtagctgggattacaggtgcctgccaccacacccatctaatttttgtttatttaatagagacagggtttcaccatgttggccaggctgctctcgaactcctgacctcaagcaatccacccacctcagcctcccaatgtgctgagattacaggcgtgagccaccacacccggccaatgttttctggcctctcttttctgttccattatctatctttgcaccattaccactctgtcttgattactgtagccttgtagtaatttttaatatctgctagtgagagttttccagcgttgttcttctttttcaagattgtttcagctgttctgggtcctttgcatttccattgaaatttggaattagcccttttaaaaggctgctagcatctcaattggtattgtattgaatctgtagctcagatttgacagaattgacatctcaatattaagtttccagcccatgaacatgatatatccccctatttattcaggttgtttttattttcttttgggagtgttttgtcatttttagtgtagagttcttgtatatctttaattagatgtattcttagctaattgatgtttttaatactattgcaaattgtattgattttaaccctttattttctaagtatttctggcttatattagtttgctttggcaacagtttatttagctcattctgtgagttgggaatttgggctgggctctgctgatgggggccaggtgtggctgagctcgctcaggtgtttgtggtcagctgggagctcagctgggagatagctggtctgggatggcctctgctgggatggttgtctatgctctctcatcctccatcagcccagcccggactacagagtcccaggagagacagcagaagccacaaggcccctttggatttcacatgtgccatatcctgttgtccagggcaacatagtcacgaggtcagcccagattcaacaggtggggaaatagatgccacttctcaatgggaggaactgcaaagcattgaggtgatttctgcagtcatcacagataggatggcaatattcacactgaatttagcagccacctctggagggttggatcttcattggagtcctgcacatgttaactacccgggcatgggttaaagttaatctgcacactcacattgtgatataaacataaggaaatgttttcaagtttgtctctggtagacaacagcctgggctttggggacaggcagagctgcattccaatctcagtacagtcactttcttcacctttaaggggaaggtaattggctgggcgcagtggctcatacctgtaatcccagcactttaggaggctgaggtgggtggatcacgaggtcaggagttcaaggccagcttggccagcatggtgaaaccccgtctctactaaaaatacaaaaattagccgggcgtggtggtgtgcccctgtagtcccagctactcgggaggctgaggcgggagaattgcttgaacctgagaggcagaggttacagtgagctgagatcgcgccactgcattccagcctgggcgacagagtgagactctatctcaaaaaaaaaaaaaaaaaaagtggaagataattgcccctagcctgcagggttgtggggagaattaagtgggtgacatattcagaagtccccagcacgggcggctgaattaagtgggtgacatattcagaagtccccagcgtgggcggctgtaaccattagcaagtatgaattcttcttctctcagccctggaagcagccggtcttaagccagtgtacctcgtcttcctctgcccctgacactgcaagcttttataacactcattttacctccacttcagagttgagctgagttacagttgacaagctggtatcttgtaaaatgtatagacttttaagtgaacattttcccagttcttttctgtggttgtctctttagattttggagccattatattttcttcccaggcccaggagtcaagcattttttctggagacttttggaaagctcgtagaccccagtgggtgggtaggatactgagggtgcggttaaacccaccctccttgacgtttgggggctgcttgttgaaacatgggcagagttccgtcgctcagagacccacttgcccgggcttgatgggctgggggtggtgctgggcagggcagaggtccctgctatgatgggcttctctctggatggagcagaggtccctgctgtgatgggcttctttctgggcggggcagaggtccctgctgtgatgggcttctctctgtgctcagaccctgtctctcaccattcctgggctcaggggacctgcagcttgggcagctttgattcctgtcctggggattggggataacctcacaaaataagcctgtcgtttaaaccctgtatgtttaaacccttgggcacatcactctgcctccctgggtcttggttttcccagctgggtggtggctgttactaaagtgatcctggctccgtgggctctggagggagggggagccctagcccccgacctgggcccaggaaacagcttttgccaggcttctcaagctggcagagctgaatggtcaagctggctttcaggtgacactcagctggggacacagagggaccccagagcccgggctcccaggtccagaccctatgcaggatggtgcacagctgagagcctgctgtgagagtgggcttggggaaggggccagaggggtggcagggagggccttgcttcccttggaagaactgatgaagatggggacttgaacttccgttcccttctttcctttctttgatgcttggctcaggagcctgcactctggagccatgcagctggggtgagatcctgcggctgccccggctgggtgtgtggtctggggcaagctgtgccttctctttccacagctgtctgctggtctgcaaaatgggggctgaggctgggacgttccttctagagccagagggaagataccgtgggtgcagggtggggtctagcaggcagctctgccaagcctgagatccggccggttggctggactggccaggctggggtgtccagacagtaaacacccacagaggagaaggtgatgtgagggccacagaaagcagtggggatgcagaagccggtgctgagggggctggctggggctgctctgcctgctgaggaaggcatccctcaggctgagttgggtgagctcaggcagagcccgctgcctggccgctcctgctgtttcttagccatcccctgctggtttctgtgatcccggggaggaaggcagacccaggttcagaaaccctttctgtctgtccattttacagtcctcataaaaaaaaactcaaggcgcctccacagaccttcaggtaaccctcccaccctgtccctccacacccccaggagaacaccaaggctggcgggaacatcagggctgcagccttctgtgtgctgtttgctcaggccccacaaatatcctgtccaaacaggggcctggcggagatggccctgtcaccaccctcctgccaggtgtggaaacttctctgcagcattttcaaagccggaattctttaaggctttaatgtcaagggactgggactggctagagcggtcatgacctctgcactggattgttcagggaacccattgtcctatgatcaaaggagcttagaatcctcagaaaatgggtaatacctgcataagataagaaacaaatacaaattacaaaaggggtaaacagtcagtttccttcctccctccccagggctgagtccttccccaagatagccacagttaccagtttcttgggtatccttccagaaataatccatgcatatccatgtatctttttaggaagacaaatggtagcttattagagatactattcaggattgacccttaaaaaattcttcatagtacatgtggaaattctttcatgtaagtgcatgcagatctaacgctttttaacagctgcatacgattagatggatatagcatcagttttgctttgttttgaggtaaggtcttgctctgtctccaggctggagggcagtggcgtgatcactgctccctgcagcctagacctcctgggctcaaggcatcctcctgcctcagcctcccaagtagtggggaccacaggtgcatgccaccatgcctggctaatttttaaaattttgttgggagatggaggctcactgtgttacctaggctggtcagcatcagttatttaatcactgccctgcaggtgggatttaggttgtttctggatctttgctgtcacaaatgcaggtgcatcagaatctgtgatgctcctgtttgtgttcatgggagcatctcatctatcagcagattagatccctacaaggagaattgcagggtcacaaattttttacactgcaatgcatttttattattttttaaatcacataacatgacattttccatttttagttgtgctcttccaaggcataaattacatccacctcgttgtgcagctgtcaccaccatccacctccagaaatttttcatcttctcaaactgaaactctgtctccattaaaccctaactccctatatccccactcccagcccttggcacccaccattccattttctgtctctatgaattgactactctaaggaccccatacaagtggaatcatagtctttatccttgtgtatctggcttgtttcacttaccttgattttatttttaaaatttattatttaaatttaaaaaataaattagttttttatttattatttaaatttaaaaaataaatttgtttatttatttatttatttattttagataaggtcttgctctgttgcccaggctgaagtgcggtggcacgatcatagctcaatgcagccttgacctcctgggcttaagtgatcctcctcccttagcctcccaagtagctgggactataggcacacaccatcatgcctggctaatttttaaattttttgtagagatggagtctggctgtgtttcccaggctggtcttgaactcctggcctcaagcaaccctcctgcttcagcctcccaaaatgctggtattataggtgtgagccactacatctggcctggatctatttttaaaagactcttttagtctttagtcttagagttttctgatcatactacctttttcagtactgtctttgtttgggaggagagcagttcaggaagtgtccacatgggcagcaggacagaaaccatagggtcgcccctgacaccccactccagttaccaccgtcctgatggcagtcagcaagagttccctccttttccttataattttacccccgaacaatcttgcttcattcttctctgttgttgagtctcacatgaaaggctgtgtgcagtattcccctgtgacctgcctctttccctggtgcagtgttggtgtgctccttgtgggttattgcacgtggtggcagtgaggtggctggcatcatgtggtcacactgcagcctatggaccctttctctcatttgtgggcacttggaaaccacctggagaccaccagaatactcagggtcgtgggtgtggcgccttctgctttaccaggggacagtgagtggttttccagagtggacctgctctgtgccacttggcgtgggaacagcagggttcctgctgggcaagggttgtgctcaccctgctgccaggcccggagccctgatgctgtgaagtcaaccgtggcagtgtgttctgaagctgggatgttgctgggccatgtcactgccaaccccaggaggccagagagaatctctgagttgaggctgggctgtcagagtgggagagcacctgcgtctctctttccacagtgctgctgagaaccggcaggtggggaaggcattgctccccctcggcctgagctcctgcaaagcagcaaagtggacagaaatggagaattctcgaaaagccagaggaaagaggaggcagggtaggcgtggctgaaggctgcaccagcttctactgctgaagggatggttgctaatccttccatggatttgtctgcccctttgttaattaacttggaaagtagtcaccaagcgtcttttatgtgccaggagacaggaggctgtgtttactgagtaccagctatttgccatgcaatgagtcttacgttcccacttgtgaaatttgggtggggagagttacttgcccattttacaagcaaggaaatggaggctcagaagccgagtgactcgcccaagtgccccagccagtgagtggtagcccaaccacacacctgtgcttccagtggtggaaggacatgcctgtgctcatcttgtgaccctggtagcatctgctacatagaagtggtgtaaggggaggtggccagtaaggatttgcattcttccttgtcatttccctaaggctgtgcccctgggctccctctcttaaactcttagaacctctttttacgcctctggggcagggagatcatcccaccgacctcttgttgttgatgtgagctttacatgagatgatatacaccaagagcctgaagtatttcacccagccccagattttaccagggacctggtctgtgctgtgtgctgggcactggagaccctgaaatgattaggctgattcttggcccatgagaccctcccaatctggtgattgggacagcctgccacccgacagggacatcatggtcgaaggacatgagtgaagtcagaggagggagctgcttttcctgggtgctagacagagcctgctggacgcacagacaggcagggagtcacatttggactggctcatgagggatgggtagttggatactcgccagttggccaaggtagaagaagggcatcctagcatggaacagcgtgtgcaaaggcgtagaacaagagaaggtgtatgtggctgggagctgagtctgggctgtgctgtgaaggccctgagtctcactccagagagaggcactttatcctgtggggcagtggcttttctgtgggatctgtggagccccaaggctccccaagatgactcagggatgtggaaggccagggcattgtgaggacgaccaggtaagatgatgtgatgagggttgagtaggagttagtttagatatggaagttagggagaccctctctgaggaggagagacccccagaaagagaaggagcctgtcccatagagagtgggggcagcagatggcacagggagaggtggaagattccaggcaggcagcatggcaaatgccaaggccttggggcaggactgagtctgaggagctcctgagtagagagagtgagtgggagagtgagttagagaaaggaggtcaggaggggaagtgggcaggaccccaccgtgtaggactttgtaaggaaagtggagaccacggggggtcataggcgcaggagtgatccaatctgatttgtatttgtggacagtcattctatagccctgtgggtgatgggctggagggtgacagaagtggaagcaaggagggcaggagggggtggtggaggaggaggtggctggtggactgagatgcctttggaggtggccctgtgagtgatagactggagggaggcgggggatgagggattggcctgggagcgtcctgaggatggtagggcctttgttgacacaggaagacccagggagggggtggcttgggaaaatccggagctgagcaaattccagctggggaagtgccagggagacatctggggtggtttcttggccagctgtgggcatgtgcatgtgacatggggggcgggggcaagaggaaggtggcattggaagcttagagatgagatcagccaggccagcgtgtgttggagaagagaagaagccccagggttgagactccaaaagtctggtgctcaggaagttaaaaaacacgacagagagagagagagagagagagagagagcgagagagagagagagcgatagagagagagagagagcgccaggcaggggctggggacctgtgagaggtggtctcagaaggagacctagaggagaggaggtgactgctgggcggagccttggagaatcagggtggagggcgggggcctctggacatgagatgagggtactcactcatcgtgctgggctttgcctggctctgcctcccacattttggatggcacctggcaatgctactcatggcacctgcacaatttcccctcctgctgcaactgggtggccctcccagcataagggtcacagctcctgagctttgtttgagaaggaaggtggccaggagagaatggggggaatcctggcacctgatcaaggaggagcaggcagagagcgccattcaacacccacgaaagcagagccacctctcgagctggtgatggttagagtcccagagacgaccttcaggatcggctgcattaggtcacctgtgcaacagacatggggacgctcaggcctggagaagggagagtaagaggggaaattgaagcttgcgacttcttttttaattttgtacacttttttttttttttttgagacggagtcttgctcttgtcacccaggctggagtgcagtggcgccatcttggctcactgcaacctccgcctcacgggttcaagtgattctcctgcctcagcctcccaagtagctgggattacaggtgcccaccaccatgcccagctaatttttgtacttttagtagagatgggttttcgccatgttggccaggttggtctcaaactcctgacctcaggtgatccgcccacctcggcctcccaaagtgctgggattacaggcgtgagccactgcacctggccatttgtacacatttatggggcaggtacatgtgaaattgtgacgtgtatgtgattcacagtgatcacatcagggtgttgagggtgtccatcacctgactaccgtgcatttttgttaagggtagtcactctgcttgggatttctaactccccagctcatctgtgaaataggaatgctgacagttctcactcttagtaactgtgaggttcctgtgctgggaccctgcctggctggttgctagcgctgctatatttcagctgttactgttatcctcattgggcatcccactgatgtcatctggctaagagccagggaccataatctctgtaaggcaatcttggaagaggtttagggaggaaggattcggtcctgtagaagaatgttgtgagtctgagctgtgcagaagagaggataagccgcctgggcagagttgcctcctgtcaccagaagtattcaaataaggagagtctcccacatgcccagagtgtaacaagaggggacgagacattgaatggtggcgtcactctcagtgaccacagagactgaagtcaggactctggcatcctgggaggtggaggcaggactctgcctggcaccttgtgctcctgagtcctgggacagacatgtctgagccatgttccattcagatggtgagcactgatcccggcctccgacacagcacctctcagttgcccagggtctcctagattcattcagcaaatactcattgaacacccaccatgtgccagggggctgagatatggctatgaggaagatagataagagaccctaccctctgggagctgacattgcaaaggaggaaacagaggactgagaaagtaaactcatccacaagaggctctcacagtgctgactgctgtgagagggttatttatttgtttctttgagacaaggtctttgtcacccaagttgaagtgcagtggcacaagcatggctcactgaagcctccatctcctgggctcaagcaatcccttcccctcaggctcctgaatagctggaaatgcaggcatgtaccaccatgcctggttaaattttttctttttaagagacagtcacactatgtttctcaggctggtctcaaactactggcctcaagtgatcctcctgcttcagcctcccagagttctgggattacaggctatggattttatttctgaagaagattctcttttttctaaaattatctctgtaaattttattctaatcctgcctttatagatttggaagttactttcgtgtatggtgtgatgtgggtcccagcatcataaattctttccctgcaaagtttgaatgccaccttcatcatatattcaattcccgtatgcacataggtctgtttctgaagtcttttctcttccattgagcgccttgtcttcttgttttaattattagaactttgaagtgtattctgataccgttagagaaagtctaccttctctgttcttatttttcagaaatgttctcgggtattcttaagcatttcgttttttggatgaattttagaattaacacgacaaattctgtgacagttacactttgctttggttggaatcgcattgaagttgtagagtaagtagaggagaattgacatctttaaggtacatattagatacatggtatgtattttgaataaagtgtatgttatacccattagacaatcaaattttcgtcttcatgtgaatcaagcatgttcactgtagatttatttctaggtttgtttctcttttgaatgggaattttttcctattaacttttctatttaattgttatgggggtataggaaagccactaatttgagtgtgttgtttttgtttttggctattgtattatagtcattattgttaattgtattaattctaatactttgtgagttttgagtctcttggattgtctaggaagatgaaaccataacatctgccaataacgactgttgtttcttctttctattatttctttggcccttttttctttctttctttctttttttttttccccaagacgagtcttgctctgtcgcccaggctggagtgcagtggtgcgatcttggctcactgcaacctccgcctcctgggttcaagcaatttttgtccctcagcctcccaagtagctgggattacaggtgcgcgccaccaagcctggctaatttttttgtatttttagcagagacgaggtttcattatgttggctaggctggtcttgaactcctgacctcgtgatccgcattcctcagcctctcaaagtgctgggattacaggtgtgagccactacgcctggcctccttttttctttctttttttttaagtttttttttttttaattatactttaagttctagggtacatgtgcataatgtgcaggtttgttacatatgtatacatgtgccatgttggtgtgctgcacctgttaacttgtcatttacattaggtatttctcctaatgctatccttcccccctccccccaccccacgacaggccccagtgtgtgatgttccccatcctgtgtccaagtgtgctcattgttcaattcccacctatgagtgagaacatgcagtgttggttttctgtccttgcaataatttgctcagaatgatggtttccagcttcatccatgtccctacaaaggacatgaactcatccttttttatggctgcatagtagtccctggtgtatatgtgccacattttcttaatccagtctatcattgatggacgtttgggttggttccaagtctttgctattgtgaatagtgctgcagtaaatatacgtgtgcatgtgtctttatagcagcatgatttataatcctttgggtatatacccagtaatgggatggctgggtcaaatggtatttctagttctagatccctgagcaatcgccatactgtcttccacaatggttgaactagtttacagtcccaccaacagtgtaaaagcgttcctatttctccacatcctctccagcacctgttgtttcctgactttttaatgatcaccattctgactggtgtgagatggtatttcattgtggttttgatttgcatttctctgatggccagtgatgatgagcattttttcatgtgtctgttggctgcataaatgtcttcttttgagaagtgtctgttcatatccttcgcccactttttgatggggttgtttgattttttcttgtaaatttaagttctttgtagattctggatattagccctttgtcagatgggtagattgcaaaaattttctcccattctgtaggttccctgttcactctgatggtagtttcttttgctgtgcagaagctctttagtttaattagatcccatttgtcaattttggcttttgttacccttgcttttggtgttttagacatgaagtccttgcccatgcctatgtcctgaatggtattgcctaggttttcttctagggtttttatggttttaggtctaacatttaagtctttaatccatcttgaattaatttttgtgtaaggtgtaaggaagggatccagtttcagctttctacatatggctagccagttttcccagcaccgtttattaaatagggaatcgttttcccatttcttgtttttgtcaggtttgtcaaagatcagatggttgtagatgtgtggtattatttctgagccggcctccttttttcttgttttactgcatttgctagtatctccaggacaatgctatatagtagcatggcccgtgggcattatttttgtaatatttaataattcagtgggggatgtgtctaatgttcccccattgagtatgatgtttgctatgtgcttctggtagacaccagttctcattcctctcagtgcctcagagcagaacagtaacaggttgtgatggaagctgttttccctgttttacagaaaaggaatgaaaacttaggaaagcttggtaacttgccgtgcctgctaaggcaacgcagccgatgaccctcagtgagctcttgctccggttggagtgtgcaggtgccgtccttcacggcatctatccctcagccctgtgcccttacgtgaactgctcaggacatttagagggctttgtgggccttagcacctacacagccattcagtcctcatacagagaaggacactgagtctggagggaggagaagcggctgtcagtggtaacgctgagatgtggacccaggcccatcaggctcagaggcactcatctgttacttgttgccctcagcacgaatgtctaggcattctgtataaacttgacttaggaatgtcactttagacctcaggggcaaacgcttgggttaattacacgtctcatttcttggcatggctcttattatcctctttgcaaggctcttgttttatttatttattaatattttatttcctttcatcttctttctccattcccatccaccacctccatctgcatagctgacagtttcatctcatcagtgtgttttttgctgtcatgtgttcttgcaaagtatgcattgttattttatgtgtgatagtttaaatttgtatagtagaactgatttggcttcttccttttctcccttagtgctgtgttcctccacacttctgtgtgttggtgtgtccagctcatgctgctgtgtgtgtatccagtctattgtttctgacagctcctgcatgtagcatggccccagattttcctcatcctcccccccagtgatggacacccaggctgtccgcaacccctttccacaaataacacttgacatgggcatccttgtactggttgtgttacgggctgtcgtgaggacttccctggcacagacaccaggagcagagcgtctgggtccttgatgttgcgtgtgcttaactgtataagtggtgccacatctctccagctggccgcagtctcctctcccaccctagacacatggacatgcagcagtgtagaggaatacagcactaagggagaaaagggggtccccacctctgtgtggcatttctcactcttactcatatttctagtttaatggatattttattattattttttgagacagagtctcattctgtcacccaggctggagtgcagtggctccatctcagctcactgcaacctccaacccccctccccatccctgggctcaagccatcctcccaccccagcttcccgagtagctaggctaactttttgtggagttggagattcgccatgttgtccaggctggtctcgaactcctgagctcaagtgatgaacccaccttagcctcccaaaatgctgggatacaggcgtgaaccaccacatctggcctaaggagtattttactttggagttcttttttctcttgttaattttcaggagtttattatgttttgtagatggcaattccttgtcagttttggacattccagaaacatttcttaatatgtcagcagtctattatatgtgtacatggagttctttgttatacatattggaattttgaggtaatcaaattcattaatttttgtaacctatagcctgtgcctttgagttttaagacattctcccctacctttgactccttccagcctccccagtcacaaatacagttgaaccttgaacaactcaggagtgaggggtgctgacccgactaacagtcaagaatccacatgtaacttttgactcctcaaaaacttaactaatagctgactgttgacaggaagccttactgatagcacaaatagtcaattaacacatattttatatgttatatatattatatactgtattttttttttgagatggagtttcactcttattgcccaggctgaagagcagtggaatgatctcagctcaccacaacctccgcctcccaggttccagtgattctcctgcctcagcctcccgagtagctgggtttacaggcatgcgccaccatgcctggctgattttttgtatttttagtagagacggagtttctccatgttggtcaggctggtctcaaactcctgaactcaggtgatcctcctgcctaggcctcccaaagtgctgggattacaggcatgagccaccgtgcccggctgactatattctgtattcttttcttgttgttgtttgtttgtttgttttttccccgggacggagtcttgctctgtcacccaggctggagtgcagtggcacaatctcggctcactacaacctctgcctcccaggttcgagcaattctcctgcctcagcctcctgagtagctgggattacaggtgcctgccaccgtgcctggctaatttttgtatttttagtagagacagggtttcaccctgttggccaggctggtcttgaactcctgacctcgtgatctgcccgcctcagcctctcaaagtgctgggataacaggcatgagccaccgcacccagcctatattctgtattcttaaagtaagcttgagaaaaaaaaatgttattaagaaaatcgtaagagaaaatatgtttactattcatgcagtggaagtggaccatcataaaggtcttcatcctcactgtcttcaggctgagtaggcttaggagggggaggaggaggaggggctggtcttgctgtcttaggggttgcagaggtggaagaaactgctgtgttgttccaggggtcaagtgtgtattcaacataaaacttccgtgaatttcctggatgagcttaaacttcccttgctgccactgctgctgttttcgtatctcttgccctgtcttagcatcttaggttgggttccttagaagcagagcctgagttggggggtcttgtgcatgtgttggttcatttggggagacctctcaggagaaactctgaggagtgagggatgagaggtggacaaagctgtggcccacgtgaggtctgaccctgtgggagctctagagtgtgagtggcccccatagaactggctgctttgagagtgggggctgagctctggccccatgttaacctgttatgggctgggctcctcccagcccccatagggaggactccacctcgcagacagttcaccaaagacagttgtgttgtgagctgttagcgaccagcatgcacagcagcaggggtggatgagtttgcctgcccagtaaaggagacctggacaggcccctgcatatctgctggacttggtgacttatgaatggtgactctgcctcatgttgctatccacaggctccaccaaggacctgatcgagacttgctgcgcagccggacagcagtgggccattgacaatgacgagtgcctggagatccctgagagtggcactgaggacaacgtctgcaggtagggtgggctccctggagcaggcggagctgcccatttgccttctccagaaccctgcttgcctaggaccccaggctccaggcagcccggagagagtgcaccttcacatgcctctggggcatgagggtgattgggtgtggctgccgtgcgccatctggccaggctttctccaggggtggaaagtccaagactggtcctaggaacaaaccagccacataaattggtagctggcctagtgagcaagatccgaggaatgtacaatttgaaacaagttttaaaggagtgctgtcccctaggaatagtcgggtgctcccctcaccacattctgcagttgctgccgcactcatgccactcaggctttctctcctctgccctcttcctttctctgctttgctacccttgggtcttcaggaggctggcctctcactgtgctcccttgctgctgtgctggttgtttcttctgactctgataccacagcaaagcaatcctttatccccatgccttcccttttccaggcccaggagagctcttggtcagctgctcatgctttgtttttttccagggaccccgtctaacctactcatttttccaaataagaaagattaagttcagagaggcagtgtgattcactcaaaactacacagctcactggcagcatggctgggattagaccccatgtttcccaatgtccagaccactctgcttcctataaaaaaaatttatgttctaaccttgtctttcccttcagccattctaccaatatggggcaacttaggagttagagcatgcagcactgggacccctggagtttggggctaagcggtcctagtgcatgcttgcatccgtcttgtggacgtgtcccacttcagggggtgctgagccctgtcccccgtaatccccgccgccctgtcctggctctggtctctgcagctgatttgtcagccacctctgccccaggcagcccaacagtgactggcaggcagtgaccagggacccggaggctgtgctcctccaggctgacctgccagccttttctgggattaggtctctctgtcctccccgaccgttgtgggggtggggactctgatgccaacccctctctctcagaggtcatgaacacacatctccgagtctagtgggacccaggcctgcatctgcatggttaagccaagaaatgaaacccatgcaacccagtggaggttgtgccggctctgccacctgcaccggctcccttgctgtggaccttgggcagagcttccctcctctgagcctcactcactttccactctgggaggatgaggtgggcgactgggggctaagttaccccctctgtttcaggacagcccagaggcactgctgtgtctcctacttgcaggagaagagctgcatggccggcgtcctgggagccaaggagggtgagacctgtggggctgaggacaacgacagctgcggcatctccctgtacaaggcaagcctgacctgtggccttcaaggcagggtggggtggggcggggcgggaggctggcctgggcctgaaggtcctcgtggcccaagaagttaggctgtccttggggctcctcctgggagtgaccctcacgcctggggtggaaggactcttaatctgcgcagaaaacatcatcagttattatactgaccaattaattcacagaatatttgtagagcaccactgtgtgccctgggcatcagggatgtagcagtgagtaacacagatggcaattcccgccctcccagggatttctttctggccaggaagacagaggaagatcacgatgaatattttagcacctggcgtggttgcaggcgattgtgctaaggagaaaaacttaaggagaggtgggataagtagtgtcagggctggggagggactgcagtatcagctgacagtggccagggacagcctcactgaggaggggacatttgtgcaatgcccggggtgggggatgtctgtgaaatgctttcaggcagagtgcagcacatgcaaaggccctggggtcagagcctgcttggcatgtctaggctgtgtggctggagtgcatcgagtgacagggggcaggtggagctgagcccagagagatgtcagggctcctggccatcatcggaaggactgtggtttgactgtgggtgaggtggaccccatggggagtttgagggtctcttctggcagttgtggggaccggttattgagggtgtttctctcacatgggaggtgggattgggatggggtaaaaccccaccaggcaacagtggtgcagagaacagtgtgaactaacacacaggcgaggacgttgggaaatggggtgtgtggtccagtggtctggcagcagtagagacaggccaccgggagtcctcaggctggaccataaaggacagtaaatgctgagagctttcggcttcaagcagtgtctgtaaagccgtgggagggatttgcagcaggagatcagtttgtctactagagctcatggtggccactggcggacagggtgtcagtttggctacaagtaatggaaaacttcctggaacactggtttttctctcatatgctgcaggctggaggaaggcagggctgagttagaggagtgagaggctccatggtcatcaggaatggggcacaggcatagtggtcttgccctgccagctctcatttgccacctcttggtccaggatgaactccagaaaggggcaggagagcccccttgttttaaattattattattattattattattattattttgagacagagtctctgtcacccaggctggagtgcagtggtacgatctcgtctcactgcaactccacctcccgggttcaagcaattctcctgcctcagcctcccgagtagctgggattacaggcacctgccactacgcccagctaatttttttgtgtttttagtagagcatacgccaccatgcttggttttgtatttttactagagatggggtttcaccacattggccaggttggtctcgaactcctgacctcaaatgatctacccaccttggcctcccaaagtgctgggattacaggcatgagccactgcgtccagctgaaattagttttgatcatggtgaaatacacatgatgtaaaattgatcgtctgaaccatttgtaagcgcacagctcagtggcatgaagcacattcacactgttgcgcagccgtcaccaccaagcacccaaggaactttcttatcttctcaagctgaaactgttcccattaaacactaactcccattccctctccctgtagctcctggtaaccaccattccgctttctgtctctgtgggtttgactcctctagggaactcatgtaagtggaattatacagtgtttgatcttttgtgtctggcttatttcacttagcataatgtcttcaaggttcatccatgccatgtgtagcaaatgtaagtgtttccttcctttctgaggtgcaataatattccattgtgtggacagaccacattttctgtatctgtccattcatcgatggacacttgggttgcttccaccttttggctattgcgaatagtaatgctgctgtgaacatgagcagaagaagagctcccttttttgagggcagactgtagttctgcttagatttcattggctggagcttcatctcctggctacatctagctgcaaggaagactagggaatgtagtgtctttattctgggaggtcaggtgccccagtgaacatgagaaaaaagggaaacagacattgggatggatagctggctgtctacagcagaggtgagggcaaactatgacagtggcacagtttcaggaaaccttccagaagggacctcatcctgactgaggagcgggagagggaattgaagaagcccaaggtctcaagcctgggtgatggtgacagagaccgctggatggttctggcatttgggagaggattttgacttcaattttggtcatcttggggtcaattttttccttaaaacaactagtattagtgagaggaccctgttgacagggtctagaaacgtttagaatccccttttctgtctttatgtttgaccctggactagttctcttttcttttcttttttcttttattttccttttcttttcttttattttcctttctttctttctttctttctttctttctttctttctttctttcttttctttctttttctttctgtctgtctgtctctctgtctgtctgtctgtctttctttcttgacggagtctcgctctgtcacccaggctggagtgcagtgatgccatctcagctcactgcaagctccgcctcccaggttcatgccattctcctgcctcagcctcccgagtaggtgggactacaggtgcccgccaccacgcccggctgatttttttgtatttttagtagagacggggtttcactgttttagccaggatggtctcgatctcctgacctcgtgatccacccacctcggcctcccaaagtgctgggattacaggcatgagccaccatgcccggccagttctcttttcttagcctcagcttttctatctataaaatgaggataataatccatgtctttttgggtggttgtggggatcagagataatgcaaactaagtgttaagtatgtgatgggccttcattagtgggaagtgttcaacactgagagatgcaagaatagagtatcagttagctgttgctgggtaacataccatccaaaacctagtggcctgttgctggcttaatgcatgaatttgtggtcagctgagtacttctgctgacctgagccacgctcagctgatcctgggggcgggggtgagtgcttgcttatgtggctgctgtcagctgacggctccactggagctagatgacctaggatggccttggctgggatgacttgtttctgctccctgcagtgtctcaacccccagcaggctagcatgggcctgttcagttatgatgtgcagagttccaagaaaataaatagaagcattcaaggtcttttgaggcctaggctaagaactggcacaccatcatgtgtatctcattctattggccaaagcaagacagaaggcacaaccaagaggttgggaaatacacactttctcttaatagaagcagctgcaatatcacattgcaaagacagtgaacacagaaaagattgaataattgttgccgttattgcaaccaaaatactactgtattttaaaataaataaaaccaatttatttttgaagaaaagcagcctgggctagcgtagatctacatctttaggaacctagtcttctatttttatgtttaattatctttaacttgtagcttccatcttcagggtcacttcatggcccaagttggctgctaaagctccagccatcacatatgtgctccaagaaggagaaagagggggagcaaaaacgatgtacttgattcaagtagagtcatccccagtttaaagccctcctgaaggctccgctgagtgaatctaactgcaaaggcccctgggaaatgccatcttttaactgacttgaatagaattggggtttgctagtaaacatgaggggataatgagtgtggctggggggttatagttccttcaactaaaggccatttacttgttatctgtttcaaaagacttacattagtcctacctgtgccagacttgggaaatagaggcagaggacccctctgccctgggagagcgcatagtctggcagaggagataagataatggtgaattcatctccatttatcagtccctcccctgagcctagctccaggctggggccagagattgggcagtgataactgtctctccctgcagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagaggtgagtgctgctcttccctggctgcggcatatagggcgaaggctggttgacctctggccttctgtggggaccctgggtccatcatcacctgtggcttgagacacaagttctgctctaaacagagttctgaggatggtgatttcattgttttctgtggactacccactccaccaacttaaccaccaactaccacccatcaccctttcactgtccactcaccaccctcccctctctttgtctatacatcttcctccctgtctactttgtctatacatcttcctccctacccacttatcagtttgctctttttccatccattgcacttgtctcccacccatcctcccatcctcttgtccatctctccatccattcattcattcactccctcattcatcctctatcccatcatctgtccatccatccatccatccatccatccatccacccatccacccacctacccacccaattatccatccatccatccatccatccatccatccatccacctacccacccatccacccattcactcacccacccatccatctatccatccattcattcatccatgtatctatctacctatccactatccactcatccatccgtttgtttatccatccatccatccatccctcatccatccatccatttatccatctacctacccatccattcattcattcatctgtccatctgtccatctatccatctgtctgatcatctattcatctatccatccatccatccatccatccatccatccatccatccacccacccatccgtctgttcatccatctgcttatccatccatccatccatccatccatccatccatccatccatccatccatgcatccatcctcgttgtccttggtgtcacccccttcttcttcccttcttgtgctgtagccactgttccagctgccatgtccagtccctgtcccctagccagggctgtctcctggacccatgaccattagcctcctctgtgcctggtgggtctgcaggagcctgatgagggtgccccagtgagtcagcagatgtcctttttgtacatgggccttggtggccctggggctggtgccgtgagagtcctggcaggcctgctttgttggtgtccacatgttcagcctcaactggttggggaccagatgtccaggtaggttccagaaccaccagcccagttttttcgctgttcctatggaccgtcatctggggcccctgtggatttgtcctgggcacttcatggagtgggaattaaagccacagatgaggtcctggtatcaagattaaactcttggcctctggagtcaggcagacttggttggaatcctagttcctttgcttacctggggcaggtcacacagaaggaaggctccttctcagagccttcactgtggcatctgtcaaatggtcttgtattctttaccttgttcagtgcaaggatgaatgataggatgcctgtcaagggcttttggcagtgcctagtgatgcattcagcattgccaccactgttgctgttaccgttgccgtgcttcagcagctcagagggggaagatgaggcccagagaagggcaggatcttgccccaggcacatgccgggtctttggcacagccaggactggacaccttggctctaatgactcccacttctgccccagccttcctgatgccctgagttttatctagacccagtcagccttggttccgattgacccagatctctgtcactataatgcaagatggcagaagtctgtgcataggggttaagatgcctgctgtccacaggtgccagggctcaggagatcctacaggaagagctcatatcctgtgtggtacaggtgggagaacagatacctggatctcccatcagggtgaggcagaggcaggggtgagtgtgtgggggttggaccaggccagacctgggcagatcaaccagaacagatgtaccaaccacccttgccaatccaatgtgggtacagagagtaagtccagtccaaggaagtgctacttgctgagattggctctaaggggaatggttgagtactggtgtgaaggccaggttagtacccagaagagtctggctgaaggtagagtttgggaggaagtccggcttcaaaagtcaaaggcaggtgggtggaagggagtaggtgggcaacagagccaggcacgatcctggccagagatccatgcttcctcctgtgaggaagatgctggtgagggtgagctgagcctgaatcctggaggtactgtctagcctgtggtgtgctaggaggagccctgggtccaggtctgtccgccgcctgcctgcagtgctgagtctctgcgggaccagaccgccagccatcatggccctgcctggaggcaccggctgggactgattgggctgcagcttaatgtaaacaccctccatatgaaacacgttcctcatacgtgacttcatgcagctactctctctgtgggctctgctgcctgggtggggtgggaaggaggccctgggctggcacagagcttagaggggctgtaggcctccccctgaagtcctggctgcatgctttccccacagttgtcatacaaagagcttcccaaggcagctcagcctcaggagccttcttttccactctcacctgctccccagcacaaccctgggagatgggtttattccagaatctggaggcacagagaggcctagtgctgcccaagttgacccagctagggaaggcccaggtcagtggtcacatctgatccaatagagcccagatttggagccctttctgctgctaaggatgatcctccttgatgtcactgaggtcaggggtctgaatccattgtaacactttagtgagagcttctttgtggatctgaccctgtcctattgtagaggactcagtgatgaagacttggacctggctctgatgggttcattcttactgcttgaggtctgttcattcatttgcccatccattcatcaatccatccatccatccatccatccatccatccatctatccatccatccatccatccatctacctacctaccagtccatccatccgtctgttcatctgtctgtccacccatccatctacccatccactcatccactctttcatctacccattcatccatccattcagccccacacccattcatccatccattcacgtatccatccacctacccatccttccattcactcatccacccatccacccactcacccatccatctatccatctactcatccattcatctacccatccatctatccatccacccacccatccatccattcagccaaatactcattcatccgtctacccatgtatccatctatccacccatccttccatctacccatccatcctccttcattcatccacccatccagttacaacccatccacccatccatccatccatccatccatccatccatccatccatccacccatccacccacccattcattcacccacccatctacccacccatccacccacccatccatctaaccatccatccatccatccatccatccatccatccattcatccaccccccccacccccccacccattcattcacctacccatccacccacccatccatctacccatccacccacccatccactcactcacccatccatccacccatccatctacccatccatctatacccatccgtctatctatttacctgcccacccacccatctatccatccatctatccacccatccacccacccacccatccatccatcctgcttcatccatccttgctgtctgctgggcacacagaggtcttgatgaggacctgcactagtttcccaaagctggttgtctcagccacctactctgaccaagctggctctgtcttgagctctaacccctgtcctagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccaggtaagggccctgatggccagggcaggggctatgggaagggctgatcttgccagggggtgtggcattcctggggtgcacactgtggggtccttcacttcctgttaccccacaagttggaacccacagaagcctgaagcttccagtgatgggggatttgtgaggcaggaaaaatagaagctttcttcctggggctccatctgcagggacctggccccagcaccttgtcccatattcgagcgcagggacaggctcaggccacagaggctctcaccaaaacccagctatctccccagtgctgggcccatggtgatcctgagggatttcctcccagtcactggtcccagaattgattggtttttaatccagacactctttttcctttcccccctctcttcttccttgcctcctttccttctaccccctctgcccccagtagctgagattgatctttcccaaggtatatgcacactccaaacctcattttcctctcctgtgaaatggggtgggggattaaatgtcagtgccctgtgtgagaagggcaggtgcctggaagtgcctgaggcctggctgaagacctgagacctccctgcaacccccactctgctctacccatgacagagggtcaccctccacagccggaagccccacaggagcctgcactgaagtcagaattttcccaggtggcctctaacaccatcccgctgccactgccgcagcccaatacctgcaaaggtaagcagtgtgggtggtgtctccaggacagggcccagggtccagggggtgggtctgggctgcttgcaggtggtgagctgtctggtgctgggtatgtgcaagatggcccctccaaagggtgtgcttctgttttggggatgatgggcttaccctgggctgagtgaggagctgaggaagtcactggggagatgtggtgtggggacagcctagggcctggtgtgtgaccccaaaccagccagttagctgctttttgtctccattcttgtaacgttgaggtagtcaaatcctggtttgccgacctgttgtggaggctgtgttcagcgctgtgtagaaagtcctcttctttgttgttcttctcctcattcccttcccctgcttttttccctgcccccttccctttctcttcttccttctctcttctcctccatctccccattgttcttgctgtcacgcaaggcatgggctgggatccgagtggtgggggaggtagacccagaacgtcgtccccgacgccagacggtgttggagcagacttaatggatgaacctgtgaaaaggaccaggagtggcgttccttgtctcccagcatccctgccttctaggggccttgtttctgtgtctcactagtaggttagagccagggatggggaatgagccagtgtggaccaaggccagggcctggtggtctctgatttctgtgtggtttcctccagacaatggaccctgcaagcaggtgtgcagcactgttgggggctcagccatatgctcctgttttcccggctatgccatcatggcggatggcgtgtcctgtgaaggtgagtgccttggggtgccctcctacctgtgcaaacctgagttggcctgtgatgggggcctccaggtgggggtggctgagacttaaaacttgctgagtttgtgcaggaagagtcttggctgctatgatgagcacccctagtggagcaggttaaacagtcactccctctcaccgtacgtgcggtgtatacatgcactccagggtgggcctgcagtgtggctgcataggaatggggcccgggctcctcacatggtgtcgctccgcatttcccggagcagtgcttctcctgccgagtgtgcacctgagtccctggaggcctgggtcaaacaggcagtcctgagattctgccgaatccccaaagatcgagtcaataggtctgggtgggtgggcctgagaatttgtgcttctaacaaggtgatacggatgctgctggtccgcggacaccacctccactcaccttgcccttgagggttgccctggtctgtgcagccatgtccaggcctgggtggagagggggaaggggaagcaatgccggttgttttaagggcagccagaagtgtccccgatggggagtgggagggaggctggacagcaggaatgcctggctgaatctgttcccaaatgaaggacactggtgatgattagctgtccaaggatcacataccttccacccccgtggccccgcctaggtctgggtcttgtctttgtggggcctctgtgggccaggaccccccactgtaaaatgaggccattggatccagcacctgctgggttggttcccacagtgaatggcttctgaagaaccaagctgagaggtctcaagactctacctcctgcctgggggcaggacagaaatggagtatgcagagtctaggaagtatggcagttctggctcagagatgagaccctggtgggtgtctgggggagaacagagtcaagtctgcctgggtgaatacccacatccctcccagaagctgaaagcccgtgtccatccccagccgagactgttctgatgtggacaaacaccgtcctacgagcccagagaggacagtagacttgcccagggtacatgacgtggcagtgaccggcaggccttcctctccgatgctgggggcagctctcaggtccaggtggtgctgggttctctgggccccgccccccatctcccagggccctgaagatgtaagagctgcatcttttctggggcaggcctcctttgggcccagccctgtgaggcccctctgcctgtgctgctcatgcagcctagcccatgtctgcgcatccccaggaccccctccctcctctggaagccctggcagtgaaagctggggtccaggttgcaatgggcattcagagaggcacctgctctgcggaggagcgctgctcaactctgctgcattggaaataatcaagtgagttccaaacgtgttgagcacaagaatgattaaaacacttccagattttaggtttctcttggtgtgaaatctgcatacaaggggcccacacccctgtccccttttggatggagcacagacactcagtgtcctggagcccctgtgggcccttccctggtttatgtggctggcctggtcccctaagtactggactttgcaagctctcgggggcatggttctcttggcgcccgtggatgtgggaagtatcgagtgcgtacgggaggcagcctctggtcctgtccccactgtgaccgtgggcagccacccaccctctctgagtctcacctcaccaccgtccttactggggcagtggggaccagctctgcacactcacacttgggcccaaggcccagctacacacagtcaggcggggaggccccagacaggcccctgccccttgctgggtctcattctcctgtcactggatgctccgtggcagcccatgtccctctaacagtccttctgtttttcctcctgcggctgccactagaccaagacgagtgcctgatgggtgctcacgattgtagccggcgacagttctgtgtgaacaccctgggatccttctactgtgtcaaccacacagtgctctgtgccgatggctatatcctcaatgcgcacaggaagtgcgtgggtaagccagggccccgcctgccgcccgccgtcacagctctccgctctgctccacgccaagcccaccacactgtggccacatgccaaagggcctgccctttgcatgtgagctctcagcacagccggcatctccgtgctctatgtcgtgcccttgtgtcctggcgtcttgtcccgcttggctgccagctccacccggaggctgctttccccagggacgtgtctatgtgtcagggaactggatgtgtggcctggtggatcagggaccccacctgggctgcaggaaaatgagggggtcagacatgctgggagcaggataggatgtgtggggtctggaggcaggaggcctagccaagcaggacccccagaagctccgtggccttggatgaatgactcgtcttcccccagctgtggttttctcatctgtagtaaggaggctgttgatcctcttttgacgattgtgtgacatgtatgtggggtagcacagagcctgggcaccgtgagcatgctacaacagctacgtgccttccccagggtcccccgcagagctggtggatggaggatggggtccagcagagcccgcctcgcataccagcttggcgttcctttgctatgtgaccttgagcagcggagctctcctctctgagcctgcctttcctcccctctgaccgtggggccagaggactgggtgagggctcatacccggcacctggcctgcacatcgcccgggttggtgctcagtgatgcctcttccttctcctctcttaggccccatgtgggccaggcgccgtggctctgggagtgctctgtgcgtacatgtctgcagcctctgatgttttcagagaactgtaaacccttgtgtcctccagtttgtggtcccaaacggagatagacccaaagtagctgggactcagggcagacggtggtaaatgccatcacagagacacgcgcagagggcgaggtcattccagctggtggcatcgggttagcatttggaaatcagtaagggcatgcagcgtagaaggaacagctcaaataaaggtatagaagtaggatcagaacctagtgcgttcagggcatgtgaccagagccccgtttgtcttctctgtgcttggggaccatgtccagcctggacatatccccttccttcctcgcctttcaccactgggcacacgggcccatggtgctgggctgaatgcctgctgcagacatgtttgccctaggcctctagccgttggcacaacatgcgcctcctgaccctgcttgccagcagccggccagctcttcctgtctgggttgggtccgtgtgtgtacgtctgggaaggcggatcccaccagggcccacgagcacccctcccatgatgccctgccctctcgcggtgcctgagtacgcaggcttgtctagctgcctggagataaaacatactaaaagggatccccaggcagctgcaaagtgggttctgggaatgaaagagcaagggcacattccattcagcaaaattgatgagctcacatgcattcctttctttctttccctccttgttcatcctgtacaaacccgtcagcacctcttcatccttccatgcccctcgcacacgtgttcatcccgtcgtgttagtacctgccgcgcgttctttccgtcatttgtacgtccacaaatgtccactgggctctcctgcagttcatttgtttgctctgcacttgtttattaacccaggcaggtgagatgcgaggcttatgctaggatcaagagtgtggcctttgcagccagcctgcctgcctgtgctgaaatcctggctctttcaatttttaatcataagaccttaaaccagttggttaaactctctgagcctcagtttcctcatctgtgaatgagataacagcacctacctcaaagagtcattgtggggattaaatgaattagtccatttaaagaagttgctactcttgtgacatcattgttatgattcaaccaatgtttcactgaggcaacctgcagaggtagtaagctccccatcactggaggtatgtaaatcaaagtgggacagtattgggtgtgacctgtgccaaggactcccctgtgtttaccatttgccttttgtggtctgtactttgaagactgtcttgggcacagggaaaagtgttgcaggtggtccaggctgcaagatgtgagggaggcagccccccagctctgagccccccatgaagtggtgctgcagcagtgcttgaatgatgggtacaagggtacagctctgggccgggcactctggcttccgttcttgatctgccacatggctgtccgtgtgactctggtccagtcacagcactaccgggaggctgatttcctcctctgagaaatggggcttgcagaacgatgtcctctaaaccacctgaccctggtgagcctccgctcatggtgctgctgttgttaccataattcctccaggctgtgggaggctcttgggttatgggcatttctggggtcctgggaatggtctccctctgtaagtccagcctgtaaatcagaaatctttatcttgcccagccaagccttccttggaaaccactggcccagaactttccctttccctcctccccattcccagccatccccgggtctgcctggcctggacactgtttggttcacctgtgagtttgggagggtctctttccccagggccttggcctccacctctccacctggtcctctagtcatccttgtagactcagctcgaatgtcaccactcctgagaagtggctctgatggtccagaccacagcaggcagttctctggccagagcccccaagcctccacctgcctgtccttgagggccggggctggggccgacacacccacttggtcacaggagcctagcacagagttatgtgtgtggaatggatggataagcaggggactagtgcacctgaccgccgccacaaggtgcagcaccaggagggggtagatgggtcagccttccacactggcttagcgctggccttggggcggtttctgagttggtggcctctgtggcccctgggcagttcctgagttggtggcttctgtggccactgtggcccgggggtggtttctgagttggtggcctctgtggccccagggcagtttctgagttggtggcctctgtggccccggggcagtttctgagttggtggcctctgtggcctggggtggtttctgagttggtggcctctgtggcccgggggtggtttctgagttggtggcctctgtggccctggggcagtttctgagttggtggcctctgtggcccgggggtggtttctgagttggtggcctctgtggcctgggggtggtttctgagttggtggcctctgtggcccggggacagtttctgagcctctgtggctccccacctcccttatgcgtcctctctctccttcactggcttctcctctccccaactgcttatccctggaatctcccaggagctggtccttggcctcctctccgtgtgatctctcccctgggtggcctcagccatctgaccattctcaagttagtattcccactcagaccccttgtgtgaactccaaggcatgtcctcagctgcctcttcaccctcaaactctcatggccagcagggctcccaccttcccctgcagcctacacctcacagccggccctcactgccacctgtccagctgcttggccagaagctctgggcccctcttcctgcctcaccttcatctcatccatcagtgggttttgttggttccagcttcacaatacttcagaatctagccacttctcccagcccattgaaggtagtccgagccactgaatctcctgcctggatcctcacccctattctccagcccctgccagggatccttgctccaaataaataagaccactttctcttctgcttggaactctctatggctccctccattcctcctgctcaccctctttctcccttccctcccctgcagcacacccacctcctggtgggcccttgaacctgcacagctggcttccttctcagggcctttacatccctgacgcctctgcctggactgtctgcatggcccagtctgtcatcttgtcacatctttgctcagatgtcttcttttctgagaatccatccctgacccatcccgcccagcgccccccgctgtacctgggcactccctgtctcctgcgtcctgctctgttttatccatagcactcatcaccacctccatttatgtttgtttatgtatttattgtgtcctctccccttgagtgtctgccccacaagggcagggatttctgtcttggtcactgatgtacacccagtgccaagaacagtgcttggtgcatagcaggtgctcaataaatctttgttgaatgaagggatgtttgggtgccgagacatcagccacatctccgaatggtgagctccctgagggcagggcctggagctctctccctcctggtggcccaaggtctgctggctgcactcagccactgtcctggggactctgcagcctctgatggcctcgctctccctgcagacatcaacgagtgtgtgacggacctgcacacgtgcagccggggcgagcactgtgtgaacacactgggctccttccactgctacaaggcactcacctgtgagccaggctatgccctcaaggatggcgagtgcgaaggtgagaagggcccagaaggaccaactggaggccccgccccatggccagttttgccccgcccctccctggtcccacccctgtcctgccctggccacccttaggcctggccacgcccctctccatcccctcctttctagcaagctccccttagttgggtttcctgctggtgggaagaccccacaatggtggtgtttggggcggagatgggagtctgaggcagggtgagggcaggctaggtccaccccggctttgctcctgcctgctggtgtctgggtgccagttatcccccttgctgtggcctggtttgtacattgaggtggagcccacagagggttcactctgtcccttttactggaaaattctagccttctaatcagagggaggggtttcatccaaccctttcaacaagtacgtcctgagctgctcttatgtgcctgccgggtcctgggtaccagggatccagggtggggtgctgtggcccttctctgaccttgtggttggggcagcggggtccacacaggcaaacagagatggcagagtgactgggggctgggggcccctgtaagtggtgggttcaaggaggcccctggaggaggtgacgttggagttgagacctgaatgagaagctcctggggagggtgttcaggcagagggggcagcgtgccaaggcctgttgggtgtggggaggaagcactcttggcatgttccagaaacagaaagacagtctccggggttggagccttcttgctacctgtgctacctccctaaagtgtgaacacatgaccttaccttagagatttaggcacacggtggggatatccccacttccgccccctgcaagtgtgggacagcggctaacaaagcaggcttgggagccagtcccccgggttctggtcctggtccagtgctccccagcagtagagccttgtctctgcctcagcttccctccttgtaagatggggcttgtcatgacatctacttcttacggctgtgtggggtttaaggaaataaatccatctcaggtgctcagaacaatggtgggaccaaagagaagcgcagtaaacatggtcacgttgttattactcctgggacaaaggccatgccggcaacaatgtggctgtgccagcttcccagggagatctttgtggccatcagggtcatgggtctgagggcggggatgtgtgggcagggctgctgagtgtaaaggcaggacctgccccccagcccttgacacccagcctctccgctgcagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtgggtgagcgggggctgcagggctggggatcatcagcctagggctctactggaggcattgtgggggcttttagggctttagagaccagggaggcctggcttgctgctccattcctctcccagcccccttgtccctacctgtgaatgggcatgtcaagtgttcaaccctgggggcaccactgtccccaaagtgtagctgctcctattaccttgagctgtgaaaccttggctgagttattattcagtggcctctgtgaagctatctgtggggttggactggatacgaatgagtatcccttttttttaaccagtcagcagtggctatgtgatagatcatgacctggcacagacatctacacacatccaggaagaactgcaataccagtgtccccacacagtactgcatgtgacacccactgaaatttcccattttcagagaatgctagtgagacctcctagagtgattccatgccgtactcgagggttgagacttaacagttttacagatgccggcctagtccccaagtgggtctgagattctacccgctctgcgccccccatcaactccttccaaaaaagggtttgcttagtctctgtgcctctaaaacttcttgttaatgtgctgtgcttccctggcagctagacccctggcacgtggttggtgtagttatcctagcactcagcctcgatcccgccctgcctccagctgctctgttgggcagatgtgagagggcgtagggccagccatcaggtgcttgggttctgggaggtgtatcccttgggtagtggggcacaggggtaggacagtctggccctgcaactctgaccagggcaggtctggagcccaggaccgaccccctcccagtgtggccctgggaggggctggggcctgggaggacaccatgccgggctccctgtcacctacacctgcctctgcagacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtgggtaaggccagccgcctccgccctgccagccagcccggcctgcccgcttccccacccctgggaggtgtgtgtggagggagccccaggcctcaaggtaccctgctcaccccccacagacgtgaatgagtgtgagacaggtgtgcaccgctgcggtgagggccaagtgtgccacaacctccctggctcctaccgctgtgactgcaaagccggctttcagcgggatgcctttggccggggctgcatcggtaggtaggctggtggccaggacccctggggaacacctggctggtcccctgccctctgtgcactccacctccccatgcccagcacctccactgcctgagtggggcccacctgctggagtccacaaggtcgccttccagctggcctcatcctcctgctgggcctgccaggacctggctctggcccccgcccccaccttctcagtccctcctgtctcatctctgtgcctctgcccctcttactctggtctttcctgcttccctcggtctctgtcaccatctcttcttgtctgttgctttgcctgtgtctgtccctctggcctcttcctctcgccttcctccaatacccttgctgcctccccgccacctggtctctttgcctctctctttccctgtcctggcctctccctgtctttccttctgggtccctctcccacttagcctccccttcggccctggatggcccttgggggtggagggagctggctttagggccacctaccctgtacctgctgcctgccctcccacagacgtgaatgagtgctgggcctcgccaggccgcctgtgccagcacacgtgtgagaacacactcggctcctaccgctgttcctgcgcctccgggttcctgctagcagcggacggcaagcgctgtgaaggtaggctggccctcatctctgaccctatgccgcctggtatctgtagtgggcagacccgccgtggaaggcccagagccttctgtgacccttcacccttacaccttcaccctcacaccttcacccatgctggcccttccttcctcctctgtctggcccaaccctctctggcctccactctcaccttccttctgttgttttctgccctgaattcccctgctgaggtcctggggctccagctccctcagtccagagaggctgggtctctgtgtcatctgtacccacaaatagggtatctgaggcatccaaggtccgtgtacctacctgtgcgggacgcgcctgtggctgagggaggggctgtaacattattcccatgtgtgttcatggtgctgttggccccagctcagtggggactggtgtggagtaaggccaccaggctgctcagtgagggggcgaggggccaagccagaaggccatggggtcttggccccatttacctggcacggtctttcccagcccctccccagcctggaggcaatttcctcattttctcctggtgaggtgagttggctgagacccctgggaggccatggatcccttcccagtcaccaggcctggcaggagagctggccctcgcataggtcaaccccagtccaggccggggagcttggtgggcctggctgtcagacagcatttggatgggctctccaaggcagacttgggccctgccatgactgcctgctggtgtccctgcagacgtgaatgagtgtgaggcccagcgctgcagccaggagtgtgccaacatctatggctcctaccagtgctactgccgccagggctaccagctggctgaggatgggcacacctgcacaggtacctctcccctgtccaagggcccccttccagagagtcactcctttcccttgtgccaggctccccgagagtccctgctgggccatggacacagaaaggttttagcatcagatctgagttcaagccccagccctgcagtttcctggctgtgtgaccttgggcagattgcctctccactctgacctcaggttcctcctctgtaaaatgggaagaatggtcctgacttcagggggatgaagacctaagtttacataggtgcccatgactggcatctgattgtcccctcagctggtagtagcagtcacggagcagccctagggcataagcactggagtgggagtcctgttttgcttcgtggccttgggcaactctcttctactctctcagtccacttgtcttcatttaaaaaatgggcccctaagctctatggctgtgacagggacaggctgactgtcagtggctgggctctgtgggtggacgaggttcaccaggggctgaacctctctctgacagacatcgacgagtgtgctcaaggcgccggcatcctctgcaccttccgctgtctcaacgtgccagggagctaccagtgtgcatgccctgagcagggctacaccatgacggccaacgggaggtcctgcaagggtgagcaagtccccccacacgcccccgcctccatcagggccttgggcaggctccaagcaggcacagaaaagctcacacagcttgcgtgcacttggagcccccacacccagtgaataaatgcaggatggccaatgctaccagtggccatgttaactgaggttgtgcctgggatgaagaacgtgacagtcttgctgctgctcaatccagcttagaatcttccaggcttgtgctcagctctggaccctgccctgagagtggaacagagatactatggggtgtttctacggaggcacgaagcctgcccagtgaggagacggcagaagagccgcaggggtcccaggcagtgtcccgagtctctgcagtgttatgcagggacaaggggatcaggcaggtctgtggacccagagagtagggcgggatcctggggagtagagaagggtgtcatggggaggcttttcccaaccctggtgcagaagggcattctcctcatcagagctgtgtagagctgggaggggctgcacaatgggagggtcccccactcccctgctattgaggatgtacaagagctgggcagtcacctgtggaatttgcaagagaggggactgtgtccctggatagagaccgtgttctgtggtatttaatgttcctcctctgctagagagtcgtacttctaagttcagtgccatttgccaccggattctgggcctggtaagccaccagggcaaggtgaggggccaggacacagaaggggtcattgccccaggagaaccaaccactcagccccatggcctcttggcctctcgctccctcggcccctcggtcccttggcgccgcagagctcagacctcctcctgacttcagtggccaggtcttcctcacacatggagctgagaacctggagttccctggggtgcagctttcggggtgtgaccagggtcctggcccagccttgggcattttcttggcccgcaaaagcagaggggtcagagttagctcccagaagggtttggagttagctcagcacagtgcaggctggtggttgctacctgtcagtggatcctgagatcaagtcgatagacttcagccagctgcctgtgttctcctttccattagcatagaacagaaagcagcatagggcagagtggagtggcgtggcatggggcaggtcagagtgcagtgtgaccctaggttccagcccttatgtgtgtacctagtcccaatgcacaaggagtcctttgtgtgggtggatgcaaacgtatcagagtcgtaagttaagtcagaagaccatgagaagaccctataaatcactgactgggaggcctgctcggcccacagaagctggcttacttaggtcttgctggctgcaaagccctcttcttgttaattaaaaaaaaaaagtcggtatggactccgtaaaaggtaaggattctattcaccgtgtgctcagctcggcaggaaatatggctttatccttctagattgtgatttcacatgtgacaccaaggccctgttcctcctggtggcagaacacaagtgtggccacttcaaggaagccccatcagacactgcagtgacatttgctcttggaggagtttcaggatgcaaacctgtctgcattgaggacagactctccctggctgtttattttctgacctacaccaaacaccttgggggtgctcaggacacctggatgcccacatgtgcctggctagccactagagagggcttcccgggacctggcatatgcccatcgtgggtgcacctgaccctagcgcttctctcctgcccgggcttgcccgccaccccgtctctgcatcctcttcttggggtggctgctcctctgccccgacgacttgctctgtgttgaagaactggcgaggccaggtcccctctgcaggcccccagtgtgccaccagccccaccaggaggttggggcaaggtagagccccacacctgcacatctgccgccctcgcttgctctccagaccttccttctggaagagccttctgactcacatggtgggcaagggcacagtgggggctgccggctccccggcctcatccatttcacaggtcactccatgtagccacttctgcagctcctgaccttcagagctaagaggctgtcctcttctcctgttctggcttgggccaaaccctgaggtctctcggctcaaacagggtggggggaggctggcttgggggaaagaatgtgttggataatgtccccgttagcctttagcctctctccaatagttaaaaaagaaaaggacaggaaaatccgaaggaatttagactcagccctctcacctggcatgcacactccatgaaggtagggccctatctgtccggctcaccagcatctagagcaatgcccagcacatagtaggtgctcattggacagttgaccccatgactgagctgagtgggaaccactgctcatgtttgcatgcatttccctccagtctttcccttagcagatataaacacactgcaaacacacacacacacacacacacacacacacacacacacacagctgaaagtcactctgagtcccggtcgtttctgtgtagtaagagcccatctctgcatgccactcgatggggcaggccagctttgagcagcactctcggtcttgcccctgagctgttgtgggcttctgggcctcaagtccttcagaagcccttggaagcctctcttccggggctgaattttgcaggactcccctgtttcgtcctttttgctctgtcacccacttttgcacatctgagttgcggctgaccctggctgtctctgatgaggctgtgatggcagccctggatacggggcctagtccagctcccacgttagcctgcgctctccaggggcctggcagcgccgatgggcgaggccctggggcgttagggaagacctgcgactgaccgcctcccgcgagcttggtgaggccaggctgtagccgctcacccttcttggcccttcccttctgggcatctccatcagcagcagcccagagccaaagcaaaaagctcccacgtccttcctgccccacccacataagctccagggtcactggagcgggccaccgggggcataggccaaggagcaggaggaggccctctccatgtggagtccacgagtgaataatcagcagcctgggaccacccggttgggctctaccctgcctggcctcttgccgtgttttctcccactcacttctgcgccaccctggggcctattttacggagggagggaagtgaggcctggagaggtaaatagatgtgagctgacccgctacaagagagcctggcagccaagagcccagagtctgaggcggtccgggggtattgagtcctggcgttgccctggcagctatgtgaccctgggcacatttgtggacacctgcacctgccccgtggggttggcgtgggtgcagagtccctcaagcatcacagggatgtcaggcagtaaactctggaggcaggctgactattggtattattactattatgttgttgttattgttaggagtcagcttggcatcatgactgggtcccagattttggcatcaggcatgcctgacttgctgccccgctcgctgctgtgtgatcttgagcaaggctttgcccctctctgagcctccacaccctcctctgtctgaggaagccagtgaccctcgctgcacagggctggtgtgaggactgagtgaggacaaattcctaaatggtgtcaatatggaggattggaaaacaaaaactgaagccctctgtggttgcccctggaacaccccctgcccctaccccacgggactttctggaggcctcctgaggcggccctctctgggctgagcagctcatcctcaaagtttctcaagaacccatttctaagaccttttgtcctccagggtgcctgtgggttacacacacacacacacacacacacccacacacacccctaccccacccctgcttctctgagctttcgtgaatggtatctattcatatgtctgttgacgtttatatgtgtatgtttctttgtcccaaatgggccttctgtgtgtttgtttctgtgcacctgtggaggtgtgcgtgtgctcacgtgtgtgctgaacctatgtgcctgttggagttgcacatgtatgtttgcttctgaatgtacaggaagcgtgagcacgtctgttgctcatgggggacattgactcatagctttgcgtctcggagtcgggacttgcaagtgatgggtcttggacttccatccagcaagaagtattgagcgctgctccatgcaggcactccactgggcactggggacagcatgggaatgagaaagacaaacacccctgccctcctggagcccaggttgaggggggacggtagaaacatacaaaacatgcagccataccaaacagcctcggtgtgttgcagagcatggagccataggaggatgataaaatggggtgggatggagggtgatggggcaggaggaccactgtagagtggtcagggaggccatcctggagggggtgactcaagatctgagagttaaaagatgagaagcctccagcagtaggaaaagctggggatagcgttccagcagcagcaaaggccctgggtaggataagggtcaggctattggggcagcccaaggatgtccagcaggactgtggcctctgtggaagagaaggagcttagagaggccagagagccttgcactgtgtggcttggcatccaggggagggagctgggctttattctggagcgcgagaagccttgggagggcatgacatgaggtgattgacactttagagccaggccccctgctgcggggtgccgagcaggtgagatggggcatgtgtgtgcagggaggcacgcgggctattctcacaggtccggctgccgtggggcccaggcctttcatgcaggctggggagtttcaggctgggtcccccagctgtggggaccctgccattgcccctcttctcccccagacgtggatgagtgtgcactgggtacccacaactgttccgaggctgagacctgccacaacatccagggtagcttccgctgcctgcgcttcgagtgtcctcccaactatgtccaagtctccaaaacgtgagtgtccccaccccagtcccagtcccagggagcctgtcctggtcctgtactatccagggagaggctgagagatgggcgcctgccttgatcacctccctctcgtcccagcccctgactgctgggtctgtgggctaggtgaccaaaacaaatataagtagcttttagagagttcagggttgagagaaggaaggggaaaagacacacagaaaacaccagccctcttcctcatacacacacatggtagttactgctgtgtgaccagttatcccaaccaacatttagcaccagaatacaacagatacttactctttgtcacgcagtgtctgagggctaggagcctgggagtggtgtagctaggtggtctggctcaggatctcaggggctgcctgtccggggtgcgggatcctgccactgctcatggggctctgggcaggaggcctcagctccgcatcacatgagcccctccacaaggctgcttgtgacatgccactccccagctcagtgtatcagaagtgccagcggcagccccttaacctcacttaacctcagaactgacagaccgctactctgccaccagccacacggcccggcacttgggagggaccctgggagggacactgggtgcactgggaagaagggagaaggaggaggaagggaaggggagagggaaaaggaaggagaaaggaagaatgggaggatggcaggagggaggaagaaaggagcatggggacaggtaagagctgttaacgagcctggccagtgccatgctaaactcacccattccagtgagccggtgaaggttttattaacctcatctcgcaggcaaggaaactgagacccaggggacgtaaggggacttgcctgaggcttcccggccattagggagagagctggcccttgatcctgccgctgagctgtgccatctgtgtccccgtctggggatgaggggggtgggcgagctgtgggtgacccggcctatcctccctgcaggaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaagggttataaagtaacagaggaaaacgcctcttggtcccttta

SEQ ID NO: 636 - DNA, 73775 bp, Homo sapiens
gacctgcggcccgccagaccctcggcgcggccgccggacgccgcggggcggacgcggaagtgaacgccttctcagctgctcggcaactcgggagcagagcggccccagcggcgcccccgtgcggcccggctctgaggcagcggctcagggagggagggaggccacgtcccgggcacgccacgccacgccacgccccgcccccagattcgtctcgccccagtgggccgcctcggagtcgggtgggtcttccatcccggaggtaagggaaacacacggtagagaaggccagggctgaaccccaagggacggtcttgtgtgttcagaggctggttttacaggtgaagagaagaaacagccgcagaagttgcgattgtccaaggtcacttaataagtggcaagaattaggatgttaagtgttctcacccccaggtcagtgcccatccctccaaacagggctgctcagtgccaacgtgtgttaatatattgcacttggataagtctatctggatagtgtctgcagcttacaaagctttttcacacacagcattcttgtttagtctgtgtgacagtgatataaagggtgatatttatttcccattatagcaaggaaaattgaggcgagagcaaacatttattcaacacttttgtacacctgacactgtgctaagtgctttgcatgcactacttaatttcctgttaacgataaccctaaaacagttcttccagtttctagcaccatcttaccttgtgcaaggtactgtgctagatatttcaagagaaatataacagtcctgttttcaaggtgcttccccaaaatcaaaaatatttggttccaaatttccctgactggctcttagaagagaataagccaaagagaggtaagtcaacctatccccttagatattaacagtcttaggagagagggaaggtttgttcaacctgtaattattaagcactagctatggagcaagcactgagagtaaaggactggaagagacaaataatgggcgttcaaccttactttccagtacaacatgcagaaaacttgttctgtaaatattttaggctttgtgggccatgcacaactactcaactcagcagttgtagtctaaaagaaggcataggcaaaacctgaacaaatgagcattgctagttccaactttatggacactgaaattccaatttcacataattttcatgtgtcaaaaaatattcttttaaaaatgcagctttttcaaacacttaaatatgtacaagccattcttagatcatgggccagacaaaaacaaatggtggtccatgggccatagtttgcctgcccttgttcaagtgggagaaacagacactaagcaaagtggtgacagagagtgataactaggtgcgaggaaatgagtggacatttaagttgagggctaggagtcagaatgagtccaccttctgcagagatggaggaagggtattttaggaagaagggagagcaagtcggaagcccctcaggcaggaaaggactcagcaatttgtaggaagagaaaggccactagtatgtctgagccttggtgggcatcaggacaaaggggaagatgagatgggatgaggttgaagagagaggcaagagcccagactctaaagtattgtgtggccatggtagaaatttaatttgactgtaagcataatgagaagctattgaaaggttttaagcagggaagtgacacaattgatttactattaaaaaaaaataatcactgcagctactgagatgagaatggattggaaaggtgtgagatggaagtagatgactattgcaataatccaggggagaaatgtcttagttcctccttgagtagtgttggcaataaagagaagtggatggatgcaagaggggtactcaggagatagacatgacataaaatttgttggtggatcaaatacaatgtgttaatatggatcccctgagaagcaaacaatattatcagattagacatgtgagagatttattgaagggaacacctgtgaggtaataacagggaagcatctgaggggaattaggaaagacattagacagtttcaacccttgtggagaacaggaaaggaaaagtaggaaaagttgtagatatgatacagttctgagaaagtttcagcacagccagtggaaagccttcaagccaaagtcccccatatcagaagagttctgtgtctcccaggaatgggcctgccttaaatccctctgctcagtcactggctgggagcagtcagtgggcagtgcagcctggtgataaatttcaaaggacagcagctgaggcatcagtcaacaatgctccctgcaattggagatctgagaagtgcattttcatggctgcaatatatgggatttaagggaaagggaaaaatgtaggaatatctctaaattgttaatttgaacaatgggataatagtgagtttaccgagtcagtgaattatgggagaggaataggtttgagggaagaaatcagaagctgtgttttggactactaagattcagatgcttttcagacattcaggtagagagatcaattagcaattgaataaatctggagctcaggggtaaaattctgtgttgaaggtggatatttggaaagcataagcatttaaagctatgagagtgaatgaaaccatctgcagaaagggcagataaatgagaagagacaacatgaagcattgacttcagcatttagaagtcaggcttacaaggaagagccaagaggaaggaggggagtcaggagcgtatggagttacaggaaccaagagagcaaagtgtcattcatgtcaaatgccactgagaaatcaagggtccatcatatttggtattgtgggagttctaggtgaccttgacaagagcagtttcaatgttgtggtgaggacgcaaaccagccaaaaatgggctggagagtgaatgggagatggaaggctggatgtaaccctttagagaagactttgttgtaaatagaagtagagaagtgaagctgtagtgaaggtgggataagagtcaagaaaaggaattttaggatgagagtcattccagcaggttatgctgatggaaatgattcagtagataggcagagattggtgaggcaggaaggggagggaggggacaaccgaagaaatgaaatacttggcaaagcaaaagggtgttggagccaaagcacaaattaagcaattttcatttgacaagagcaggggtaggaggtaaaacacagaagacagatttaagttcaactaagttgtagatttcacagaggagagatgagaaaagtctgaccaaatggcttctgcattctctatttagtctaaagcaaggtcaaaggctgagagtaaaggagatgaggagtggaaaaggtgtgaagaaggagcgtaaggtatgaattatttatcttgggaactgaaaagcaaactttctatagaaacttggtaggattgctaagaagggatgagtgtccacttgaagattgtaatcattataacatggatgtcaagctagtcatcccagttatatgacttttatccagcaacattcagcagcttcagtacaggtgctgagaaagtagataaccctgggctcagccggagttgggatttagccaggtagtatgacacaaggattggttaccatgatggatcatcgattctaagatgggtaaagagggaagtatatgaatgtggtgatgcatagtgaaaaggtagtgagattaatggatttgagatctcaatggagttgaggaatttttcaaataggaatactagagtaagtgagctagaagaattgaaggcagtggtcagagagtatacttgaattcaagatgccagaagtcatgcaatgaatgtagtgccaaggctctgggctgagacggggtggaaacaaagttagtagaggtgaaaattgtaaagaaatggcaagctaggttgtaagatgggttatcaccgtaaataaatacaaagtcaacaagaatgagttggcatagagagaaagatgatgaaatggaagccattgttaccaataactgatcatcaaaagagttgtagaaaactgcattgaggaaagaaggagagatcctctgtcctgaggtatacatatagttaaaattacctagggcttagaaagacaaagaaggaaaagtgtttggaagcactattgagagaaaacgaaacgccagctccacctcctgattctggaatatggggggagtggaagaaaaagtagtctccacccaagaagtctacagtggaagcaggacctctaagaacagacaactttcagttaaaaaaaaaaaaaattaagcaatagtaacattttagccaggtgtggtggcatgtggctataatcccagctacccaggaggctgaggcaggagaatcgcttgaacccaggaggtggaggttgtagtgagccaagatcacaccactgcactccagcctgggcaacagagaaaaagagaaaaaaaaagaagaagaaaggaagaaagaagcgatggtaacatttaaaagtgaattttaaagggctctgtggagatgtttggaagcaatgggaacagtggagaattggcttataatagtggacatatcagaagtatgaggatgagggccccaggtaacagtggacaacttggggaattgggactgctggggtgattatagaacacagggtctagacataatgagaaaagtcctaatggtctgttaatgcaaggttcaagcaaaggccaaatatttaactcaatagcattggtataaccccattttctgactgctttcaattgtatggtggactgagggcagggagggtcttatgtggaactgaagcatcaggaaaatcctcgggtgactactccctcctgcagctctcctggaaggaaagaacaatcctagctctggtgcacagaaggttgaagggaagggggtaaaaaagcagtatataactcagaacctgagtcacacacctgattagacttgagactgccctcctcttctggcactctttaagatgggaaagataggtacttgtcatggtaaaggagaagcaaataactttgcgactgtcctccaggaaaagattcccaaaccataaacgcattcctccttcaaacccaggacaatgtatgggagaatgaagggtctggttgcttctttgttcacaaaggctagataagttgggacgtttttctttttgcaatgcctggtgcagagtgtgcagttccaccaagataacactgacaggacaatttctgagcagccaggcaatagcagctatagctgcataaatctgaatttcccaattcattctctgaaaaccacactacagaacaataaaaaagatcaaacaaaactgcaggaaatgcatgccacctgcataactaaaagagaatgttcaaatttcagtatacctgtaagtaggaagtaaacatccagtctcaagtagctgtgtctcaagatcttgccataaactttcacagagatacagttctgagaaacagagatacagagcagcctggagaaagtgaatagaagagagaagaggagagccattgacaggcctgtgattgatctaagaaaaccagaaaaaagagaaagtccatcgtatgtgctaacatactggaaaagattcctaggagataaaaccacttgctatatatgttttcttaaagtgcgcatgattcatgggaacagtctatgaaatgcattgcttctggaggtacagaaggtaaaaaagatagagaggcaccctttgaatctaaatgaagaggaaaataagtaaaaagaaattttagtgccaagtaaatgagtttcaaagcttttttgtcttgttttgttttgctctgttgcccaagctggagtgcaatggcacaatctcagctcactggaacctccgcctcctgtgttcaagggattctcctgtctcaacctcccaagtagctgggattacaggcatgcaccaccatgcctggctaattttttgtatttttagtagagacggggtttcaccatgttggctaggctggtctcgaactcctgacctcaagtaatccatccgccttggcctccaaagtgctgggattgcaggtatgagccactgcgccgggcctcaaagctttaaaaatatgcaatctttagctacatacacatgcatgtgcatgcatgtacacatgcaaaagccatccattgacaaactgtatttcactgcagaagagaatacccttgaacttgaaatctcataaaccatatcaaatctttgaaatgaacagatgacgtattattcaaggttttccagataaaaagaaccaataattagtatgtgcatatatatgtagatatagatacagatatacagatatagattagaaatatgcatttaatataaagcattggctcacacaaatatgaaggctgagaggtcttatgatctgctctcttcaagatggagacccaggaaagccagtggtatagctcaaaggcctgaaagccagagaactgactacacaaattccaggctgaatgtgaagacctgagaaccatgagccctgagccagggcaggtgaaggttgctatgcctgctcaatacacaggcagagacctagcaaacacactggggaggtcagtctgctttctcagtctcccaatttaaatgctaatctcttccagaagcactctcacagtcatatccagaaataatacttaaccagatagctgggcattccatgatccagtcaagttgacatataaaattaactaccacaggtgaaaacagagtaaatatatacaaaaccattataagaagaaaacagaaaacaagaccgtgtcagctgatgaaaattctcctctccccccgaaaagaatccaaagcagaagaaaactgacataaactccaaagtgaagtaaatatcttcaaagaagcttttgggaatatgaaaaaaacaccttgaatcataaattttaaagtaaaaatggacaaaaaatgggaagaaataaaagagagtgtgttagatccaagaaagaaatataagaaaaagacaaattactgcagaagtgaagaacaaattgcaaagtttccagaggaaaagagaattaaataaaatcttaataagggacagggaaataaccaagatatgaaaagaagatacaaaactaaaagctttgagagaaaagaagtggttgaaatggaagacatttcagagagaaatagttgaaatggaagacaggcaaagaagaaacaacatacaaattattgcagtccttaagggatatacacaaacaacaaaggaacagaactaatatttgggaccataatccaagcatgtttcaggatataaaagaatatataaatctatataccaaaaggactcatcaattatgtgggaaaattaatccagaattgtcaactctaaaccatacgcaagtaaaattattagatttcaaagataaagaaaaaatccccgagatctccaagggaaaaaagatcaagaaattacaaggacgagagaattagactggcacaggactgctcaaaaacaatatattaacaaggcaacaatggaacagcagtttaaaaaaaaagctcaaggaaaaaagtgtgaatcaaggacttccaggcaacccattcttcaagtattaaatatcaagccaagaaaagatgagttttaaacatgaaaaaatttagggaatttttaatacatgaacccttcttgaagaatctttgaaaagatgatttctgctcaaccaagtagcgaaactttctcaaaaggacagatggtgatcatttactatatttaattgtagacctaagactaaacaaaggtggggacaaagctaacaaaatattgttatatgttgatatggtttggctgtgtccccacccaaatctcatcttgaattgtagctcccataatccccatgtgtcatgggagggacctgttgggaggtaattgaatcatgggggtgggttttttctgtgttgttcttgtgatagtgaataagtctcacgagatctgatggttttataaagggcagctcccctacacatgctctcttgccttccaccatgtaagacatgcctttgctccaccttcaccttctgccataattgtgaggcctccttggccatgtggagctgtgagtccattaaacctcatttactttataaattacccagtctcaggtatgtctttattggcagcatgagaacggactaaagcatatgttgtatgtagtacattctgacaaagtagaaataacacaactgaaaatgggaaaagggaacaagaaaaaggaaaatagaataagcctaccaattgtgatataggcaatggataggggttaagggacaatattaaaattaaaaagtcagataatcgaaggttaaataaaaaagagggaatgaagtttcttgaaaaaggtatagtacaaagataaccagtagaataaaactgtgagctttcttaaatacaaaaaaattttttaaaattaaaatagcaaaaaaaagtgtcatgcaaagaaagaaacacagcaaataaaacacagttttaagattattatagtataaaatatgtataacaaaataagttgaactgtcatattaatgagtatgaatgagtttaacttatctattaaaagcaaaagatttccactggacatgctcattcccataatcctagcgctttgagaggccgaggcaggcagatcacctgaggtcaggagttcgagaccagcctggtcaacatggtgaactccgtctctactaaaaatacaaaaagtagccagatatggtggtgggtgcctataatcccatctactcaggaggttgaggcaggagaatcacttgaacccaggaggcaggggttgcagtaagccgagatcatgccactgcactccagcctgggtgacagagagagagactctgtttcaaaaaaaaaaggcaaaagagattttcaattttgttcacaaagcaagatgctgaaaataagagacatgactgattcaaaatgattcagaaagtctaaaaagggatgggcaaaagtacactagacaaatggaaacaacaacaaaggaggggttgtgatactaatgtcaagataaagtttaaaccaaaatgcattaaatgagacaaaggagggcatgttttcatgccacagttcacaatggatatactacagttacgaattctgttcaccaaataactcagcagcaacctttataaggaaaaactacaggacatgcaaagaaacactgatagaaacacactaacaaaaagacttcaagacactaccttcagtacaaaacagactcagtagccaaaaaagaggaattaatgtagacctaagtcgtataagcaataatatagatcttacagatacacagccatgcatcacttaaggatgggaatatgttctgagaaattcatctttatgcaatttgattgttgtgtgaacatcatagagtgcacttacacaaatctagatggcatagcctactatacacctaggcaatattgtatgggctattacccctaggctacaaacctgtacagtgtgatactgtactgaatactagaggcagtggtaacacaatggtattcgtatatctaaacatatctaaacatagaaaaggtatagtaaaaatatgatataaatgactttgaaaaatggtacacctgcatagggcgcttaccatgaatggggcttggaggactggaagttgctctgggtgagtcagtgagtgagtggtgaatgaatgtgaaggcccaggacattactgtatattagggtaggctttataaacactatacacttaggctaccttaatttatttaaaaaataaaggaattgtgctatgatgttacaatgactatgatgtcactaggcaacaggaatgttttagctccattataatcttatgggaccaccatcgtacatttgtttggtagttgactgaaacatcataatgtggggcatgactataattattttatttctttctgttagacaaactgtttacaggagataaggaagttttggtttatgcctaaataatttcacttaccttagtttttactgaaataaaagcatagaagttttaaatgtagagttgcctttcttttaaggaagcaaatgttttgaagataactgtccaacatttatgtgaatgtgaaaacttacaaagtactctggttttcaaacttatctatgcctacaatatctggtctttcttctcttcttcccaccacaaaggaaaaggagacccttcagctcacagcttagccctgattctaacccctgcctcaccactactaactgctttcctatgtcagcctctctccctctacaagctcccttatccagcttttaaaaagaatatgtgaaccccaaaaatttgagacaggtctcagttaatttagaaagtttattttgccaaagttaaggactcgggcctgtgacacagcctcaggaagtcctgatgacatgtgcccaaggttgtcggggcacagcttggttttatacattttaaggaggcatgagacgtcaatcaatatatgtaagaagtacattggttccacccagaaaggtggggacaacttgaagcagggacagggcttccaggtcacaggtaaatgagagacaaatggttgcattcttttgagtttctgataggcttttctgaaggaggcaatcagaatgtacatttatctcagtgagcagagggatgactttgaatagagtgggaggaaagttttgtcctgagcagtttccaccttgacttttccctttagcttagtaattttgaggccccaagattttcctttcacaaatacaaaccccccctccaacctcattcccctgtagctattgttacttctttcttgatcctcaaagaactgtctattctcatctctgcatcctctctgctgcaaaaggaatgactccttaactgtcaaaccccaggactgttctcactcaggtcttcctgctgcttaagaccaggttggcagtcccttcccaaccatcattcctccctcagccctcccacgtgtctccttctacctctcactgcctctcttgctgccttttcatctttcctccattcattgatgttcaccgtgattctaccttctactcttcttgtgcctctacacactcttcctccacaacttaatcaactcttgtgatttctaattactatttgctgctgactcccaaatctgagtatcccttttcagctccatatttcttatttctgtgagcctactggacatttctgactagatctcctaaatagcagagttattttccacagctgctattcctttgcattttcaatgaagagtggaaaagggaaggctatatgatgaggaagggtatgggggtctctgggaccccatccagcagccagggaatgtccatatggaaataactctggagacgtgggcttcaggaccatgccagcagcgtggtacatgtaactgtgagtccactggtaaagccagtgagtacagcagctatcttttcaggccccttcctcaagcctccactttgtatggtttggattttatgagtggagatattgagtaaaggagtactttaagcttttcggacttcctgcagaggcacagggtggaggctgagaagtagactacaccccagtctctcagtgtcatccaacatctggactggagtagtgtagagaaaaaagtcgccatgagaaccacggctagaggttatctagctggacaagtggtagaccaagttccctgattattttatccctttccagacaagcctcccttctacacacacatacaccttggtcagacataaggaagcttggtgctcctgttacatattccctgcccttgcctaaaccacagaaatgttcttgaatcacctcaaggctcaaagaccccttccatctatccccaacatcgatcctggattttctagagttaatcggatctttatcactcccttttcttaaacttcttgagagtttaagcactgctccctcccctacacccaatgctttccttcattgtccacacaaagtaaagcttcttagcgtgcacccaagatccttctgttacttgactttgtctaacctctcagcctttgctccccctatctgaccacatgcgtcctaggccccagcagctctgaactgcttcctgggacaggctatgtgctgtcagcctaatgaatcccacccaacttggccttcgaggttccaccgctaagtgacttcccctgaagatttgtcttccctcttcttttaagagctgctctttgtttcctaaatattctttctttctttctttctttctttctttctttctttctttctttctttctctttctttctttctttccttccttccttccttctttctatctttctttccttctttcttgagacaagagtcttgctaagttacccaggctggtcttcaactcctaggctcaagcgatcctcctgccctggcctcccaaaatgctgggattacaggtgtgagtcaccgcagctgtcctgtttcctaaatgctttgatggcatcttttgcaaacctcaacatctacatatcacaatatacaggaatggactgtttgcttgtctactgtctcccaaaaggaaagaacatttgcctcatccatctttaccctcagcaaaatgccaggtgcaaaggggctcctgataaacgtatattgaagaaaaagaggaggctgacaagcaggaaacatgaggaaattagcatgatggataccatgcctcaaaaccaaagtgacaaatgacaaagtaattctctcactatcttgagaggctcaggccaggctgcctgggttcaaataccagctgcaccacttaactaaaccttgtagaagttacttaaatttttggtgctttcttggttccacccagaaaggtggggacaatttcctcaactttaaaaaggaaatgatggtacctaccacataggatcattttgagaactaaaaaggcatttaaagggcttgacacagtgtctaggacaagataagcccttaataaatattatctgctgctgttataatgattagctatccatcacccagcacagcttatttaactggtttctattaaataaaataaaagtaattattgtagtaaagttgcataaaatactgaaatgaacctttgtcattcttttggccgcctagctcaaaatgcacttcctgagtttgggtaattcctcaccttatgagtctgtctaggttacctctcactaagaagccaccatcatcataatcatcatcatcatcaacacaacaacaaaagccagacacaggctgttcaggactcccttgcagcaggacttgtagcatatgattcaggtttgacgagtcagacacacccaaaccaggtctagcaacaggagctagtaatgccaagcagcagtgatgggaaaactgcagcacaactatgcccactttcccatatgcagtggtggtcccagtggtcccagcagcagtggtggtcccagtggcggcatctagtgccactgttggctgtacaagatcagctgcatcctcaaagggctatttttggtagcatgaccatggctaggtgctcgtctgctgccaagctccccttattttccaagcctgtatctctatcctacccagaaatgctttaacccacccaatattcttttctgcttctatcagcctgggttaattttccttggtgcaattcatcctgccagactggtacagatgatcaggtcagatggtttcataagatgtaagtacactccttctactttgttttattgctttattgatttgcagtgttctttacttggctcctgctcagggactgttcttggatgatttttgttttagtaatgccgatatgttaaagagggtttttctggtttttgttttatggcaattacactttctctctttcctttccttcccatcccttttttggtgtgagtgattgtgtcttaggacaatcaaattttaattgactggaatctatgcttaggtagagaaaatcaggcaactaacaagtataagaataaaggaaaacagatggagaggaacaaaatcagtgcccagtgcaggagagtatcacaacaggtctgtgagctcatttaatgtaactagtttcttttacagataaaatacttgaaacaaggaacacacagctaatggctcagccacaactataataactgcatctccagacttctcatccagggctcctgcctctatccattataccaagaggcaaaaggcaaataactaaaaagcaagctgagatcacgttaaatttaacccgactaattatacttttaggtttatggttgtatatgatactaatttacattttcaagaggttttacaatttacaaagcagttaaatcctttcaactgctctgagataaggtagcactttttttttttttttttttttttttttttttgagacggagtcttgctctgtcgcccaggctggagtgcggtggcgcgatctcggctcactgcaagctccgcctcccgggttcacgccattctcctgcctcagcctccggagtagctgggactacaggcgcccgccaccacgcccggctaattttttgtatttttagcagagacggggtttcactgtgttagccaggatggtctcgctctcctgacctcgtgatccgcccgcctcggccttccaaagtgctggcattacaggcgtgagccaccgcgcccggctagcacttttttttttaaagaggtcttggtattcatgtcttgataaatgttttagcatctcttctacctctgattttcctgtctcccttttctatttgttttggttttgaagctgtaactacaaaatgtgtccattgggaagagagcaatattaatgtatttgaacaaaagggcccattgattgaaaccatcataaaaatatatgggatgctgtttaactccattttacaaataaggaaacagaagcccagagagattaagtagtttggccaagattaaataaccattaaatggcacagtcactacaaggttcatttaaaaaaacatataacatacattgagcatttaatgtgtcaggctgggtaaacaagatatagtgctagttaactcctaggtaagcataaatttctataaccagtatattactttgtaaaccactgtcttctggaattttagcagctggacaatcagtaaatacttttctacttacacaagattcatgtaaccagatctgtttggagactgatcgtgatttatattagactaaaagatcttaactcaaaagcatgttttgcatcatttgtctagattctttaaagtaaaaatggaaagctgtaattctcaaatgtcttcgaatgaacaaaaaattgacaagaatatgaagctgactgcattactgtatcatcaattattggaaccttgatttaacaagctattttcattttcagtccaatggcatacaaagaggaaattttattctttgtagtttctccaaattctttgtaaaaattatgaaagtaatttgcgaaaaataagcgaattgacatggaatataaggtgaataatacatttttaaaatgtagttgtgtataatggaaaacgtcattcttgtatattcagctaaaacagaccattagtgcaagacctaaatattaatgagatccggggtttgcaacgaaatgtcattgctgcttttcccccagaaagttaaaagaaaaacggggagagcttttaagtgaaaactaaatgtgctggcgtcacacttggaaatgcaaggatgcagaagaaatggtaagatgtgggtgggtagtatcccagtaaacaacataaaccttctaacagacttgaggtggctgtcaagcctttcagacatgtgattgataatgaatgtcagaggagagtttccttttccatcaacgcttcaggagacagcggaccgccaccaacacagggcggaagagcacccctgtcacgcagactgtgccgcccccggctcgcctgggcacgccccttcctgccctagcagcggcgtcccgccctttccgcctttcacttcctagtaaccgccctcccttgctccatcttcgcaggacccgattggctgatggggcaaccgccaacggctgtggcgtttaaacccaagccgcagccgctgctgctcgccgagctcccggagctgggtgggggtgccccacgctgaaagagaggtaagttagtggcctgcggcagttgacgtgaccgccctctccctgtcgggatcggtgtcgttcttgagtcggttctctaggcgctgtccgcctcggtctccggctcgtcttccgccctctgtcctccgggatccgggacggcggcccctctccggctacgaggggttcgttgacggagtcctgttttggctttgagtcgctgcctcttgtttctgagatttgagcgtccggcagggcgagcggggagagccaccagttaggtcagctacttaagggaagatatttctgtctctgggactgctctactcccttgaacagtttctagggcattgtgagcgctcagtacgtgtctgcggaatgaatgttagggactgcgtgccaaagttctcgaaggagccctctcgtttggagaggctggctgaaggcgaaggggtgatggaagactagggagaacttggaacttagaacttgagctgcttgatgtacaggtaggatttcagtagagaatagggacaatgattttttagatgaggtatccaattcaggagaattggatgtggaactgagtatttcgtatttagagatagtcgagatgctggccggacaagtgtcacagagtgctggtattgagtgctgatagtttaccaggtcccgtactagacactgtacatacattggctcatttagtccctacaaggagatgcccttattttttatggttttataaatctggaaattgagacgaagaggtgttgagatcacatagctatgaaacgttggaactggagctccaacacagttgtaatcactatcataatgtctcagtgtctatatggtaaatcaccctggaacagtaccccaaatgcctggttctggctcctaaagtttcccttggtgaggtcattgatgtagggggttgcagggcagtgtcaaggaacactcccagatttctggcatgaggatttgaataggcgattgacagtgtcgtttattaaattaaggaattgtgtcagaaccagcttattggggagggcagtccagctgtggtttcctaattagtaaagtgagatttgatattccagactggattttttgggagatgaactagatttctatgttaggatccctttcaggtgtgtgagatgcaacagtttgtggggagtttctgtgttctactgtctttgagatagatagtgatctttgattttaaagtttcttcctggcaaaacgtttaaaagaactgttgagccttaatcttgaaaggtttctggttcaacttattccccattgcagaaatttcttctaaaaccatctttccgttatttgcttgacacctcccaacatctgcttaacactttcaaaggagacccattccaagagtgggcggtttttctattggaaagttcttccattcattcatagtcacttcttccacaaatgtttatccagcagctgctatgtggcaggcacatttctgtactaaggtacagaagcaaacaaatttgacaaaagtttatgccctcattgaacttacaatttagtaggagaaaacagataataagttaactatttaattttatcttagacattgataagttaacggagaaaaataaaacagaaggggagaatgggggtaagtgtgcagtttttaagtagtttggactgggaaggctcactaagaaagtgacattttggcaaatgctcgaaggaagtgagcaagccctgtggtcatttgaaggaagagttgatacaaagggaagaaggaataaaagtttctgctttagagcatgtcaaggtaggcagtgtggccagagattattgagcaagagaaagattaatgaaaaggattagaaaggttcactgatgattaattggggaagagaagtgtcaaattgtatagtactttctaggccattttaaagattgagtgagatggaaagctactggagagttttttttaacatgggagtaacatgaatttacttaagctttaaaaggatcattgtggttgctaggttaagaatagatagtcggggagaaaatggaagcagggacaccattcacgtagctatagcaaataatgtacatgggagagaatggcaacttgaatcaaagtggtagcagtagaaatagtggtaagtagcccaggtggatatattgtgaaagctgggtcagcataattgatcatagaatagatgtgggatatgaaaggaactttctgacctgagcaactgaaagaatggagttgtcattaagtgagctagggaggacatggtggagtaggttggggtggggggagtttaggacatgttaaatttgagatgtgtgttagaaatcctagttggagatgcgtagtaggcagttggatgaataaatctggagttcaagggaaaagtctagattgggaacacaaatttgagagttatcagcatttagatttaaaagccaggatactggctgatagtccagggagtatatgtaaatataaaagagatgagatccaaggactgagatctggggcactccagtggtaagaggttagggagatgaagaataaccagcaagagggactgagaagtggtcagcgaggcaggagaaaatcctgcctcagaacaaacagaagaatgtgctattttgcaaccaagtgaagagcgtatttcaaaaggaaggaatgacttgatattaaatgcttttcacagatcaagtaaaaagagactgggcctgaccacagtatttgatttaacaacatagtaattcagtgaccttaatgaacagttcccatatagtagtggtgagagcagaaatttcattgtagtggatcaagagagactgggaggagataaattggagacatcaagtatagacaactctctaaaggagttttgctgtgaagggaagcagggaaatcaggtcatagcattccagcatcaagggaccacttgtattttcttaaatgtttcattttcatgcatttacacatgccattctttcttcctggaatgcccttcctaatcttgatgcctgacaagtttttagtttctaagacttacttattcattcaacaaatatttactgtgttgatatcatttgtaaggcgctattccatgcgctggggaatatatcagtgaataaaacataaaaatccatgacctcctagaatttaaattctagttggggaagacagacaataaataaatctatagtatgttagatagtgatagatgttgagggaaggagctacagttttgtttcgttttgttttgttttgttttttgtttttttgtttttgagacggagtctcactctgtcacccaggctggagtgccatggtttgatctcactcagctcactgcagcctccacctcctgggttcaagcatttctcctgcctcagcctcctgagtacctgggattacgggcacctgccaccacacctaactaatttttttgtatttttagtagagacgggtttcaccatgttggctgggctggtctcgaactcctgacctcaggtgatccacccacctcagcctcccaaagtgctgggattgctggcatgagccactgcacccagcctggagctacagttttaagtgacctcactgagagggtgacatttgaagagacttgatggaggagagtgaatgggccatttgtatatctggaggaagatgtttctaaacagcatttattctaaatgcagaataaccagtataaaggacctgaggctgaagaatgcctggcatatgctccaaacagctagattttggtggccagtatggcctgaggggaatgcgatagagggagaggaggaggagttcaaattagagaagtgtagagctagtggagagaccgtactaaggactttggagagaagtgggaaccatgggagagttttagattgtatagattagttcactgtagggacagcagcagtggaaatagggagtcaaagcctgttgcagaaactcaagtgagacatggtagtgcctctgactaggttggcagcaatggacatactgagaattggtcagattctaaatatattgtgaaggtaagttgagatatgagagagatttttggcctgagcaactggaaggatgaaattaccatgaactgaaatagaaaatgctctgagtgaagcaggtttggacaagttaaatttgatgcatctactttagttattaaagtggaattgtggagtagacagctggatacatgaatccagtgttcaggaaagagatccaaactgaggacataaattatggagttcttggcatctggctggtattttaagtgatgagactgtatgaaatcaccaaagaagggagtgtagataaagagaggaagttcaaggaaagaccccgttagaggttggaagaacctgtaaaagagacagaggaggaacaggtaggtaggtaggtaggaaaaaaacataggcgtttgatgttctggaagccaaggaaatacaatttttgaggaaggagaaattaaccacattaaaatgctgctgatagatcaagttagatgaagactgagaattgactattagatttagcagcacagaagtcatcagagatcttggaaaaaagcagttttggtggaatagtctaagtgaaagcctgattgaagtaggtttatgagaaagttggaaactgagtatagacaatgttttcaaggagatttgctgtaaagatctgcagagaattggagtggtagtctgagtatgaagtgggaacaaaagagggttctttaaggtgaggaaatagcagtgtgtttgtatattgatgagaatggtccagtggaaaaggaaaaaaattgatgatatcgggaaagaattgttggagtgatgtctttaaggaggcaggaaggcatgggatccagtgcatggatccgtatctaggaacacagttgatccctaacaacaggagagaaaacagatacacagatacaggtatggtatgtaggtaattgcaatggaagttttgagaaagttctccacaggttgcttcagtgttctgagagagaataacaatgagtgaggatatgaaataattcataaagaggagtgacccagggattgataacagcagtgaagggaaaggggtaatagagtctagtgacagtatattcaaggatgggaatttttagggaggagggaagatgaatggtctgcagacatgaatgtgttgtagcctctagaaggggtgtgggagggaaaacagcacctgcctgacaggactgcaggagaatctgtgtcctcaggggagagggtggttcaagaagatgaagggaacattcagagaagagattgaggctgtagaggtttggttgatgatggaatgtgagttctagaggacctcatgagtctggcaagggtaagataggcaggctgtattcatttcctttggctgctgtaacaaattatcataaatgaggtgcttaaaacaactgaaatgtatttccccacagttctggaggccagaagtctaaattcagttatcactggttttcccacctcaaggtgtattcccagctgcactctctctggaggctcttcaggagaatctgttccttgctttgtcaattcctgatggctgctggcagtccttggcatgtggctgcatcactcctgtctctgctgtctcttgtaaggactcttgtgatagtatttagtcctgcctggataatccaggataatctccccattacaagatcctcaatttattcatatcttcaaaggccctttttccacatgaggtttagaattaaagggatctaataactttgggggaccattttccagcttaccacaggaccagatgaggaatgtgtagcacttaggggattcgagtgaggggaatgaacgtgacccaggagttgagggattcttgccatgattgataaagtgagctgagtcctggattgacatagtgagctgagtcctgtggactcaaggcaggtagtggtggggaggctgagtattgagggttaggcaggtgcaggtgacagagttttttgtttttttttttgtttttttttttttttcagatctcttcagatggaggcaaggaggcttgggaaggaaatggaggcatggggaggttggtcttacatggctcaacatcaactgctgcttctcagtgaagctatttctgatccttttcctctgcccagtcacagttaatcgcttctcctctgcattgtgtattgtagccattactcttgtaatactataatgtaatgatttctttatcttcctgtttccataataggccataaatctaatagacaaatttaagatttcctatttctccaacccccttccccaccttggattgggtatatctcttctgtacttcctttaaactctgtgtatatctctaaggttatacttcttacattgtatgaaaacactgtctgtacccgcattgtaccatgcattccatgagggcagagaccatatcctgtcatctttcccctgcacctggtacatagatgattaatgtaggcttaaatgaaaaaaataatcatttacctttttggattataccttaagccacttttgattacattcatactttcagattttatgtaaagtttagcaaatacttaatgcacaaagtatattaagtcatgattgttactttttaaaatgtatttatcagttatactttttcttttattaatcaatactatgatttttttttctttcacttcagtgatggagtgcccagtgatggaaactggctcactttttacctcaggaattaagagacatttgaaagacaaaagaatttcaaagactactaagttgaatgtttctcttgcttcaaaaataaaaacaaaaatactaagtaagtgccatcagttttaaaatacactcacgttttaacttttccccagaattgttatatatttgctaccttattttatcaagtacagaaaattactaaaatgaccattttgttaactgataactttttaaatttgatccttcctatctccttcaactcctgttagttgggtggttttgatgatttaccctaagtgtgacacagttgaattttcagcagtgaggctgcagtgacccaagacagctactttctacagcgcagaaaaaaactaccaacatgacttttctggaacagatgtagtaagagtagcaggttgttctggcatgttgtggcaactggatgatgggtagccttgaggaggtgggctcacactgggtgcttatatatacgtgtgtatatatataatgtatatgtgtgtgtgtgtgtgtgtgtgtgtgtgtatacatgtgactttatataggcaatcttatgaagacactgagcactttggaaatggaatttcatgaattctggagttaaggcatcagaagggcaaaaaaaaaaggaggtgggaaaactccccaagataaattttcattacttctgaaaattatctcagtgttcatacccatcttagcaggagttggggaggtatccttttagtcacattatctgctgatatagctcctgcgaaggacaatcacgtgtgccttctaaaacaacccagcctcctgggtgcctgtaaatcatgatgcagctcccacctaggtctctagggccactccttacactggctcttgcttactccctttggcaagactattccacaccccctgttatgaaggaatatgctgactttgaggagtacaacaggaaaatgttattactctttatcttctggaaatcctaagcttgttgtagtcagtttccatttgctatgccaagaatggctatccaaaactactctctctgtgccaaaggtaaagtactgttttggactctgttttgcagaatcccaagttttccctgagtacttataaaatgttattaaattttataaaacttatttcacatacactagacttttattcagtggcatatgttattgaatagtgaaatgtaagttaaaattatgaaaatataatgatattttaaatgtactaagggaacacactatatttatggtaagctttaccagggaattcacaatgaaatttctttgcttccaacagaaaagcaatttcaggcgtgatttaaatcatatttacatagtgcttttaaagaggagtcgagtttagattgcagtagatgcctagaaataagaggtagaatcttttagatggcagtaaaaggtcccgtggggtttagattatctatctaacattagagaaagtatggctctatcactcaaagtttaaaaatgggcgttgggagtattaagtaatttgttcagttctggagctgtagaagctggctttagaattttcccagattggctaccctcattcctatgggacatttccagttagagctgcagaatcagtttctccattctgtctgctagtcaaaggtaggaaattaggtagagcagcaagtatcaagatttaatttttgtgactgatctaattatgtagaatgctatgtctgtgctgcagtcctcttactccttttttatacatattctgcattcctcacaactcttgaattcttcatcttctgtctagctttcatttcctcacctctaaactctgggtttatttttctcaaaactacatctgtattgttattcccttttctaatcttcagttaaaacttgtgaaatgcattttgtctatgttttactaaggaatataaaaatttcttaaggtataagctgaatattaactcattttaaaaatctttttacagataattcttctattttcaaaatatctttaaagcacaacaacagggcattagctcaggctcttagtagagaaaaagagaattctcgaagaattacaactgaaaagatgctattgcaaaaagaagtagagaaactgaattttgagaacacatttcttcgcctaaagctaaataacttggtatgtaagctatattgtttttgaattctaattataacttaaatcttttagctgcattattatagaagctttaaaaatatttttcaaatctccaatagtgaaaaattattgaaagtcagtataccatgtaagtctatgtcaaagtacaaactgttaatgggtaataaaatatgtgttttaaatctacattctaaatgtgtgcttgtgtgctgtgtaaaccagtataatactttgaccaacattcgattgctaatcataaacaaagcttggtacattaatacatttttaaaagatggtcatagttcttccggtgttcttgaaaggaaaggaattcccagaatgttgttattcttttttaatctcagcatttacctggctacaagctaaacagaatgagaattatagttgtttcttttccttccaaatttcaactctgttcacagacaggacagtgagagccaatgattagctaggctgcaactatagatctaaatctaaaatgagtagaactttttataatggaaaaaggacctactctacttgtgggtttaattccggtggctgacaaactgttctcttgccatgtgatatattactatgagaagatagaaaaatgtttataggaaaacaaaattgttctaaagtattcaacatatgtgtgtgtgtgtgtatacatgtatgtatgtatgatatgtatgactatttggactatataatactatttggtactatataatataccattttagctgaatgtgatctcaatttttagctcaatatgatatcaactattttttaagttttctcacatggatggcattcataaatgcctgatattataataaattacaagtcttaactgattaaaaggggtctttattttacatgtgcagaataagaagcttatagacatagaagctctcatgaacaataacttgataactgcaattgaaatgagcagtctttctgaggtaagtagaatttatatgtaaatagtgttgttctttagattactgaggatcactgagattacttaaataacatcaaggttagagattcacatttcaagttttgtgcaaaggactgatgataatatcagttttaactggctaacagcatattatcattttgtataattggttattgaaaatgtcatatgaaaattaggtttttattaaaagtaacaggattagacaggttagtggaacatactggctcctaaatggactcagaaacataaagacattagtagaaaggaagcattttaagtgaggaaagactttggggtttttgttttttgtttgtttgttttaaagatggacacaattgaaaaactggggaaaaaaatagaggctggtcctactttatactgttttctaaaacaaattctaaatttcccaaatgcttttcatgtggttctttttggagaattcagagggctgaggtcaacatctagattaaggaaaagtaaaaactggacagcaggtagatggagaagctggaggtgaaggcacagtatacattcttggtagctaccttcttgaacttactatttaacagactaacttttgcataccaagctttaaaattctttttctttctagttgttactaagtggggcaggtgatgggtcatatagacgtactgttctaacatcagaacgagataagaaaagtatagaataaagtttcacacatgcttttgtccgccttcagctactttcttctccgttctgtcttctccttgtacctcatgcaggtgattgctttcatctatttctttatataaaaacaaacaaacaaaataaatattttcttacttttcttctttacacaaaagatagcatgctataccagatgttctatacctttttatgtgacatatcttggggatctctccatatgattatgtggagtgattcctcattctcttttggtgctgctttggatagatccagagtggacttgtaatctacctcactaggctcctgttgttggacacttgggttatcctttgctgttggcttgtgttagtgtagagtgcctttccctcttgcatcattaattttttccctcccttctggattattcccatcaggatgcaaaaatgttatcatctctcatcttaaaaaataaataaataaacctcttacttcacctacttccccgctactatctcagctctcttcttgcctttacagcaaagctttttgagagatttattcactatctctagtttctcttgatcccaagccaattgggttttcaccaccagtccactaaatcctgaaagtcaccattgatgtccatgttgcgaaaacccacggataattcttggttcttctattgacttcacatgacttttagaataccacacactcctaagtctcttcctacctttctggctattccttttcagtctgtttgctggtttctctttattttactaagttttgggaatgccttatgactcagttcttggacttctcttttctatctacattcactcctcctaaataattttattctatcttatggttttaattactgctatacactgttgactttcaaatttgtaactccagcctgaccatctcctctgacctccagacaatttatatctaattacctacttggcatctgtttggatgtctaaaagccatctcaaatttcacatttgccaccaaaccagttctttttgagattttcatctaaggtaatcacaactctcttttcctgtctttttctcacaccccatatctgatcctttggcaaatcattttagttctgccttcaaaatcagtctacaattctaccagttctcacaatcctctttcaccacgcatgtccaaggcactgttatgtcttacttacatattgtattaatattagcatcccaacttggccttcttactttttctcttgttcctctatgtattctcttcttattataacagccagagtgatgctgttaaaatgttagtctctgcttcaaactctccagtggagtcttatctattgcttgatgtgatctgaaaactgaaactcttcttatttcttccacctcatttgctactctcctctttcttccactccttaaccttttcagtgcagttctcttcccactccctcagaggtgagctgctaccatagtgcctttgtacatgttctgtctgcatgtgacaagttcccgtccttcaaatgttgactcaaaagtgactgcagtgaagccttccctagcaactctgcataaatttaaacactcctcacccctgcacttacatttcatatcctgcttttcttctttaatctttctccttaacacttaacactcactgtatgacaattttgtttattgttcatcccatcagaatgtaagctttttgagtgcagggatgtctttaccagaacaacatctagaacatagtaggatgcaataaatacatataaaatattaggtagtgtttccccagtaagactgatgcttgttttatatgtaaataagtaaggtacatatatttcctgcagtccctctttgattgagctttttaaatacaaataatgctaagtaatgtaagtatctttttagtatgatgatgatgtggtctttttaggtggcttagtatgattatttattttagtaactttcctaattttacatttctgtaataaacttcagaagtgatttttcttttaatatgctgctgaattcttttttgccagttttgcttaagatttttctattgttagttataagtgaggactctgaggttttttttctatgcatggaaaaaaacataagaccatacagtctttaggcattgataaaaatgttatatatactaagcccataaaaagaatttggatgttttactttttctatgttctttaaaagtgatacagtattataattgtttttctttaaaggttttgtagaattattctgtgaaaccatctggacctgggacttttctgatgagagtgatagtagctttttgttgactttatttatcctgtggatattggtccccttaggaaaatgtctttctttcttttgtgtttagttttattaaattatttttccttagaaagttatctgtttcatctaagtttttaaatggatgttcacagagttgaccagagtagtctgtcattattcttttaattttgtctgtgttgcatttccccagttgattaattttatgtatttgggcttttatttgtcttttttctccccactatcttaggttgttgtgatttttctattttattttattcttttaaaagaatcatctttctaatttaatttaatgtttgatgtttcaaacattttttgcttttatttttaataagttcttttgcctttttgtggttcattgttacttttctaactttgagtcaatgctttttttaattgttaactgtaggtaagatgccatttttctctcaatactttcaattttttaaattgtctttagttttgagaattttgactttgatgtgttttgccatgaatttccttgagtttatctttttgaggttcactcagcttcttgaatttgtaggttgatgtctctatcaagtttggaaaaatgttcagccataatgtccccaagtacttttccagtcctgccctctttctctttctcctttcctctaggactctgatgacaggaatgttttatcttttttgctattccacaaattcctaaccctctgttatttttttcagtctcttttctttcttgttcagtttgagtaatttctattgttctatctccaagttcagggatttctttcccccctttttttctcggttttgctgttgagcccatttaatttattttattttatttggttattacatttttcagttctgagctccattcggctctttgtatctatttgtttgctgagatgttccattttttcatttgttttaagcatgttagtaattgcttgttgaagcatttttatgatacttgttttaaaatctttgtcagataattccaacatttgtgtcatctcagtgatgatatctattgtcctttctcattcaaatttagagttacctgatttttggtatgacaagtgattgatttttgattgtatcttggacattttagatgcattataagacattggatcttatttccatcttgtgtttaagcagacctcctttgacactacactggtggtaaggggaggtgctgcctactgccaagtggggactgaagtttagacttcccattcagcctctgttgacaacactgtggtgggcataactgatgagtgggtctgagagttcaggctgacaccactatggctggaacagggaagggtgcacctcattactttcatggcctctgctgacatgaggatgaggaggataatgaaggggggaggttgttactactgaagagtgatgaaaatcctagttctttattaaaccacttctatccccaccatagaggagagggaggggaactccttcttatcactgaatggggatgtatagcatatagacattttattttctgtgtattatgatgtttttacatcttttaaaacattattggctggagacactgcccttctcagggctagccaatttttagagatagcaagggaccagccaggagcatgtcttttgttttagtctgtttgctgctgctataacagaataccacatacagggtaatttattgttttcttttcttttttcatttgagatttcattctctaaaaagactgggtaatttataaagaacagagattcatttggttcacagttctggaggctgggaagtccaagagcatgatgctgacatctggcatgtgtcatcccatgatagaaggtggaaggcaagaaagcatgcaagacagaaaaggagaccagactcctgtaacccactcctgcaataacagcattaatccattcatgagggcagagccctcatgacctaattacctcttaaaggtcctgcctcttaataccatcacaatggtaattcagtttcaacatgagttttggaggagagattcaaaaccatagcacttttgatatgcaagctaactaatccagagccatatctcccctgtctggcctttatatctcaggaggcaatggtcctctgctttgatcgtcccagggtcaggtactaggcaaccagggacctacctctcctgtgtcttagagcctgccaaaattattcaaactagccaattctagactattcaccctgccctgtcttgcctttcctatggaaactccaataataggctctggcctaaaccttcccctcattcccatcttctgccttctgaccatcctagtgtcttttctgtgtggctctgcatggcctgctgtacctcttgtctctaggacctgcaagtataataaactttatttttttcctgagtctctaccttcttttaatggctacacccaactgactatctcataaaaagaatatgaaacaggatggagatccaaatatgtcctccactgacattgttgggcggggatgtgctctttaacactgggctgtcccaagccttttctgatggtactgctgatttggaagagagttgtcttattatagcctggtgagtgtggaagtttaggttccccattttgacctttgtgcttttgtcaaaaattaattgaccaaatatatgtgaatccatttctggactctctgttctatgtcattgatctatttgtcttatcattatgctaatactgtactgtctcaattactgtaaccctcctaacttttttctttttcaaagttttctttgtttttttagctattctaggtcttctgcattttcatatgaattttaaaatcagcttgataatttggcaccattcccttgtttctattacagcttagctctgtaataaaaaacatggttgtgtgttgcctaattttctggtgtttattaataattaaaacatgtttgtatctgaaaatttagaaatatggataagtaaatatataaaagatatattaaaatcacccagattttgaattttaaaaagccatttaaaagatgtattataaaattcaataaaatattgcataatacatatgtagacatgaacatattgcatgtatgtaaagatattgtatttgtgtaggtatagtcatgtatttattcctacacatagaagaatgttgaggttatataccaaaatgttggcagtgattatctttcgttggcatgattaaggatgcactgtgttttaaccttattatcacattattctcattaaattattaaaggtaaatgcaaaaattgttcttttactattaatgtcattgtataatttggtactgtgataactaacatgatttaataaggttagaaactttgttttctttatttttttcaaaaatagttccatcagagttcctttctactgtcagctagcaagaagaaacgaattagtaaacagtgcaagttgatgcgtcttccatttgcaaggtaaatatgggcttgaattacactagttcagagtatatagattttatataacacaattagtgtttgtgtgtattgtacagtgttcaggatcatcaacctgtagttatctactaacgtagaaatgagctggtttgtagtgtcttgctataggttgtttctctaggactccaaggaaacttacggtcaatcccccaaccaggtttatttgtaatgtcttgctactttatagttcttttttttcttttcatctagttcactcctggccttatattgatttttgctggataaatctgatgactgtttctacctttattatcctgtgtactgtcctaaactttaaaattaatttttgtcgaccagcaggacgtggtggctcatgcctgtaatcccagcactttgggaggctgaggcaggaggatcacgaggtcaggaaatcgagaccatcctggctaacatggtgaaaccccgtctctactaaaaatacaaaaaattagccgggtgtggtggcgggcacctgtagtcctagctacttgggaggctgaggcaggagaatggtgtgaactcgggaggcagagcttgcagtgagccgagattgcgccactgcgctccagcctgggcgacagagcaagactctgtctcaaaaaaacaaacaaacaaaattaacttttgtctttgctcttatcctcctgtgcacaattctcattttttattaatttgattataagttatagaaagcaccctatttcaaatctgtcatcttacaagtcagtcagtgatgctcagagaggcaaaatgattgaatgaattgatagcattgaccaaaatcctgttgtctcttttagaaatgttctttctattatatataacatatagatttaatgcttttacttaagtgcacaagtaaatgcacttatttattgaaatgctatctgtgccatagtaaaaaattctcatatttactgtatcactttcaattcattgtagtttgttccattgacttgcctattatgtgtgttattaccatttcataccagtacattttaattgttgtaattttaaaatagtaaattttgttgtttattagatccttagtagtttttcaaaagtatgttgtcattatgcacgtattgtttcatatagatatgcaaattaagtgtcaacttgtcctccaaaaaattgtattgtgtgtctttaagtgaacttttgtttgaagtatattatacatattcaaacatggtggattttcaccaagtgaacactgttgtgtaatgcatacccagaacaagaaacagaatattaccaacatctcagatacttccttgtgtccctttctagtcactacccactacccaacacctacccaaggataaaatattatactgacttctaattatagatcaattaattttacatggttttgaacttcatataatgaaattatacagtatgtatgtttgtctctgtcttcttttgcccagcattatgtttgttagattcatccatattgctgtatgtagttgtaaattatttgttctcattgctgtatagtattcaattgtatgattatactacaatgtatccattcttcttatggtcaacattttgttggttttccagtttgtttgtttgctttttgagacagagtcttgctctgtcacccaagctggagtgcagtggcacgatcttggctcactgcaacctccacctgccgggttcaagtgatcctcctgcctcagcctcccaagtagttgggattatgggcacccaccactcttcttggctaatttttgtatttttaatagggacaggattttaccatgttggccaggctgatctccaactcctgacctccagtaatcctcccacctcggcctctgaaagtgctgggattacaagcatgagccaccacacctgacttggttttctagttttggtctattacaaatagggctgccacatatatgccttttgatgaaggtatgcacacattctgttaggtatatagtgtggagtagaattacttgggagatctatctatctatctatctatctatctatctatctatctatctttggcttcaggagaaactgctaagtagttttctaaaggagttataccaatttacattattactaacaatatatgaggattcctgttgttctgtatcctcaacaattcttgttattgtctgtctttttcattttagccattttgagggatgtatagtggtatcattttgtggttttatttttaattttcctgataattaagaagttaagtatcttttcatatgtttactttctattgggttatctgtcatattttttaaggtgttctttgtatacatatttttgtatgtgaggcaaggtctcactttgtcacccagcctggagtgtagtggtgcaatctcagctcactacagccttgacctcttgggctcaagcgatcctctctcctcagtcccccaagtagctgggactacaggtgcatgccatcatgcccggctaatttttatactttttgtagagacagggttttgccatgttgcccaggctagtcttgaactcctgagctcaagtgatctgcccacctcaacctcgcaaagtgctaggattacaggtgtgagccaccatgcctggcatattcttcgtgtatcttctactctgtggcttgcccctttgctctctgaatggtgtctttagatgaccagtagctctttatgaaatccaactttgtttgtggcggggaggtgtgtatcttctccctcacccgccttttcggttactaatttttgtgtccttttgagaaaatctttattggttctggttctaaaacggcagtgtaagataagctggcttctcttgccccaacaaaacaaaacaaaacaaaacaaaatatacagtgccaagatctaccaccatcaacagcccagagatcaagctagttgagatacttcccggggccaaaaagaggtggaaaaactctgagcagatggtaggagaactgcacttccacatgtgcaatgcccctccctcccattctgccaggcccgaactatgtggaaaatctcccctcaactcacagtttctatactggaaaaagcaaaattgaaatggtcagccagcttccccaccttcttcagttccctgtcaggagaactgtccttgccttaactgatgggtagcattatgactgcctgaagggagaaatatcccggaggacaggcagagacagacaagcaaggctggactaccatccccagcccagaaactctgctctgtaactcagccaaaggaagcgccaaatgagagtggttgtaggaggtgcattccccaggtcccctgggtgtgaactcctagccagccttcccacattgctgtcctaaaccctttgggacctcccccattttgggacaggcagtggtcaaccatttactagctccaaggtgaacctgggttgaaggcaccacctggagccaaaaagaaggcagcaaactagcagtatagatttgctaaaaaaaaaaaaaaaatacaaaaaattagccaggcgtggtggtgggtgcctgtagtcccagttattcaggaggctgaggcaggagaatgacgtgaacccagaaggcggagcttgcagtgagccgagatcctgccactgcactccagcctgggctatcgagcgagactccatctggaaaaaaaaaaaaaaaaaaaaaaaaaaagatttgctaggcagatatattcaataaaatccaaaacaggctggacaaagaaaactggaataaataatccttcaaggcaaagacatagacttacactcactagaaactacagcagacaaggagccatgagcttcccaaaaggacaaaaagcagaaatttagtgactgatgaagtggcagtttgtgatttcttggaccaagaattctaaatagtagttttaaggaaactcagtgatctccaagataacaaagaaaagcagctcagaaatttatcagagaaatttaacaaagagattaaaataataaaaaaaagtcaaacagaaatcttggaactgagaaatacatttgctgagctataaaactctttagaggttcttaacagcagaatgaaccaagcagaggaaagaatcagtgagctggctatttgaaaatacacagtcagaggagaaaaataaatagaaggaaaaggaatgaagagtgcctacaagatacagaaaattaccccaaaagaccaaatctaagaattattagtgtttaagagagagctgagcatgagcaaggcataggaagcttattcaaagaagtaataacagaaaacttttcaagacatgagaaagatatacatgtccaggtaaaggaaggcctgagaacaccaaacagattcaatgcaaataagacaacttcaaggcatataataatcaaactctcaaaggtcaaagacaaagagaagatcctaaaagcaatgagagataagaagcaaataacacaaaggagctccaattcatggggcaacagacttctccacagaaaccatgcaggccaggagggagtagaacaacattttcaaggcactcaaacaacaccaacgacaaaaaactgacacccaagaatattgtgtccaacgaattgtcatgcaaatttaaaggagagctaaagtctttcacggataaacaaaagctgaggaaattcaccaccaccaaggaccatcttgtgagaaatgcagaagggagttcttcaatctgaaagtaaaaaacactaccatgcaaaaggaaactttttaaggtataaaacccactggtaaaattaagtacacagacaaactcagaatcctttgttaactgtatttatggtgtgcaatccactcaaactctagcatgaagcccaaaagataaatttatcaaaactatatcaacctgttaatagataatataaaaatatgtaaattgatacaactaaaagacaaaatgttggagggtggagttaaattatagaattcttttgtgggttttcatataaattgtctcagttcttcagttaaaagccatagagtagctgaatggataaataaatgagacctacctatgtgctcccttcaagaaactcacttcacctgcaaagacacatatagacaaagtggagaagggctggaaaaagatattccatgcaactagaaaacaagagcaagagtagctgtactcgtagcagataagataaactacaaagactgtaaaaactggcagtaaaggagggtcactatatgattaaggggtcaattcaaccagaggatataacaattataaatatctatgcactcaacactgcagctccatataaagccaacattactagatgtaaagggagagagagactgcaatacagtaatagtagggggctttaacatcccactctcagtaatagacagatcatccagacagaaaatcaacaaagaaacagcataaactgcacactagatacaataggtctaactgacatttcacccagctgctgcagaatacacattcttttcatcaacacatggaagatttttaagaatagaccatatcttaggcacaaacaaatctgtacaagttcaaaaaaatataaatcatatctggtatcttcacaatggaagaaaactggaaattaaaatgagaggaactttggaaaatacacaaacaaatggaaattaaacaacatgctcctaagcaaccaatgggtcaaagaagcaagtaagaaggaaattgaaaattttcttaaatgaaaagggaaatacaacatagcaaagtgtatggggtatggcaaaagcaatactgaaagggaagtttatagcaataaatgcgtatatcaaaaaaggagaaaaacttcaaataaacaacctaaaaatacatgtcaaggaattagaaaagcaagaacaaagcaaatcccaagttagcagaagaaataataacgatcagagcagaaataaataaaattgatactaaaaaagtatagaagataaaatgaaaagttggttttttgaaaagataaacaacattgacaaacctttagctagactgagagagaggactataataaataaaatcaaacaagagatgagacataacacctcagacctcagaaatataaataattattagagacgattatgaataattatacaccaacaaatcacaaaatgtggaagaaatgaatacatttttggacacatataacctaccaagattaaaccataaagaaatagaaaacctcaacaaaccaataacaagtaatgagattgaagctataataaaaactctcccattgaagaaaagcccaggctgggcacagtgggtcacacctataatcccagccctttgggaggccaaggcaggagaattgcttgaggccaggagtttgagaccagcctgggcaatataacaagatccagtccctacaaaataaaaaattagctgggtatggtggctaatcctgtgaggattaatcctgtcaggctaatcctgtggtcccagctactcaggaggctaaggtgggaggactgtttgagcctgggaagttgaggctgcagtgagcagtgttcacaccactgcactccagctttggtgatggagcaacaccctgtctcaaaaaaagaaaagcccaggacttgatggattcgctgctgaattctaccaaaaatttaaacaatgattatgaatcccactaaaactctttgaaaaggagggaatacttccaaactcactctacaaggccagcattaccctaataccaaaaccagacaaggacacaacgaaaaaataaaactacagaccaatatcactgatgaacatagatgcaaaaatcctcaacaaagtactagcaagtcaaattcaacaacacattaaaaagaacattcaccatgatcaagtgggattcatgctagggttttaaggatggctcagcagacacaaatcaatcaatgtgattcaccacattaaaagaaacaagaacaaaaactgtatgattatttcaatagatgccaaacagcttttggtaaaattcaacatccctttttgataaaaacacttatcaaaatgggtataaaaagaatatacctcaaagtaggaaaggccatctatgacaaacccacatctagcattgtactttgaagactggaacaagacaagaatgcccactttcactgctattcaacataatacttgaagtactggccagagcaactaagcaagaaaacaaaataaagggcatccacattggaaaggaagaagtcaaattagccttgtttgcagattgcctgatcttataaagactccactgaaaagctgttaggacacataagggaattcagtaaagttgcaggatgcaaaatcaacataattagtagcatttatatacaccaacagtggacaatctgaaaaagaagtcgagaaagcaatcccatttatcatcgctacaaaaaatatgaaatacctaggaatcaatctaaccaaaagaggtgaaagttctatagaaggaaaatgacaaaactctgatgaaagaaataggacaccaaaaaagggaagatattccatgctcatggattggaagaattaatactgttaaaatgaaaatactacccaaagcaatttacagattcaatacaatttgtatcaaaataccaatgacattcttcacagaaataagggggaaaaatcctaaaaatttatatgaacccgcaaaagaccctgagtaaccaaagcaatcttgagcaaaatgaacaaagctggaggcatcacactacatgacttcaaaatttatgacaaagctgtagtaaacaaaacagcatggtactggcataaaaatggacatagataccaatggaacagagaacctagatataaatgcaccatttacaaccaactcatcttctgcaaaggtcccaagaacttacaaagggatagtggtcaataaatagtgcgggaaaactggataactatatgcagaagaatgaaactagactcctatctctcaccatacacaaaaatcaaatcaaaatggataaaagatttgaatctaagacccaaaactatgaaactattagaagaaaacattggggaaacacttcaggagtgatctgggcaaaaatgtcttgtgtaagacctcaaaagcacaggcaaccaaagcaaaaatagacaactaagattattacatcaagctaaaaagcttctgcacagcaacggaaacaatcaacaaagtgaagagacaacccatataatgtgagaaaatatttgcaaactgtctctctgagaaaggattaataaccagcatatattgggagcttaaacaactaagtagcaaaaaaaaaaaagaaaaaaggggaatcatatactggtagaaatgtaaattaacatagccactatgcagaacagcatggaggttcttcaaaaaactgaaaatataccttccatatgatctagcaattccattgctgagtatatatccaaaaaaaaaggaaattagtgtatcaaagagctgtctgcactcccatgtttattgcagcactattcacaatagccaacatgtggaatcaacctaagcacccatcaacagatgtgtggataaagtatggaagatatatacacaatggcgtattattcagtcataaaaataaaatcctgttatttgcagcaacatggacagaactgaggccattatgttaagtgaaataaaccaagcaccaaaaggcaaatattctcactcatatgtgggagcttaaaaagtggatctcatgaagatacatttgtggttaccagaggctgggaagggggagagaggaatgaaagagaattttcattatcactgaactgtagacttaaaaatgggaaagatgtaagtcatatatgtatcttttacctcaatacatttttttaaaaggaatatttctattgattgcaaggtcacaaggtgttctgttctaaaatttttattattttcccattcatgtttatatattcagtctacttaagaattttgggtatgatgggagggaagggtcataattttttttttcatgtaggtatcttactgaccttgtatcatttattgaagcaatcatcctttttccaccccactgcagtgtcatctgtattgtaaatcaaggagactggatatgaatgggtctgtttctaaactcactattctattatgtgagtccttttgtcaataccacactgtcttaattattagctttatagtaagtcttgctatttgatagtgtgaatctccattttatttatttttattcttcaacattagcttggctctttgcatttacacttgaattttagaatcagcttgtcagtttacacacacacatacataacctagaatttttggccaggattatgtggaatatagttcagtgcagggacaacggacattttataaaattgactcttccatctataaacatgatatatcactctatttagctataatatatattctctccatgttttgtagtttttttgtattgagttattacatatctcagatttatttctattcatttcatatagatacttttttaaaatatattttttgagatagggtcttgctatgttgtccaggctagattcaaactcctacctcagcctcctgaataactgagattacagttgtgtgtcacagtgctcagctttattttatattcttaaatgatattctgaatgttactgggttttgtttgtttgttttttaagtgaaagcaagtttactagtaaagttaaggaataaagaatggctactccataagcagagcagtggtatgggctgttcaaccaagcttacttgtagttattccttgatcatatgcgaaacaaggggtggattattcatgagttttctaggaaggaggtgggcaattcctggaactgaggttttctccccttttagaccatataaggtaacttcctgacattaccatggcatttgtaaattgtcatggtgctggtgggagtgtcttttagcatgctaataaattataattagcatataatgagcagtgaggtagaccggaggtcacttttgtcaccatcttggttttggtgggttttggccagcttctttactgcaggctgttttatcagcaaggtctttgtgacctgtaccttttgctgacttcctgtctcatccattgactaagaatgccttaacatcctgggagtgcagcccagaaggtctcagccttattttacccatcccctgttcaagacggagttgctctggctcaaacacctctgacacatccgcacccccccgcccccttttacaagggaacccttaatgctaagggttgtagagggacgaaaattcatcttctgtaacttcttcaggctgaataggggtgataatattcctgcctaactgttagggtctcttgtatttgggtagagaggagctcagtcagaaggcaacagtatggtgaggaccattcataactcttgagttctgacaaaaggtgatacctggaagattaataagtgcaccatttcggaaaacattaaggaagcccatactgcattcctacacaaggagtacaatagcaatatattctacaacagtaaaacaaaataagtaaaattatcccaagtaaactaaataagaaggctttccatgaactgggcaattgttgaaaccaagctaatagggagtcactaactgattccaatatgtgcccagaattagaatactgattgagatttctacattacctatccctcttgtttcttttgagcaacagccagagaccactgatgggttcacaggaataagcagagtcagtctaaattgcagaaaaaaactcaaaaacaactgatgagactagaatccaataacaggtgtatcatagtgcttgaaacataattttcttctctctccagtatcacatttttactaaagacaaatcataatagaactgatttgtttgcaaaaataagctttagtcttacacttagcctgattatttgtataaagtgcagcaagaataatttttttaaacataagctctttttaaactggctttgatggaacattgttccataaggaatctcagatgagacttttttaaagccgagcccagccatgggtttgtaccctccgatacctataacttgagtaaattcctctcttcttgaggtcccaagataacttggggctcctgggcctgtcagaaaatgacattatttacttaccgcaggtcaagaaacctgtacagggattgtgtacacaaggtatgaggccagttttcccaatgggcctttattggctctctaagtctaatttgattgcttaaaggaaagcacaccattccagtcaatgccttggtaaaataaccagtttttccaattgtgttctgttgcaaaagaaaacagattcttattgtacttatacaaacaactatattgccatcaattaagaatattcacaactagttttcaaattctagagaaatcaggtagagagaaacaaacatgctccaaattttgttcacaggagtatactgtactcaatttttaaaagctgtaaatagctcaaaagaaaaattttgttgacactgaaaaactaaagatcatcaacgtttcaagcaaaaagccaaaaaagattacttcagacttacattggttcagtccatgcagttaaatactgtcctatttgatattcatgaacatttccactctccatgagtactggaagttttttcctctattctaatgtcacaatctccaaagttactagaaacttgcattcaagagcacctgtcaaagtcctatagctgattataaattaccttttgaagaggattaaaacaagacaattgtctgtaggtgacaaaaagtcttagttaggacaaccattattaaagccacaatcgacaaggaaattttggtttcttctatgacacacaacaattttacataacagttataatgattaataacatacactaagccatatcagagttacaggaattttgcataattttggaacacataccagtaatatttatataagcacaaagaaaggcaaacactcacatttgacagtgcttcctgtaagatttttatgccaaatacgccaaatttcaccactgcattagtgcattatttatgtcaaactcaattcttaataaaaccttatacaaaaatgtattcaatcttaatcagtttgaccttaaggtaagattctcaaaccttttacaaccctttataaattttttttaaagagcagatcagtgctctaagaaaaacctgttatgcttttattccaatgttcaatttatggaaagacagaataatacccctttaatatgttctcacacacaacctttttacaagattaatttttcacaaacctccacaacttgctcgaatcttcagctttatcctatctaatttaaaacaattcttcaaccctctcaacaaggcaaaaagatattcacattcccatgactttttataatcttttcccaaagattagttaagtcacatgaactaaaaggcattacactttttacttttctgacaaaatgttttatttaagcgcttattatttttaagccagttaaagcccttttatatcacacacaccacacacataaatacacagacaaacaaaagaagatccagtagttgtaagatttttcatttgctagtttttaagtttctatttcaagcatacactttctagggcctaataagcaggcatagctggaaggcaaaataaatccccccaaattaagggtcccatttttataccagatcctagatcccaaaaaatgagaaatgctacggaacaagacagtacaatgattttactgtgcattttttacaaagcaacccaaagctaatcagcccattctgtgattagcccatcccccaggggaatcttatttctcagtggtagtgggaggtaaggacatttccataccttccaggtggccaagagcatgcttttctgatccaaacatgcaaacagccgagtatccccaccataactgccattagctatccccagaagcatatttcctaccaaattattacaccccaatgttctctcataatgcaaagaatttctgatacccctgaaagtcaaaaatatcagataacacaatgtgaaacagaatagagccttagattttgagggagatctatcaactttcaattcctggggtttcatgaggtaaataggtttttcccaaaacagggtctgtggtgcctcctctgttttccccaaggagtctcaggctgttagagcttgaatatccgctttttttgtttgtttgttttgagacggagtctcactcttgtcatccaggctggagtgcaatggtgcaatctcggctcactacaacctccacctcctgggttcaagcaattctcctgcctcagcctcctgagtagctgggattacaggcacctgccaccaagcctggctaatttttgtatttttagtagagatggggtttcatcattgttggccaggctggtctcgaactcctgacctcaggtgatctgcccacctcagcctcccaaagtgctgggattacaggcatgagccaccgtgctaagtcgaatatccgcttttaattatctactgacttttagtcatagtgctcttttaaaaagtccttttaaatctcattacctgattttagccaggccaaacagccaatatttctcgcttttgaattttaccaaaggtaacctcccaggtgaaaccaataagcctaaagttatgacttaaccataagttaatcatatgtacatgatattttcaaggaggtggtaagcaatttttataagatctagaatctccaaaggtagctcagagaaaggaagattcacgaagggaagccagaagtcatacatggaggggaagagaatcaacaaatgataaagatcacacagatatcaaccagaaagtactcattccctaagctgggtattgaacccaagctgccatagtgaaaagacaaagccttcgccagtaagctacagcattgggcagtttccattacccttcccagaaggaccttacagcagccaattttgagcttgcaaaggcttttaactgctcaaaacaatttttagagctaactatgatatcaaccccaaaactcctggccgagagagagagagagacagagacagagacagagagacagagagagggagagagagagagattgcctgtggcaaagtggggcaggcaaagagttcagggaagccagagaaagacccactcattgcaatgacactgaatcaaaagttcaggtggccatttgtcagttgtgaaaggatcttttccagcagtcctgtcagctctcaggtttccccctttaggggaggaaaaagctccccatgtcccatgaacatgtatgtgcctaatcctgtcacccacagccatctgcaaacagtggaaggcaaattaatccaaagagaagagtggttaatgtcccataatgccaaatttgttcgtagccaagagggactttactgatgggggcctctaatcccctacatctcagaagggactctaaccctcataagttgggcctcaaactgaagtttggtgaagcatccttgccttttattaagaggggcctttaatccactctgtcttaggagagactaactcccctaagttgggcctctaacccaatcccatcctttacctgggcaccccaccacttacccaaagttggccaattggtgctgcagtctatttcctttgggtcaggggtctcttcagtatcatcccttcatggtttgccaagaagatgttattggaaagcgtcctgatccagaccccaagagagggttcttggatctcacacaagaaagaattcaaggcaaatccttaaagtaaaagcaagtttattaggaaagtaaaggaataagaaatggctactccataggcagagaagctctgctttttaaatttaattttcttcttgatgttaatatatagcaatatgatttttggatattgaccttgtttccagtgaccttgctattctaatagtttgtgaataaaattttactatttgtgaataagggcagttttattccccctaacctcctaatatatagcttttcttttatttgtttgtttgtttgttttgtccaggttttggcttttattttttcttaccttgttgcattggctactttttttttttttttttgagacagagtctcactctgtcaccaagcttgagtgcaatggcatgatctcggctcactgcaacctctgcctcctgggttcaagcgattctcctgcctcagcctcctgagtagctgggactacaggcatgcaccatcacacccagctaatttttgtacttttagtagagacagggtttcaccatgttggccagggtggtctcgatctcttgaacctcgtgatctgtccaccttcgccttccaaaatgctgggattacaggtgtgagccaccgtgcccggccagctacttgttaaatattgaataaaagaagtaagaacaggcattcatattgtattcccattattaaatattgtattcctgttattaaatatgatgtctgctcttgggtttttgtagattctcttaatcagattatgaaagtttctttgtactttcagtttgctgagagtttttcatgaataactactgaattttatcaaacgctttttctgtcactattgagtagatactaattttttcttttttctattaatgttatgaatttttaaatattttttattcatataatgaattataaggatttttgaatgttaaaccacaattgcatttctacaatgaactgctcctgatgaagtatccttttgatatgccacaaaattgtaattgctaattttaaaaaaatatttttgcatcattttacatcattgtatgttgatgaaaatgatgtataatttttgtttcttgtaatagattttgtcaggtttttgtatttatagtatgccggtcactgtaaatgaattaagtgcacctctttttctgttttatggcagcatttgtgtaggattttttttttttttttaatgtttagaagttatctgggcctgcttgcagttttcttgtggaaaaggttttggtaacatctcttttttttttttttgaggtggagtttcactcctgcaacccaggctagagtgcagtggtgcgatcttggctcactgcagcctctgccttccgggttcaagtggttctcctgtctcagcctcctgagtaactgggattacagatgctcgccaacgcgcccagctaaattttgtatattttatagagacagggtttcgccatgttggccaggttggtctcgaactcctgacctcaggtgatccacctgcctcggcctcccagtgtgctgggattacaggcatgagccaccatgcctggtgtaacatctcatttctttaataggtataagaatattcagatttcttatttcttcttatgttaggtttgtaaaattttttttaaagaatttgaccatttcatctaaaattactggcataaaattgtccataatattatcaagttatgtgcttaatgtgttttgggtatgtagtgaggttctcttcttctttctcagtattgttatttgtgtttcatcactttttttcttagtcttgctctagaggtctgtcaattttattcatctttgtgaaggtctcatttggagctatgttgttgttttagtatatttgttttctatttcattgattctgctctttattgtttctttctgttttgcttttcttttcattattattattactcttattagttgcttcttggggtagtttagattatcaattttcagcctctcttttaaaaaaataagcatttaaggttattttcctataatcactgctttagctgtgttccacaatttttatttgtttattttgtgatgagttctcgttgcccaagctggacttgatttcctaggttcaaatgatcctcctgctttagcctcctgagtagctgggactacaggcatacatcatcagtcttctagattcacggtttttgatataccatatcattatttagttcaagattttttttcctgattttttatttgaccctgtggatcacttacaagtatattgtttaatttctaagctgatgggtatttttatttttactttttgttgttgatgtctagcttaattctgctataattagggactatagttaaaatgaatttcgatttttgaagtatattgggaatttcattaggacaaagcttgatctaatttggtaattatttggggtgcacatgaaaaaaatgtgtagtttgcaatggttgaacgcagtatttttatgtatggcagctgtgtctagtttgttaattatagtcttccatatccttcctgcttctgttgtctgtttattctgtcagttattgagagaagtttattaaagtctaccattatgattatgaattcatctgtttctccttttagttttgtcaatttttgctatatgtattttaaagctgttattaggtactcatacatttaggactgatttgtttttctgatttctagcaatggttcctgctttgaagtctactttgtttgttataatatttccatgatatatctttttctatacccttactttcaaattctattatatttaaaatgctatataagtgaatcaggtgtcattttatcatcttcaggtatctatctttttctgttgaaaagttagcacctttcttgcaagctgaagaagttcccttttttctggttttctgagtttttataatgatttgtattgaattttgtcaaatgatttttttgcatttctagagagaatcattatttttttctttgttctattaatacagtgacttcagtggattttctaatgcaaactttgcgttcctaaaaaaaaattccacttcgttatgatgtattattctttctatatattgctgggtttgatttgctaatattttctttaaaattcttgtgctatgttcataagggatattggtctttaattttcttacaaaaaccattgatgggttttgacaagggttatgctggcctcatgggatgagaagcatttgtcttcctcaatttttgaaagagtttgtacaattggtagtttttcattaatgtttaatagaattcacaagagaagtaatttgggcctggagtttttaattatgaatttaatttttaaaatagatatggggcttttcaagtttttggtttcttttcaagtcaatatagaaaacgtttgtctttcaagaaaatcacacatctcatctagtcagtaaagtttattggtgtaaagttacttatactatgcttttcttattcttttttttattattatactttaagttctagggtacatgtgcacaacgtgcaggtttgttacatatgtatacatctgccatgttggtgtgctgcacccattaactcgtcatttacattaggtatgtttcctaacgctatccctcccctctgcccccacccaacgacaggccctggtgtgtgatgttccccatcctgtgtccaagtgttctcattgttcaattcccacctatgagtgagaacatgcagtgtttggttttctgtccttgcaatagtttgctgagaatgatggtttccagcttcatccatgtccctacaaaggacatgaactcatccttttttatggctgcatagtattccacggtgtatatgtgcacattttcttaacccagtctatcattgttggacatttgggttgtatacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccttgaggaattgccaccctgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttatccttcacccactttttgatggggttgtttgattttttcttgtaaatttgtttaagttctttgtagattctggatattagccctttgtcagatgagtagattgcaaaaattttctcccattttgtaggttgcctgttcactctgatggtagtttcttttgctgtgcagaagccctttagtttaattagatcccacttgtcaattttggcttttgctgcaattgcttttggtgttttagtcatgaagtccttgcccatgcctgtggcctgaatggtattgcctaggttttcttctaggttttttatggttttaggtctaacatgtaagtctttaatccatcttgaattaatttttgtataaggtgtaaggaggggatccagtttcagctttctacatatggctagccagttttcccagcaccatttattaaatagggaatcctttccccatttcttgtttttgtcaggtttgtcaaatatcagatggttgtagatgtgtggtattatttttgagggttctgttctgttccattggtctatatctctgttttggtaccagtaccatgctgttttggttgctgtagccttgtagtattgtttgaagtcaggtagcgtgatgcctccagctttgttcttttggcttaggattgtcttggcaatgcgggctcttttgtgtttccacatgaactttaaagtaggtttttccaattctgtgaaggaagtcattggtagcttgatggggatggcattgaatctataaattaccttgggcagtatggccattttcacaatattgattcttcctacccatgagcatggaatgttcttccatttgtttgtgccctcttttatttcattgagcagtggtttgtagttctccttgaagaggtccttcacatcccttgtaagttggattcctaggtattttattctctttgaagcaattgtgaatcatgagttcactcatgatttggctctctgtttgtctgttattggtgtataggaatgcttgtgatttttgcacattgattttgtatcctgagactttgctgaagttgcttatcagcttaaggagattttgggctgagacgatgaggtttttttaaatatacaatcatgtcatctgcaaacagtgacaatttgacttcctcttttcctaattgaataccctgtatttgtttctcctgcctgattgccctggccagaacttccaacactatgttgaataggagtggtgagagagggcatccctgtcttatgccagttttcaaagggaatgcttccagtttttgcccattcaaaactggaggctgtgggtttgtcataaatgactcttattattttgagatacatcccatcaatacctaatttattgggagtttttagcatgaagggctgttgaattttgttaaaggccttttctgcatctatggagataatcatgtggtttttgtctttggttctgtttatatgctggattacgtttattgatttgcatatgttgaaccagccttgtatcccagggatgaagccaacttgatcatggtggataagcttcttgatgtgctgcaggatttggtttgccagtattttattaaggattcttgcatcgatgttcatcagagttattggtctaaaattttctttttttgttgtgtctctgccaggctttggtatcaggatgatgctggcctcataaaatgagttagggaggattccctctttttctattgattggaagagtttcagaaggaatggtaccaactcctctttgtacctctggtagaattcagctgtgaatccatctggtcctggactttttttggttggtaggctattaattattgcctcaatttcagaacctgttatcggtctattcagggattcaacttcttcctggtttagtcttgggagtgtgtatgtgtccaggaatttatccatttcttctagattttctagtttatttgcatagaggtgtttgtagtattctctgatggtagtttgtatttctgtgggatcggtggtgatatcccctttatcattttttattgcatctatttgattcttctctcttttcttctttattagtcttgctagcggtctatcaattttgttgatcttttcaaaaaaaccagctcctggattaattgattttttgaagggtttctttgtgtctctatctccttcagttctgctctgatcttagttattgcttgccttttgctagcttttgaatgtgtttgctcttgcttctctagttcttttaattgtgatgttagggtgtcaattttagatctttcctgctttctcttgtgggcatttagtgctgtaaatttccctctagacactgctttaaatgtgtcccagagattctggtatgttgtgcctttgttgtcattggtttcatagaacatctttatttctgccttcatttcgttatgtacccagtagtcattcaggaacagattgttcagtttccatgtagttgagcagttttgagtgagtttctcaatcctgagttctagtttgattgcactgtggtctgagagacagtttgttgtgatttctgttcttttacatttgctgaggagtgctttacttccaactgtgtggtcaattttggaataagtgtgatgtggtgctgagaaaaatatatattctgttgatttggagtggagagttctgtagatgtctattaggtctgcttggtgcagagctgaattcaattcctggatatccttgttaattttctgtctcatggatctgtctaatgttgacagtagggtgttaaagtctccctttattattgtgtgggagtctaagtctctttgtaggtctctaaggacttgctttatgaatctgggtgctcctgtattggttgcatatatatttaggatggttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtcgctgcacatgagatgggtctcctgaatacagcacactgatgggtcttgactctttatccaatttgccagtctgtgtcttttaaccggagcatttagcccatttacatttaaggttaatattgttatttgtgaatttgatcctgtcattatgatgtttgctggttattttacttgttagttgatgcagtttcttcctagcatcagtggtctttacaatttggcatgtttttgcagtggctggtaccagttgttcctttcaatgtttagcgcttccttcaggatctcttttagggcagtcctggtggtgacaaaatcgctcagtatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagttctgctgttagtctaatgggcttccctttgtgagtaacccaacctttctctctggctgcccttaacattttttccttcatttcaactttggtgaatctgacaattatgtgtcttggagttgctcttctcaaggagtatctttgtggcattctctgtatttcctaaatttgaatgttggcctgccttgctaggctggggaagttttcctggataatatccggaagagtgttttccaacttggttccattctccccgtcactttcaggtacaccagtcagacgtagatttggtcttttcacatagtcccatatttcttggaggctttattcatttctttatactctttttttctctaaacttctcttcttgcttcatttcattcatttgatcttcaatcactgataccctttcttccagttgatcaaatcagctactgaagcttgtgcatgcatcacatagttctcatgccatggttttcagctccatcaggtcatttaaggtcttctctatgctgtttattctagttagccatttgtctaatctgttttcaagggttttagcttctttgcgatgggtttgaacatcctcctttagctcggagaagtttgttattacagatcgtctaaaaccttcttctctccactcatcaaagtcattctccattcagctttgttccgtggctggcaaggagctgcattccttttgaggggaagaggtgctctaatttttagaattttcagctttctgctctggtttctccccatctttgtggttttatctgcctttggtgtttgacgatggtgacgtacagatggggttttggtgtggatgtcctttctctttgttagttttccttcttacagtcaggactctcagctgcaagtctgttggagtatgctggaggtccactccagaccctgtttgcctgggtatcaccagtggaggctgcagaacagcaaatattgcagaatggcaaatgttgctgtctgatcgttcctctggaagcttcatctcagaggggcactcggccatatgaggtgtcagtcggtccctactgggaggtgtctcccagttaggctactcaggggtcagggacccacttgaggcgatagtctgtccattctcagatctcaaaccctgggctgggggaacgactattctcttcaaagctgtcagacagggacgtttaagtctgcagaaatttctgctgccttttgttcagctatgccctccgccagaggtggagtctacagaggcagtcaggcctccttgagccgcagggtgctccaccggcttcaagcttcctagccgctttgtttacctactcaagcctcagcaatggcgggcacccgtccccccagcctggctgctgccttgcagttcaacctcagactgctgtgctagcaagagcgaggctccgtgggcgtgggaccctctgagccaggcgccggatataatctcctggtgtgccatttgctaagactgttggaaaagcacagtattagggtgggagtgacccaattttccaggtgctgtgtgtcaaggcttcccttggctaggaaagggaattccctgaccccttgcacttcccaggtgaggcgatgccttgcagtgcttcagttcacactccgtgggctgcacccactgtcctgtaccaactctccaacaagccccactgagatgaacctggtacctcagttggaaatgcagaaatcacccgtcttctgcatcgttcatgctgggtgctatagactggagctgttcctatttggtcatcttggaacctctcttattcttttaatgcctgtagcatctgtagtgagaacctttctttcctgatttttgtaatttgtatgtttaatcaaactagctagaggtgtgtcagttttattgttcatttaacaaactcagcttttggcttcattgattttatttttctcaattttatgttttatatttcattggtgtctatttttaaattatttcctttcttgtatttacttttaaaaacatagagatatataattcacttaacataaaatttcttatcacatgaaattcacccttttaaagtatacagtgcagtggttttagtatattcacaaagctttgaatcttcaccctgttcatttctaaaatatttcaatctctaaaagggaatctcatatctataagcagtctccattctccacccccctagcccctaacaactgctaatctactttctgtctaaatggatttggccattttggatatttcatatgaatggaatcataaaatatgtggccttttgtgtctggcttttttcacttagcatattgttttcaaggttcattcatgttgtagcacatatgagcatttcattactttttatggagagacaataattctgttgtgtggatataccatgttttgtttatccattcatcaatcaatggacatttgtattgtttccactttttggctattatgaataatgctgcaataaacattcatgtacaaatttttgtgtggacatacattttcagttctcttgaatatatgcctagcagtggaattgctgggtcatctggtaactccgtgtttaacttttggagaaactgccaaattgtttttccaagcttctgcaccattttacattcccgccagcacagtattttgacactgatttctccatctcctcaccaacacttgttaataattatctattcttgtgagtatagccatctaggagtatgaagtagtattgcatcatggtttttatttgtagttccctattaattaatgatgtcaagtatatttttatgtacttattggccatttgcgtatcaagatcattctcttttgattatcttttccatgtgagtttaaatcatgtttttctattgcttcatatattggataatattagattgcacctgggtattgtgtatcccttgttggagaaaatgtagattcagttatgctcacccaaagagttttgatgtttcaattttaataggcactaaccttgtctgaacccaaaataagcaacatctgaaatctcattttagttgttttatccttagatagctgcttcgaatcttcctcatatatatgggattcagaggtcagctagatatttggggagcatttatacacaaaatttggggctctcctctttacctctcttatctgacatttccccccatcacttcacagctgttatagttgccctgaattctaaccttgaaccaataagactgtaggtttccaactttttttgaatgtggcaccagctgaggctgtaaaacaatgggaaactcactcttcttccaagtgttggcacccccttcgctagctctctacttgctttttgtccattcactgacttctagtagttgttttttaaaatattttgtccagaatttatagtcattatgttaggtagggttggtctgatagtaacttttagccattaccagaagcagaacctctccgtttatttttgttaacttgtttcctcaagtggtatagaaatttcctcccaacagctattctactggtagttgcctttaaatttctcataaatatttatcagaaatattttatttttcttattataaattattttaaaatatctgtgatttccttggaatacaagacagctctttactgtttgtggacgatattactcttcattctttgaattcaaatatgtcagtgtatcaaattatttctgtgggtttctgtcagttttcttcccatagatttaattactctaggaataatgattttagtgtacttggatgccttttggaaacatagcaaacttatttcacacataattttataaacaattacatttgctagaaaccaaaggaagatttttgggtattacatagaattaaaattttatgaaaagtataaatattatacatggctgtttgtaagtacatttgaacttttttcatttgcttaatagtagtcttctaatagcacaagaagtaaatatataaattatcttcttttggggccactgtgactaaggggttaagaagcattcatgtttccttccaagttctgttctagtaggaactactcatttcctacctttaagtgtcttcattgaacttgaaaaagtaccaggtggatttgtggttcgatcttaaatagaatatagaaataactgcccatgcatttaaagaaaatttataaaacacataatttctcatttccttcccacttgcctttagggttccattaacttcaaatgatgatgaagatgaagataaagagaaaatgcagtgtgacaacaatattaaatcaaagacattacctgatattccctcttcaggatcaacaacacaacctttatcaactcaggataattcggaagtgttatttcttaaagaaaataatcaaaatgtatatggtttagatgattcagaacatatttcttctatagttgatgtacctcccagaggtgagattgttttaaaaattcattttgagtatttgtattagttacattcatcagatgttcttcctgagggcaattatgtataacagttaataagttagctctcttatgttaccgatttgctaacttctgccatttaaaactgctggtgatagatttaattttaaagtaaatatgctgacaaacatcacacccacagtggcctaatactgttactctggaagaaatatttagaaataaatggacctaatgagcttttctcaatatcttagcttatgatttgaaagataccatatatttacttagttttaccctctttttttgtagatatgaaaattgggggcctagataggtatagagactctttgaagatcatcaccagttaattaatggtaaagcaaaaacttgagtctgggtaatggttgagcaagaaaaaagatggcatttacattttatttacatagtattcctaaatgataatctgtggtgtagtctggtgcttacagatttgccatagattttcagactgggatatggaactataacaattttgaatttagagcttagaattgtttttcctttctgaaaatgtgtgtgtgtgtgtgtgtgtgtgtgtgtgtgggcatatgtatatgtatataatatatacacacacacatatatacacacatatatatggtatacatataatgtatacagtatacatatatacatgtgtgtatatatttacacacatacaaacatatattaatatatgtatatataatttatataaattttagctgcctgttgatagtctttgatagcaatccttttcagagctatcactattatttgggttcatttgctggcctcctttcactctagaaatgtatgctaatggttctactgttggctgtactccactctactgttggggctgaggcagaattctcagtatatattttctgtagatacaaatgtaaaatgtgatttaggagtattcatcatttctaacttattttcttataagcatagattcttagtaatattaggatctgatcagaacacattgtcagaaattatatctgtgaaacagcttgatttcgaatctaatttgtttaaggtaacttatttatttcattacttgtttctgagttttgttttccttttcttaatagaaagccattcccactcagaccaaagttctaagacttctctaatgagtgagatgagaaacgcccagtctattggccgcagatgggagaaaccatctcctagtaatgtgactgaaaggaagaagcgtgggtcatcttgggaatcaaataatctttctgcagacactccctgtgcaacagttttagataaacaacacatttcaagtccagaattaaattgcaataatgagataaatggtcatactaatgaaacaaatactgaaatgcaaagaaataaacaggatcttcctggcttatcttctgagtctgccagagaacctaatgcagagtgcatgaatcaaattgaggataatgatgactttcaattgcagaaaactgtgtatgatgctgacatggatttaactgctagtgaagtcagcaaaattgtcacagtctcaacaggcattaaaaagaaaagtaataaaaaaacaaatgaacatggaatgaaaactttcagaaaagtgaaagattccagctctgaaaaaaagagagaaagatcaaagagacagtttaaaaatagttcagatgtcgatattggggaaaagattgaaaacaggacagaaagatctgatgtcctggatggcaaaaggggtgcagaagatcccggttttattttcaataatgaacagctggctcagatgaatgaacagctggctcaggtgaatgaactaaagaaaatgacccttcaaactggctttgaacaaggtgacagagaaaatgtactgtgtaataaaaaggagaaaagaataacaaatgagcaagaggaaacatactctttatcccaaagttcaggtaaatttcaccaggagagtaaatttgataagggtcagaattccctaacttgtaataaaagtaaagcttctagacagacatttgtgattcacaaattagaaaaagataacttactcccaaaccaaaaggataaagtaaccatttatgaaaacctagacgtcacaaatgaatttcacacagccaatctttccaccaaagataatggaaatttatgtgattatgggacccacaatatattggatttgaaaaagtatgtcactgatattcaaccctcagagcaaaatgaatcaaacattaataagcttagaaagaaagtaaaccggaagacagaaataatttctggaatgaaccacatgtatgaggataatgataaagatgtggtgcatggcctaaaaaaaggtaatttttttttcaaaacccaagaggataaagaacctatctctgaaaacatagaagtttccaaagagcttcaaatcccagctctttctactagagataatgaaaatcaatgtgactataggacccagaatgtgttgggtttgcaaaagcagatcaccaatatgtaccccgttcagcaaaatgaatcaaaagttaataagaagcttaggcagaaagtaaatcggaagacagaaataatttctgaagtgaatcatttagataatgacaaaagtatagaatacacagttaaaagtcactcactctttttaacgcaaaaagataaggaaatcatccctggaaacctagaagacccaagtgagtttgaaacacctgctctttctaccaaagatagtggaaacctgtatgattctgagattcaaaatgttttgggggtgaaacatggccatgatatgcaacctgcttgtcaaaatgattcaaaaataggtaagaagcctagactaaatgtatgtcaaaagtcagaaataattcctgaaaccaaccaaatatatgagaatgataacaaaggtgtacatgacctagaaaaagataacttcttctctctaaccccaaaggataaagaaacaatttctgaaaatctacaagtcacaaatgaatttcaaacagttgatcttctcatcaaagataatggaaatttatgtgattatgacacccagaatatattggagttgaaaaagtatgttactgataggaaatctgctgagcaaaatgaatcaaaaataaataagctcaggaataaagtgaattggaagacagaaataatttctgaaatgaaccagatatatgaggataatgataaagatgcacatgtccaagaaagctatacaaaagatcttgattttaaagtaaataaatctaaacaaaaacttgaatgccaagacattatcaataaacactatatggaagtcaacagtaatgaaaaggaaagttgtgatcaaattttagattcctacaaagtagttaaaaaacgtaagaaagaatcatcatgcaaggcaaagaacattttgacaaaagctaagaacaaacttgcttcacagttaacagaatcttcacagacatctatctccttagaatctgatttaaaacatattactagtgaagcagattctgatccaggaaacccagttgaactatgtaagactcagaagcaaagcactaccactttgaataaaaaagatctcccttttgtggaagaaataaaagaaggagagtgtcaggttaaaaaggtaaataaaatgacatctaagtcaaagaaaaggaagacctccatagatccttctccagagagccatgaagtaatggaaagaatacttgacagcgttcagggaaagtctactgtatctgaacaagctgataaggaaaacaatttggagaatgagaaaatggtcaaaaataagccagacttttacacaaaggcatttagatctttgtctgagatacattcacctaacatacaagattcttcctttgacagtgttcgtgaaggtttagtacctttgagcgtttcttctggtaaaaatgtgataataaaagaaaattttgccttggagtgctccccagcctttcaagtaagtgatgatgagcatgagaagatgaacaagatgaaatttaaagtcaaccggagaacccaaaaatcaggaataggtaggttaataaccattatgaaatgataaagttttagaagtgttttgttttttgttttcgttttttacttagccagtgaagtattttctaactggtatttttatggaatttaaaaacaatatataactgagtacatgatccatagaaatagcatgaaggaataaagaaagtttcatactttgggaaataacagtgagagtatcttggacatttacaactataaatggatttggcctttaccacaaacttgtctaataaagaccataggcaaataatttgctttttcatacatctgaaggaaattgaatgttttaaatgtatataataatgaattgtactggtttttattttactgaagacagttgcatgtttcttgagagtgagactctttccccattcaacaacgtatatttaatgtgatcaaacccttctagatattatagaggactgaaaaataaacaataccaaccccctttcctcagattccatgtatgtaacaaacatcatggtgaaatggaataaacgattctttaagcacatgtattatgctaagggatataatggggagtaattttgactagaggaatcttcaaacgcatccttaaataggtagcattttaggccctaaaggataagtaagatttttacctgtagtatttactttttatttttttcccagttattaaaatagtactcattgcaaaaaaatcaaaagtagagagtcagaaaaagggagggggaaaaaatcacctgggagaactttagtccatttaccatgtgcatgcagacccaaatctatggaattttaaatatatatttcttttgccattagaaattttgtaatattaaacattcctataccaattaaaaatttttactgggagcctattatttcaatatatgtgtgtagatccctaaggttttggcgggtaagtcaattccaggtaaaagcacactgaagcaaaagaattacaaaggtttagagttgcaggatttgttagaagactggtgagacattttttatctttgtgctcctcatggtgccttacacagagtgagtgatcaatggcatatatgttgaatgaactgtaatttgtgtgcttccatgaaaagagttgaactaggatgaactttgggagccatatgtgatttcagaatgaaaaagttataggctactttgacagtttgtttcaaatgttagtctctttcctctcaaaattgaatcaagatttaaaatttgctgtggtgatttgcagaccactatatagctcatatctatttgtatctctatatactttttaaaatatttgtgaaaaataatattctttttcaggtgatagaccattacaggacttgtcaaataccagttttgtttcaaataacactgctgaatctgaaaataagtcagaagatctatcttcagaacggacaagcagaagaagaaggtgtactcctttctattttaaagagccaagcctcagagagtaagtatttcaaatgattttagtatgccattataaaatatatccttaaaaaaatttctgcctgaattagtatttgagcacttctgataattcaataaaatgtatattattgatatgtaacaaccacagtatgatttgggtaagagttgaagaaatatgtcctttggacaggctatttttggggggttggagaattgtctggatttaaattgatttgcttttggttagttcccagttctactactgtcatattttaaattgtagcctgatacttataatttttaaaatttgtggcctgtgatttgcaagccatttttgttaccccatttgtttatttcctaccttgttccctagaagtcaaagtggtttatgtgtcctttactctcaaagaataacagtcctttctctttatttttgtaaatttcaaacataccccaacaaagagaatagtgccctcctccaatttatccattcctcaggttcaacagttataacactttgtcgaatttgcttcatgtatcctttttgttgtattttagagtctcaaatattgagtcatttaattcttaaaacacttcgatatatctctctctaaaaagtaagaacttaaagttcttagcaaaactagacaacaatgatcacatctaacaaaaaagaatgattctcatgggtattttaaagcaataaccagcagatggcagtaatataaggcagggtaaaagaaaattaaaagtgaaattaaggaccaaggggccttttttttttcttttttcttttttttttaaacagctattgagagatataattcacacaatttaaactgtacaatttagaccagatgtggtggctcacacctgtaatcccagcactgtgggaggctgaggcaggtggattgcatgaggccaggagttcaagaccagcctggccaacatggtgaaaccccatctctactaaaaatgcaaaaagtagctgggcatggtggcgtgcgcctgtagtcccagctgctcgggaggctgaggcaggagaatcaccttgaattcggaggcagatgttgcagtgagctgagattataccactgcactccaacctgggtgacagcgtgaaactgtctcaaaaaagaaaaaaaaagtatgcaatattctggtttttagtatattcatcaatatgtgcaaccattaccagagtcaattttagaacatttctttacttaaaaagaaaccctgtaccctttagttatcactttcctatcctcccaattctaggcaaccactaatcaacttcttgtctctctagatttccctgttctagacatttcatatgaatggaataatagaatatgtggtctttgcaactggcttctttcacccagcatgttttaaagtttctttcatatcatagcatgtatcagtatttcaattcatttttatgactggataatattccattgtgtagatgtaccacattttgttcatccatttgttctttgatggacaattgggttgttttcatcttttggctattatgaatatgctactatgaacattcttttgcaaggttttgtgtgtaaagtattgtttttttttttttcttggatatatccctaggagtggaattgctgagtctgtttaattgtttgaggaactgccaagctgtttccaaaactgctgtaccattttacatgcttaccaacgatgatgatttttaaaaatttctctttatctttaccaacacttgtttttctatgactgattctagccgtcctagtgggtatgaagtgatattgcatggtggttttgatttgcaatcccctgataactaatgatgttgagcgtcttttcatgtgcttactggccatctgtgtatcttcctggagaaatgcctgttgagatcctttgcccatttttcagttgggtcatttgccttttaatgagttgtaagttaaactttattttgaactaattttagacttatggtaaagttgtaaaaataatacaaaggtttcccctatggtcctctcccagcattccttaattttaatgtcttatgtgcccacagtaaaattatcaaaactaaagaattagcattggtacaatactattaccaaactatagactttcactaacatcactttctgtttcagaattctatctggagtcccacattgcatttagttgttgtttctcctaagcatcctccaacctatgacagttttcagtcttttttttttttttctgccttggacacctttgaagactactggtcagtttattttgtagaatatctctcagtttgggttttctgatattttctcatgattgcaatgcagttgtgcttttttggcaaatatttcacagaaattatatgtccttcttgcctcatttcaaggcttcatcatgtcagtgtgtttcattactagtcatgttagccttgattccttggttaaggtggtgtctgttgggttttttaactgtgaagtcacaatcttttcctctattgttaatgaacatgggagggagatactttgagtctatatattccatttctcaaactttcacccactaattttagcatccattggtggatcttgcctgcaacagtactactgtgggtactactagtagtgatttttgatttctccctttccttctacattaattggaattcatctgtaaggaagagttgtcttttctatagatatagatatagatatagatatagatatatatcgtgggtatctcttttgttctatagatgaaagtccaatgccatcaatatttatcttgttgctcaagttattccaactttgaccactaagagttccttcaggttggcttccgtgtccttttgacatgacttcatactatttggagcactttcttactttctgacacacaggatgttccagtatgtcatagtggcttaatcctagtggcttaagtagcaatctggatgcagcttaattaggtgctctgcttagggtctgacaaagctgcactaaaggtgtcgtccaggctggttctcatctggaggctgtgctggggaagaatctgcttccaagtcacacaggttgttggcagaattcatttccttgtggttctggacagagggcttcatcttcttcttgttgactagaggctgtccttagcttcttgccacacggcctcctttacagcatggccacttacttcaaagccagctgtggagaatctctagagcaagtcctgtagcaggatagagtcttatataacaaaatgtcatctcggaagtgagacatctcatcacctttgccagtggtctccttgtttattgtagaggatctatagtatgttttaatgtctggtagggctagtatcctctcatggtttttctttttcattgtttccctcactgttcttgaatgtttgttgttacaaatgaatcttaggatggtattgacttgtctggctcggtttcataaccttggcactgttgacctttggggctaggtatttctcttttatgggaggctgtcctgtgtattgtaggatgtttagctgtatccctgacctccatccactagatgtcagtagcaccctcacatttataacaaccaaaaatgtctccatatgttgcaaaatttcaactgggaggcaaaagcatcctgagttgaaaaccactggtctataagtatttagttttctttgttgctattatatatggacatgtaactgatgcccaatgttgttcgtatatatgaaagctgttgaattctgtgtcagtttatatcttgttactttctgaactctgttattctcttatctcactgattgtcttgagttctccaggtatagtatgatatcatctgaaaatagagatagttttacttcattaccctgtttgtatgcctcttactgtttttatattagcattggctaataactcaggtacaatgttaaaatagtagcaggaatagtaggcatgcttgccttgttcctgattttagtagaaatgcttctgttgaagtatttttgtctctccattaaacaagatacttgctgtaggattaagatatgtacataatttactaagaaaatgccccttgatgcctattgagtgtttttatcatgaatgattgttgaattttgtcaaaggcttgttcagcatttatgaagatagtaatatacttcatttacttacatgtattaacatggcatctgttgatgagttttccagtaccgaactaaccttgctttcctggaataaatctcacttgatcacggagtatgtttttcataatgtgatgttgaattgagtttgccaaaatattttgtttagaatttttatatcaacattcataactgatgtgagtctatagttacccacctttgaattgtctttatctggcctaggtatcatattaagggaatcaagaaagtcaccatcttggttcctttaatgaaataatttatatttcattataatttatagtgcattataatttatgtttataattatttgtatgttatatacttatataattttagaacagtgggactctctggtttttgtaagtttgttagcatccccctctgaaaccatctggacctagtactgttttgtgtgggatagttccttaataacgttgactgttttttgtgtgtatgaaaattagtctgtttaagcttttttgctgtaatggggtcaatttttgttatttgtatttccacaggaaattatccatttcatctaagatttcaaatttatttgcataaaagtctgcaaagtatcttttatgaattagacatgtaaattaattttaaatcttttttcccataattattttacctatatcatttattattttttgtgtttgttctttttctctttttcttgatcaaattaggtagtagtttatttattaacttttccaaaaaatcagtactttgatttactaattggatctatttttctgttctctacttcactgacttctgcttcatatttattatttccttctttgtgttttctttgatttactttattattgttgttttcccattaaaatttattgtttttattctttcatttatatagataacagtgttttatggacaggcacagtggctcacacctgtaatcccaatactttgggtggctgaggtgagaggatcacttgagcccaagagtcggagaccagcctgggcaacacagggagacgctcactctacaaaaaatttaaaaatcagccaggcacattggcatgtgcttgtagtcccagctgctactagagaggctgaggtgggaggatagtttgggcctggtaggtcaaggctgcagtgagccatgattgtgccactgcacagagaaagatcctgactcaaaaaattaaaaataaaaataagtaaatagaacacacacaaaaaaatttttttttaaagtgtcttttgcaatcaatttttctctgatcagtgctttcaatgtatcttgattctgatacatagtgttttcaatgtcgtttttaagtttctccttttctttaggagttattaggaggttttaaaaattccaggtagatgaacctttctggttttttgtttttatttgtaaatctagttttattgcattttggtcagaaattatttattgtaatatttctgctttatggaaattgccagtattttctttgtgacctactataggatcagcatttataactgtgctgtgattgcttagatgtatattctccataatcaaggtctaaagtttgatatatatccatgagatttactgtatttattatgttgcttagatcttctgtttcttattttttgtaaataagtgatctgttttgtactaaggttatactaagagttgtatattaaaatctactgtgtcctgtgtttccatgtatctcctgtagtttttgcttcagaagggtggttgctctgctttttgctatgtaaatatcatgattattacttattcattttggattatggcctttattatattaaaaatgtcctcatttgtcatgttcagtgctctggactaaagacttaaagtctttaagatataaagactttaaaaacatatttatgagaccttcctgataactcctaccactcctatcttcaatacctatgatgatcattccataatagcaagcagctttaattaggatgtactttcatgggagctactagaagctgtgatatacctagtgtataccatttccaatccaaaaagaaggaagaaaaaaaagtggcaactggatggtcatcactcggaatttatactgaatgttgtggcttttgcttttaaaaattttaccaactaagctgtatagcaaatcatctgcatgcactgtacatttaaactaaaatagaaccttatttccttacagcattttgctgtgttttatttagaataggtacttcttttgaaaggattaattaaactctatctaattacccaaggcagtggtatcacactggctctgaagaggagtacgaaggagtgaaagagacctttccacctaatcttgtatacctttttaaatttgggaccatgtctatgtatttcatctaaaaaccacatttacacacatgcatgtaaaatataactaaactccataacttgaaacatgatgtattaggtgcaggaatctaccctcttactgaaaaaataaaattattgggtaaaatactaaaaaacataccttgaatgcatttcttaactaatgactattagccaaccaacatttcttttagtaggaaagtaagaaaagctcagatcaaagatcaaatgatagcaggaactcagaggggaactgaccttatcctgaagatatttgtctaactaggtgaacctaaacattgcattcacaaccctatggggctagggacagaagacaaatcctagggtttatccaaaataaatagtctaatagatcttcttccataaagttgatctactttctcagtaaaagagcaaactaaaaataacctccccactagcttgctcagccccaggaaataacttgggtgctgaattaaggaggaaaaaaatctttccttagaattcataaccaaaatacagcctttattgcagattatagctggaattcacaatatttcgaaggcaaaaaaaaagttaagctgaggatttagtataattagtgcatgaactatagtgctctgttgtctattagaagcaaatattttgtagggagttgtccatctcacacctcaacatgttttgcacagccaaagttccaaggaaaatgaagggctacctcatagtaaagaaaaacattacatacacaggggaacaaggtatcagcagaaacagcaatcagacacagaatataaaatgtttaatgtttcaataaaggagaggcttgaaaatgaatgaagatgttgagtggaaaaagtcacagaaaaacacctacagtacgattccatttatataaagatatctatcaaacagataaaaccaaacaatatactttgtgggagagcaatacacaaacgcttaaaacaaaactgtaaagaaaggagtgataatagaattcaggatagtggtccctttttgggggaggagagggttgtgatcagaaaggggcatattggaggtgtggtaatattttgtttcttaacctgggtgtaggaacatgagcatttactttgtttttaaatggtatattttcacatgttcttgaacatatgctaaatttctaacaaaaaggaactatgtaataaacatgtaatatataaaatctatgttgattaatttttcttaaatatttgaaatgaattatttgaagtactctgatagtgagaactataagatttaagaaaaattagagtatttcaagtatttaacaaagcttatggtttaaggaaacttcttttctactgatatgatgaaacaattttcttctccatgcttcacagcaaaagcattaattttgggttgttattaatcttcctttttttctactttgcagcaagatgagaagatgaagtgaatttatggattctggtttttctgaattttcaaagcataaggaatcaaaacagaaatatagtatcaagaagatgaaatgcttaatgaaaaggttttttttttgtttctttggcctttcatggagtgttgatttgtccattcttaatgtttattaataggtatatgtgcataaaatagctattttgtaacattaaactttttgagtcattttggtcatcatataacttaccttcctgtttatttaagcttctttttacctagtagcctttaaccaaacaataaccttttaaccaaataaaatgtgttaataaata

SEQ ID NO: 637 - DNA, 90326 bp, Homo sapiens
gaggggcctgtggtggggatcctggggctgtcgggctgagtatgccgtgtgggtggagaggaagcctcggggaaatcgcccaggtgaagggagggcttggtgtggggacttgcactgggcagaggggcagcttccctgagagcagctaagccccaggcacaccgggcatccggacacacaggtcggggaaggataggctgagccggggctcccagcagagacgcctgggtggggcaggaggccgctccaggtgtgagccacagaggaggggagagggacccccacgggagtggaagtggcagagcagctgcagaagtgcagggagcggaaaggtaccagggcagctgctttccgctgcctccggtccgggcagctgcagaaacagcagggggaggagcaacagctgccaaattcgccaactagaggagggagaggcggagcttgggtccctgtagaagccagaggcgcagtctggactgtagtttcccgggagagacgaaagcaggaacgagagcggagcggagcacagtccgccgagcacaagctccagcatcccgtcaggggttgcaggtgtgtgggaggtaagcgtgggtccttcttcggggcgtctgcactgccctggagaaaacgtcttccaataggaattacatcaagacacagctaaaagagtccgcgttgggttaggaaaccggtgcaaaacctctcgggtgaaagatttacatttttcgactttaagggcaaaaaagcaaaaggaagcttgactctgggtataaagggcgtggttagtgtttttggtttgagttgcaccagtaaaactgttctgggagatctgaagattgagaaaaatcctgctaattgaggacgaggtggatgttatctggtggatgttataggtgcgtagcctataaaaagcaaaaattttgctattgatatagaataacttctgaactatttcactaggaaaataactttgcattcttcttcagtgtctaccctttacgttggtttatcagattgtcctgctaccgacctgttatccagggtggttattttgcagtttcctagaattgcaagaaatccgtattaaagaagcaagtgcaggcaggaatagtcaggataggatgggctctgacttaatctatcaaaagtataacttttgccagcaataatgtaaaaatgaattttaatgaatggatagttagctttcttcccagtggctctggaatattggaacaaagacctggattcagcctacaatggaaacatatggtgtacctcactgctgctcgttagtttctcatttgtgtccgataatatgtgtacattttaaaaacgagtacatggaaagctgtgtgggaatcttttctctgggtagagagtatgtgctgaaggactacccttaatatgtgttatgatagtgggttcagtttaaaacacatgtagtgtcataaaataatagtttattctcggtattaaactatatgtgcattcaaagcaacgttaattgtaatacctatggatggaaataagttgtaatgctgggtaaagatgaaagtctcacctacctttgtgtaattatgacaaaattacagccttttatttttagagaagtagtaagaagctattttcctagttcattttcattttgttacagaggttcccagattacatggcttttaatcatagtagcatattgcagcaaattttgctctgaaatgctttcattgtgacagttgcatatttcagagtctgtctcaatactttatgtttttttttaataaccagggtcaataaaatggagtaattgtcttgttttctcctatttctatgctttcctgagttctcgggattttaaattttatttttgtaatgcatcccaaatttctttttgaaaagaaatggctcaaatgaattctcttcccagattaaagttcagtcctactgagtgctactaccgataagcctaagtgacttttcagtgtgtatactcttccctcccacactctcacataccatagaaatatatagacagatagatcatagaaaaacagctgctttttaattacccctaagcaaatcagctaagtatcaaaaacagcaaagagcttagaagaaagaaaaagcaacagtagctgctaaacttaaccactataaggatcaggttttatctttgctacagcactggagaatctattaattcacatagctgatatggccctgtgaaaatgattttgggggtaaaaaaaaaagtgggtattagggtgacacatggaaaagactgtgtttgcccttgttatttgtgattaagtggattgtcttgaatcagtcttagattctttctcagaccctactactaattcattttgtaaaactgaataattgctgtcgctgggttatttcccctatgtaataattataatactaccaatgaaattctttccgagcctttattaaaagatctgtttgaaagagttttattgggaaacagttaataagcaagcaaatggatagaagataaatatctaaacagttgaaattaagatatactttgaatctcagctctttataggtcttctgctctgagacacggtaaaggatagaatctgattaggaatgaatgagtttgtggtattaaagtactgatttttttcacctgtttccaagatttggatcctttttactgtgtcagtaaaagagattgggtttcaatatcatttgaaaaaagaccatgtttttatatgagagaatatcattggaaatatatggcatttattttttaccttgcactcttgattcatgttagttaatattcacattcaatctcaggtaatctgaagatttttcttgattggtgttgaaaacgttcgttatatggcagtttataattctgtgtaaaatgctacccatgttataagcatattacttattttgctctttaattttactatttgtgtatggctatcagtgaatatgtatgatgagaaaggaaaagcaacagagtgcagaatgtctctcttgaatggaaattgctctggggatgattgttctttagccaaaaaccttggttaatttcaaattaccatatcctttggtcttttctttagagttctgattctaagccttttgagtaaaaataagttagcatggatttctttttaacaggaagattcactgatgcatgcagcacaaaagagcaagacttaaaggttcaagatcaaatggttttggtaaagaaggatacaggggaatagatataaagaaaactacttgagaaacacacctttagcaaaagagaaaaaagattttatattttttgttaaattcctataatccatgattccatgaccttttctcccccagtcattaatttgtagaggcctgtattcatactgggatacattacttttctaagtaaaattgaatattcaaaatccaatgaataccagtctgattccagttaaaatggcaatttttactggaataaattttggatgattaaccttccttttttatgcttttataacccataaatattcaaaatctaatgaataccagtctgattccagtcaattgccattttaactggaatcaaactggtattcattagattttgaatattcatggattattaaccataaaaatcctacctgtatacactaacttctaagtgaaacattatttggacaaaatatcaaaaagtaaatacctaaactgatgttttgcccctttaaaataataaaggtacttgaaccagacactaagatgagcaagagcccatttatttaattaagcaaattccaaaggttaaacactgcttttgggatcagaattaacgtacacaaataagggagagatttttttgttgtttcttttttttttttttttttaaatcttaaacctgtaagaatttagtctttaaaatttggaaggtgtgttttaagtaactacgttattaactcttagagaccatgtacttcttttctatctcctgttagtcctgagcactttatgtcatattcagcataaagaaattgagtaaccagttactgaattagaaccattggacattggacaatacttctgtaatgcacacattgagacagtttgcgctttgatagacagagtcagctgacctcacagaatgattgcttacacattagtccttctgagaatgtctttatgctagtttgcctttgcaaaagtgttgattgagcacaattggattcacactgtgtgcgctgcaaatacattacagatttgagtgccagcatttctaaattcatctcagagataggatatataggcgagggtaaaggagtctgcaactggtggcacttaaggtcttaatttcacagacagaaaaacccagggctcaaccaccatttaacctcaaggccctggagttatacctttgttgaagcttatctgtagaaaccatatttcattctataaaaactgaatttgctcttctgtttttctaattatttcttccaaaaaaaaaatagactgattttgtttaagcatgtgtggagttggtcattagttgttttttgcatttgacctagaaacaaattaatctgattggtgttagaattaagaatctaatgtaatttttacttcattatgataagacctatacaattctagttaattgtatatagttttttagtagtaaaattaattgtagcacatatttaactatcttctgtttacttttaccttcatgttgatttatataaattggcttgcttagaactgataattaacctgcctttttctttttttttttgccgcctttttttttttctgagacagggtctgactctgtcgcccaggctggaatgcagtgacctgatcatagttcactgtaaccttgaactcctgggctcaagcactcctcacaccgcagactccccagtagctaagactacaggcaagaaccaccatgctcagctaattttaactttttatagagataagggtctcactgtgttgcccaggttggtccaaactcctgacctcaaacaattctctcaccttggtctcccaaagaattgggattacaggtgtgaaccaccatgccttgctgatattattcttaatgattagcactgtgccttgtgtagagtaaacttagttcatactatctttctcaccagatacttagtatctttagagctaactctgagtttcattgacgtttgtattcattttgagaatccttttacatagttcatacttggtaagtagtaacaatttggataactatttggtaatctataatgaaacatcattttgcaaacaaatacaactagaaaaatgactttttcttagacatctgtgttagtaccaaattcagccctctgccaacaacggttgcttatattacagctaaatataaatattgctatcttgttggatttctaaatgagtagaacaaattttgttattaactgcaaacttgcgcgcgcgcttgtgtgcgtgtgtgtgtgcgtgcatgggcgcatgcttcagacatgaatttattcattagatgctatttggggtttatgtggtccttttctctccttgcctctagaactctgctgatttaaagatgtgcttttatgtaatacctcccctcccctacacgatttccattacttttttcttaacaaatagagaaaaataaatagatgaatgtaatatgaggccttaactaaagtttaactggctgtaaatgttccattttcagtgaaaaggctgcattgagagaccttagtaaagcttacattgtacctgaattatacaggtatttgtcatctctgagccatcatgaagaacgaatgagttttgagacttggcattgacagtgctcagtgttggtcttctgtgtatagcttggtggtggaagcttacagggtaccttcagtttcagccactgctttgaggcccccttctggttctgcctgggaaaggagacttctgagctcctcacagctcttaatgtgggaaggaaaacagatgaaatgtttttcatttaataaccttattttgttaaactgtattgtttttcccaggtatatctcacaccaggattcccagtaagagtagctcaaatgtcacacagtgatttctatagcacagccaggcaattcaatgagtacctatcaacttgtagtccactcctagcatcttggcttttcttgaacagaccccaaagagcccactaaaacatttctgatattttacccacattggattgcttctgtcattttcttgataacctagattttgttgctttgaggtcttttaaccagctctaacttgaagagctagctaattttattgtttttatacccgttagtagtatgctagagataccatattgtggtgtataatttttgcctttacttgaattaaatcagttattggagcatttaattgttgtgtacttcacgaagcaatttagaatcattgaagcaattagtgtttttgagatatattcaaccttccagttaagaaacctgtacctagtctcctaaattgcttacagatgttaaatcccttattcaatgtctgtggcaggttaaatagtatcttatatcttatgtcctttgacatacaataccagatgaaattatataataccagtaatgtcatagaataatttttggctttggtaaattacgaaacttttaaaaaaattatattatgagattttgtgcacaaggtatattaactaaatctaaggcaacaaagtttgtttttgtatttcagagtttctgatatgttcttttaaaaatgcaaataactagttatctagataagaagaaaaagccttaaaatttaaaaaataaataaggaaaaaaatttaaaatgccaataactttaaaggtgtaaataatagctatttgttaatataatagcagatttaattaataattagtaatataaaattgaacattttgaaaaggagagaaagaaatcttatccaggattatcttaaaagcaaatttttcctcacattgcatggcccaaaagtgattaacaatttaaaaaataattgtaaagtacagatcaactagaaacgctttcagctacaagttttatgcacaatgagataaaacaatagggatttatttttccagaacaagaagtctgaggagagtagttgtttgctttttgtttacaggctcgatgttgtcagaattttgtccttgtgatttctcttgtgcttgctgtaagacagatgcctctgttgatccagatatcacactgtcattcaaagaaggaagaatgagaaacagttgttcctgttgagtctttctcttttaatcaggaaataaaagctttcccaaagatccccggcagatgtccactgtgcactaactggctcatgtcatatggctgccctagctttaatggaagtggagatatcaaagacttttggcttctgtggtagatggagcaggggaacaaaggtttgagaatgacttttggataactgtcagtagtttcagccatagtctgatgactaaaaccatgtttattttaaattttatttcttctcattgttatcaattttgtgccgttttgtgtgtgtgtgtgtgtgtgtgtgtgtgtgtgtgtgtgtgtagaagtttagcaactctaaccttcccataccaagtgttcacttcagtgatttccaaattttaagtccctgagcaaaggcattcctcagaaactgatggtatctccagttaaaaggccatctagctaatattgcatctaatatttttcctatactttgcattacaaacacttttcgtaaaacttgatggttctataataaatctgctttaaatctaaaaatattcagtaatctctccatatagactgcattaaaaaatatgggtataatacaaatacaagaaaaattgagtattaggatttcttttatgaagattttcttagctgcctgaaaaagcaaaataagccattattccctagaggagagcctactctaaaaatttattaccctagaaaatggtgttattatccatttcaaaaatgtgaaaaatatgaacatctatagagtgattattacctaaattatgactcattcatacagtgacactttgatactcatggttttggtgaattatgattccttgaggtaggaaagtctgagaagaaaattgaaattgagaaaatgtaaataagtacattaatttttttctctgcctataaaactctcataatcaaagatactgacttggcaaaattgtagttgtctttgcatttctatatcaacatttttactgcctgatttttacatttctatcatgttaccctaggtgaatggctttatcgggataaagctttccagataagagtcacgtgtaaatttctaaactcttctacaaacaatctctagtgtgagtttggattctataggggaatataacaaaatatataaaattactgtctggcataatcttttgtcaatatagttaataaaagaaggcattggaagacacatttacattacaacaaggatatatgacttaaggctatgatattacagcagttactattgtagaaagccagaaggagaagaaattggtctatgtggtaatcaggaaaggctttaaggaagaattagggcagctggtatgttggttaattgcaggggatggcaagctagggcctacagtcacactaccttgttttataaataaagttttattgtaacacaaccatgcccattcatttacatcttattaaggctgccttctcggtacaacagcagagttgagtcattgcaatgaagacgtgaaccacaagactaaagtatttcctatctggcccttttaaaaaaatttgtcaaacactggttaagaatgtcagctctacagtcagacaaaactgagttcaaatttttgttccataatcattagctatatgatattcagtatgttacttaatctctctaaactttggttttgtgatatgtaactttactcaaaggttgtttatgttgacataatgagattttacacagagtgcattacacagtaactggcgtgtagtaaatgctcattaaatgttattttattaaacgttaggttttattttatgataatttattttgtaagtgaactataactttttttactcaaatagggatttgaagctctcattttaactcctcttcaaactgctaaaataatgttcaggacactaggaagggtatcatctaattgtgagaaatttagaagagttgcacagaatattgtactaggacagtaagattaagagccaaatgacctaagtgtatggaaaaagtaatgctacactttaaaatatagttaatattttaactatattgttattttttatatatataactatatttaaatattttatatttatatataaatatatataaatataaaaatatatatataaatatatatataaacatatataaatatatataaaatatatataaatatataaatatatatattatatataactatatttatatattaaatatatattatatataactatggttatatatatatataatatataaatatagttatatatataatatatatattatatataactatagttatatatatatataaatatatatatatcaactgaatagcttattgagtattgaagggtgccaagccagtcagttttttataagttaagatactttctcagaatttagaagaaaattatatttaagggtaggggaacctaatatagtaaagaggagacatcactaccaatcttacataaataaaagtattgttggagaacactatgaacaattgtatggcaaaagattagataacctagatgaagtgaacaaattgctagaaagacacaaactactgagaccaacttaagaaatagaaaattcaaatatagactcaaaaatgctcaacaaaatactagcaaccaaatctggcaacaaaagaattatataccatgatccagtaagttttattccaggaataaaggttggtttaacatgaaaatcaattagcattacatactatatcaatgaaataaaagacacataattatctcaattgaagaagaaaaatatttggcaaaacacactttcatgataaaaacatttaacaaactaggagtaaaaagaaacttcctccacggggtaagtacatctacagaaaacataaataatttttttaaaaaacatagctaacatttggtagtgaaagtctgaatatttccctttaagatcaggaataagtcaaggatgtcagctctcacacttttattcaacactgtattgaaggttctagccagggaaattaggcaagaaaaataaaaagctcccatactagaaaggaagaaataaatttctattcacatatgaattggtcttgtatatagaaaatcctaaagaatccacatgaaaaactattagaactaataaacaggttcaccaaggttgcaggatagaagatcgatataaagaaactaattgtatttttatacactaacagtgaatatccaaaatcaaaattttaagatccacttaaaacagcataaaaaggaaataaaataccaaggaatgaatttaacaaaaatgcaagaattttacaacaaaaacaccaaatgatgtacaaaacatcacaaagaaattaaagaagacctaagtaaattgaaaagtatctcatgttcatgagttgaaagacttaatattgttgggatggcagtattctccaaattaatatgcagatttaatgaatcaaaatgtcagccactttttttgcagcaattgacaagttgaacttaggactcacatagaaatgcaaggaacccagatgtatgtgtcagtggaacagaattcagagtcaggaaataattctttacattttcagtcaattgattttcaacagggtgctgagacagtttaatggggaaggatatttaacacatgataccgaggcaactggatatctacatggaaaaaaataaaattgggctctacctcacaccatatacagaagtgttacttaaaatggattacaggcctaaatgtaagagctataactataaaacttaaaacaggagtaaattattaccatgcattatacagtagtttcttagatatgacaccaaaagtacaagagacataataaaaacaaattggacttcatcaaacttaaaacttttgtgtttcaaaggacacgagttgaaaagataagccatataatgggagaaaatatttgcaaatcaggcatttgagaagaaccttatatgcagagctcataaataacttataattcaacaatttaaaacaatgcaattaaaagtaggcaaaggatatgaatagacatttcttcctccaaacaagatgtaaaaatccaggaagcatatgaataaatacagagcattattagacactagggaaatgcaaatcaaaaccacagtgagctactacttcacacaaactaggatgactaaagtcaaagagacagacacctgtaacaataaaaagtactggtgaggatgtgggaatatttgaaccctcataatattttttgaaactcataaggttttggtgagattgtaaatgatgctgtcactttggaaaacagtttagccattcttcaaaatattagccacagagttagcctatgacccagcagttccactgtaggtatatgccgaaaagagttgaaaaaatgtttgtctacacaaaaacatccacaggtgttcataacagcattattcataaaagtggaaacaatccaatgtttgtcagttaatgaatggataaacacaatgttgtatagccatccagtggaatattatttgacgattaaaaggaatgaggtactgatactacagcatggatggcccttgaaagcatattaagcaaaaacaccaaacacagcaggccacattttatgtgaaatatctagaataggcaaatccataaagacacaaagtagattactagtaagggacaaaggggaataggaagtgactgcaaatagttatggggtttctttctggggtgatgaaatggtctaaaattagatcttggtgatggctgcacagcttgatgaacttcttaaaaaccactagattggccgggcacggtggctcaagcctgtaatcccagcactttgggaggccgaggcaggcggatcacgaggtcaggagatcgaaaccatcctggctaacacggtgaaactctgtttctactgaaaatacagaaaattagctgggcgtggcagcgggcgcctgtggttccagctactcgagaggctgaggcaggagaatggcgtgaacccgggaggcggaacttgcagtgagccgagatcttgccactgcactccagcctgggcgacagagcgagactacgtctcaaaacaacaacaacaacaacaaaacactagattatacaccttaaaagggtacattttatgatatgcgaactatattttaataaacctgctttttaagtgaatataatatttaaaacttttaaaaataggagttatggaagatagaattatgaggaacccagactagcagataaaaagtaatgtagaataaaaaattcattctacatcacttggcctcacagaacaccatgaaaaattagtgaagagaaactaagacctacccacactttgttaaagtttttttgtgttttgttgttttttttttaatttcaaaatgaaggcaaggaaaaagcctaagcaactttaagcagataaaaataaaggaggcggaaatatcagcttatcttaatacttctttatatcttatttttcactcagaaaatataatacttaggaacaaaaaagtgtgatcaaaacaaaaagaaaaaactagaactttaagatagaatgacaaatactaaacaaatatattgcagttatcaacagctttagtccattagtgaaacacaaaatccatcatactggatagaaaaaaaaagtcaaactatttaatatttaaaagacaggaagttaagcaaaagaatactagtttaaagtaaaaggatgatgaagcaataaatagacaaaaataagttttaaaatgtaaggcagctatatttgtataagacaaggcagaattcgaggcaaaacctttaaggtcaaggaaggtaatttatattgataaaggtgtaatgcatagtgaagactgaatagccatgagcctatttatgtcagtcacatagaactaacgtcgctaaaccagtctgaaaaagaactgtaaacatggcctttggtgccagatcttgattcaagagggaaaaagtaaatagtcatgcaacattaaaaataaggaagggataaaaatggactttggaagaaatggagatgacaacgtctcagaggtggtagcattgatgatgcggatttgagggaatttgagtatgaaatcaactagttttgtccctgaattagctcagggattacaaaataggtcagcagtcagcacacaggtaagacagagtgtgttactctgtgtgtgtgtgtgtgtgtgtgtgtgtgtgtgtgtgtgtgttaactgtatctaaataccagttctccacaatgagtaccatgctctgttgtcttacactgagctctttttggtcattttcccagcctccctggcctctgtaggcatttgggtttgttaccactagtttgggatacgggagaaactgatgaagaggagtaagttttgagtcaagcagcaggaaaagaaagaataattgtaataattcaaaatgtaaccgttgtaaatgagctgaaaacgtaaagcatttaaatctttacaaggattatatttatgtacattcagtttgcttcatgttattaaaaattactcactgagatattgatatatcactattttgaaattatccccttgcttttatgattaaggaagtcaactttcattaaaatactgaatctcatttcctctcttctgtgtcttaaatttttgtttgtgtttttttgctctagtttactctcatacaatgttccttttatgtcttaccttaccctaatgggaacattttattttttggtttgactccttctcaacatccacaaaacatatgaagacatctatgctttttaccatcattaaaacataatgttcagctagctgcctggcatgaataatccatcactgaggaccattaaccatacatgacaagctacagtacagtaattgctatctttatacaagacaattgtgactataaggctgatgacttaaaaccataaacccagtctcactttaaatctaatagtgcaccaactgatattttaagtagtgttctcttttcttctttttagaatgacttataaatgagaaactttaacaggaatatctcatttattaaaaggatccagaatttccactgtaacacaccttagaatgcaggaaataagcttacaaacccagccaaattccttgctgtgaaattcaccttatttatccattagcctttatgcagaacctgtttactgttaataaactgtttaatttactattgaatgctgtttatatgtttagacaaattaacagtgactcaatataaacaaaagatgagaggggaaaaaagctaagaaactaagaaagcataggtgccggaagggttcatgtcttgacctcagagaagtgcagagacataagctgtggggcagtatgtagtgctcagtagatactggctgggtgaatgaaggacagagccagaaagttttaaaaaatgaccttcaggcataagaaagaggattaattgttacatttccacttttctggaaaaactaagtgaattatatattttgttaaagtttcatgcaaatgggtaaaataaaaataaatttcggtgcttaaaaagtaaattcacagctattgataaaacacccagccgggatgacttattttcagagaaattaaagaaaccaaagctttgcttttttttctggatgtcactacatgtatatgttacccaaatatctaaaatgacagcactgaaatgtctgtttcagaaatgtgcatatgaaatgattaattacacattatgtaacatatcttcttcccaggttgaatttagcaagctctatgagaaatattttttcagccatgcagtgtagcttgggaaagtaagaacaagatgactgcacatagaaattaatgaaatagaaaaggcaacatggagcaatgggtttgccatcacgtgttcgtgatgcttatttgtgtatcatgtgaaggctattattagtatgtgaagagaaagtgaaaggtttacaggaggcagtgggtgttgtctagaaggaaatccagaactgcttcactgtttctgagactgaactttttactgtgacctaagcactaatatctttacatccatacattatcacccttaatttttatgacaatcgtatgagacaagtactatcataattctcatttcatagatgaggaaagtggggcatagaaaatcatataggttatttcaggtatcaccacacagtacctagtttgcatttgtttccagccaaaacatagttctgcaatataattatgatctcagaagtaaccagaatactttgtgtatttctatggaattgtccatatttacttcacagtatttgtatattgtaccttgcattcttcaactatgaattctcttgcattcttaaaaaattagacagctgcaattacatatctaaaccctataaaaataataaaatcaatatataaaaactctaacttcagacaaaaactagagaatgtttcatgataatattaaaaaaagaatagaaaatccacggcaagcttactttaaattaggcatttcaaactggcagtttgacagactgaaatctttctgtctcacctcctgccagctaaattatgttttgcagagtttattatgttaggaaaaaaaagattttctttaggtaaggaatatcctcttcagttaccgcagactcctctattctccattatactggaccaattcacacatttatattatctgctaagaaactgcagacttctgagtttgtcagaactttcaatcatgagcaccttggtaaatttaaaatatgctattgaattattaacatagtttttggaatatgtctacttgataaaatgaggtagccctgtaattacacaaagtaagtcaaactgtatcagaatagtttttcaaagcttagtctctataagcaaagattaaattattaagcagtcaaccgtatctgttaacttcctttaaatgttttctccacatggaaaggaataggaaataagagatttttcttaagccagatgaaaaatttgagatgtgttaaattactccgctaaatatatagatttatcagagaatagtgttgaggttatcgacacaaatggtgatgggttgtcaatggcattttcaggctgtcaactcaactgtcaggatgaaactaattggtacatcatatgcagcgttatgtatgatttgttctaatatcttttccagtacggtatctagtatctttttcatgtacgataataaagcctccaatattagtgattctccttcatgtgtgaagtgacattttaaaactgtatactgtcccacaatataaatggattttgtttcaaattgtgttgtatgaaattaaactttgtgaaattgccaacatttgactatttttgacctaccaaaaaaaggtaatttatatggttcaacctaatacaatagttatgccaaatggggaaaatgtttttcaagagaaactgaaatacaggtttgttttgagattagtaataaacatgcattgtgttcctgctttctgccagaccctgagctctcaaggaaggtcattttctctcttcatcctcctaagtcttgcatgtgtttgggtttcccagagcttggccatagggcacctcttctccacactccccaaaaactctaatccaaatgtgctcataactcctaaatgtatctctaacccagacctacactctgaactctgaccttatttatctaactactttcttaactctccaagtggatgtctcatgggcacctcagatttacctatccaaagcaaaattcatgatcccctatctcacccctctctgcttttgttccagccttctccatcttaatgaaggacagctccacctacctacccagctggctgagtttaaacctgggagtaatcctgactcgcccttccttactgttacctctgtcttgtccaatttattttttaaataagtctatccataatctaactatcccttttctatcttcattgcaacccccatagtcaactatcttctctcacctggattgttacaataaccacccaatttcttcttcagcttctgcttgagactccccatactctctcctgtataactttataaattatactgtgtttaggagaaaatgcaacatccttgctgcttacaagggcctagataacctagcccctacctcataagccagcctcttcttttcctttgttcattgtattatttcagttctttaatcacagagctcttttctgccatcaggccttcatattattccctctgtctggaatactgcttccctccttaactcttatttatcctcatgtctcaacttaaataacacttgcttagagaggccttccctgattctctccttaatctaaaataggtccctgttattcttttatgtgacacactattactttttattcattgcacttaacacagttttcaactaggtgctttaatgcatgtgtgttcgtttaatgtaagctctgtgaaggcagagcccttgtctgctgctttcacctccatgtccagggcccagtacacagtggatgctctctgcttgaaatgaaaagtatagtctatattggatgtcgatgcttgaggaaagccagatgttcagaggaggatgtgaggggcttttggaaatgtggtatggtttcaaatcccatctttgttttgggtgacttttctgagcccctagattgtaagctttctcaaagcagttattttgtctattttgtgtagagggcactgctctattcccagtgcccagaaaagtgcttgataattagggatgttcaataaatatttgttgagtaaatgaactgtttcctctttcacaaagttcctttctcatgaaactataagggtggtaaataaagaaaatataggaagcatctaatgtatagcaggtactcaataatgccagaaaccctagtgggtttttcaaaacataattctcacattttttacaagagtgattctcagaggccttgggaccctatgaagattgggggtggggagcagtgaggtgggtatcttaaacttacccctgtggccttttttcaaactacctaaacttatacttcatgtccagtgcctactacagactggctatttttcatgaagaatatatcatattcctcaggtgtgctaaagcaaagattaaggaaaatatgtctaaatcttgcctagaaccaatgtcacaagaataatagctaataaaggagaactgtatatcagaagactatcagtgttgttaggctaaagaatgtatattaaaaaaggaactgtgaaataattatatagtgatgctactgtctctcttctggtaagaaatatcagaatgtgtgcttgatagagtgtctctctggatatattaccttggattcaattttaaaggcatttgctagcccttaatgttttttaaaagggggagaggagtagatttcttattctccaaaatcatgtattaaccttacttcaagctgctttttcaagggaaatatttatactcccagtaactggttggaagagatgcagttatgccacatttacctttgttttatccagtttaagaatttgtgagctctgtattcatttttatactggttaattaggcatgaaatccaggagggataaaggaataaaggtcagaatcaccacaggctgtcacaaatcccagaaataggggaagtgaaaattcaccaaccaattgaaccacacattacacacagctagaccctgggctacagagatgcatcttcagcaactggaatagatgaaagtgtctcttaaagccctccattgatctataattgtaaaatgtttacaagcattttgattgtatacaacaaaaataagcaactttaagtgtcctacttctgtggcacatacattttcataatttacagattctattatctgtgctttctttagtatatgtacactgttcaaatttgaatattctaaatgtcaacaaagaataacattaatgtttatgacttggccataaggaaatccacagtgcaaaatctgaattttcacgtccttggaacatactggaagtgtcactaatcagataaatccactagaagaaaaacttctgttagaggtataatccagaagggaagttgattgaatacaactgcattatttggttatagcagaactgccacactataggatttccagattcatccaggtaaatcctttcattttcttccacttcaggagttctcaatctttgctggtctgcgtgtccaccatggagttcaggttcaagctatttttgtccatgtcctacccaaccctgagtaggtgcttgcttcttggatccctgctagcactttttcattccctattaactgaccacctagttggcctcctcttccttctttctttctttcctgctgttcacagatatctttgatagctccttcctgcagcctcatgcagctcaatgaactgttctgctgtctgatcaaaacattcattcaacaaatcccattccttcttgacttttattccagtctttcaacaatcctaccaggttactgggccatagctctcattgtaagcattaagatataactccacaactacatttttttaagtttagctgtatgggaaagaatcatgcatattaatccatgacctatttcaggatggtagtttggaagcacttcctaattaagaaactctgaaagaaagcacatggcattatcacgatcactccaaatggacctccttttaaagtcatttcagatttcaccagcagtgcacattcactcctgatttggagtaggcaagtgaccaaggatactggtagattcaatattttaaaaggaacttactggtaaaaataagttcttgtttcaaggaaatagatgatggtcttatagtacttcaaaagggcccattaagatagagctatactttgtaaaaatatttgttattttaggttaagcaattcagagagaggaaaccataagaaggctgtggttggtactggaaccttgtaaaatgaagatcaaaatcactgactgttcatacttgaaattacaataaatgtaaaatgtgaccttggtattatggcatagtcttttaaaaatgtctttgttttcatttgtttttcactttcttctgtaatctctcagattctggtactactgaaatagtttagctttgtaaacctaaagcctatattattagctattaaaacaagtaggtgttgctgatttttttttttttttttttttggctgtggtccgtcctgcagaccccagctgcatgacggatgaataacgtactcagacactgatattcagtgaaagagttggctaggggaccaggccgctgactgaaagagatgtagcagccatgaccctgactagctggctcctccgacatttattcagcacacattaaatgacaaaggctttgagtcagcaccactagaggctaattaacctggtcactctccccaccccctgacccctgcccccaaccccagagagccatcctgcccacgaatgatcaaaggttagttttaggaccacatgagtaaacaagttatttagataaactcctctacattcctaggtatccatgccctatgcttttaagataattcagctgctttcagtcaaacactttactgaagctatgtaaacccccaggccttccaagaagttttgtgtttatttcccataattttacaatttctcccaccatcctgacccaacccccacattttttgagacaatgtctcactctgcttgcccaggctagagtacagtggtgtgatctcagctcactgcagccttgacctcccaggctcaggtcatcctcccatctcagcctcccaagtagctgggactacaggcatgcaccaccacattcatctttgtttttgtttttgtttttgttttttagtagagatagagtttcaccatgttactcaggctggtcttgaactcccctactcaagtgatccacccacctcagcctcccaaagtgctggaattacaggcataagccgcaacacccagccctaaaattgcttttgtaattaaacttccaaataaacatgtctagccattagttaaaagataagtcatctttttttttgaaaaatatatataagcatatgccccttgtaatgactatggcagtcatgccataaaagcaatttctagtccaccactgcagttatttagattagctatttgatttccattaatccaaagaagaccagaacatctaagtatctacaatatgcaaccaactttctgcttcagactttataaataatgtattctgcgtctcagctgactcttcgttatgtcacaagtctaagccaccatgtaaaaaatagacttagtgactctatgtaaatgaggttttctgcctgtagggaatcaattctgtgaaattcagtgagtaataaaacagctacaaaggatttattaaagagagaaaagtgcatctattactgattaggatatttttagggaaaggcacattgaacagcaacctttaaataatcaagttagttaatcacagtatcaaatgactttagtgctggaaggaatctgaaagatcaaagaccaaccctcctgttttactgatgaagcctagagctttttctaagaccagcttttgaaaggacctcacactaaactgcaaggtcactgaaggcagtgtataatggttgcttatatccgtggtgtttgtgcagtgcttgggatgtattaaacactgaaaatacgaatttgcatgatgaattaataaatgattttataaacaaacatgagtaaaggaattaatatgatctccttggtgttacataggaatttctgttatacaaatcataatgaacgttaatgttacctgttttcaaaaagtattctcgtttttaaaggagcctcaattagtgagatctctctctctctcacacacacacacacacacacaaaatatatattacactattagatatagtcattgaacttgtaatcatactccgtgttggcctctgtatattcaaatgaaccagggatataaatgttcctaactgtggctgggtgtggtggctcatgcctataatcctagcacttcgggaggttgaggcaggcagatcacttgagttcaggggtttgagaccagcctgactaacatggcaaaatcccatctctaatacaaatacaaaaattagctgagcttggtggcctgcgcctgtaatcccagctactcgggaggctgaggcagaagaatcacttgaacccaggaggcggagattgcagtgagccgagatcacgccactacactccagctggggcaacaaagtgagactccatctcaaaaaataaagaaaaatataaatgttcctaaatgttcttcttgacaattgtcagaaaaccaaatctccagccagagtataaatgtcaggggtattcagcattctgatttatgtaacacaaatccctatgcaacagacaggaagtaatattaattcctttacacggattcatattttgaatgtctccgtatctttctaagtcttttgtcttcattctggacctgcaggtgtgtggatccggtgccctgtgtcccctgataccccacacattttttcttgtctaagcttacattttaatcaagctacatttttaaagaggtatttctttggatggattgatttttaacaagacattgatctatgtgagttggaccatctaaaaagtccataacaaatctgggacaatttgaaaaataagtaatgatagcaatgtattatagcccgtagaataaaataaatacctatgagtctctactgacacaaaaaataatttcgatacataagtaaatgggagcaaagggacagctatttcttatagtagaattccaattgatgaatgtagaaagaatgatggaaatagaaaaatcacagtgtgtcaaatatggcattaatcattgttgcagataatcattaacagattaaaattagtgttcaaagatatgatgagtaacaggatatttgtataaccttaaagtatccaaccacatgacactttttcacagattggaggagactaaggacatgtggcaactcaatgcaatatgggatcctagataaaatccagggtcagaaaaagatcattattgaaaaaatttaaacgaggtctatagattactcaataacattgtatcagtgttaatttcctggttttgatgattatgcattagctataagtgagatattaacatttagagaaactgaatgaaggatatatgggaactctactttttttcaacttctttgtaagtctaaatttatttcaaaattaaaatttaaaatgttttaaaaataaatacaaaggttataacactctcttatatttgagtggctctttataaaagaagcttaagagatacagatgtttttatgatccacattagacacaggaaatagattccagttgtttcagtgacttgcccaaggccactcattatagagccaggtgttctgttagattccattttcctctctacagaaactgctgggctttactatttcattctcataactactttacaaagacagagaaggcatattgttcccattttatagactttgagttccagagatttctcaaagacctaaaaatagaactatcattttacccacaatctgactacagatttttttttactacccaaaggaaaataaatcattttatcaaaaagacaccttactcatatgtttatcacagcactattcataatagcaaagtcatggaatgaacctaagtgtccatcaacattggataaagaaaatgtggtatatatatatatatatatatgcgccatgcagtactatgcagccataaaaaagaatgaaatcatatacttcgtagcaacatggatgtagccagaggcctaatattatcctaattaaaataactcaaaaaatcagataccaaatattctcacttataagtcagagctaaacactgggtgcacatggatataaagatggaaataatagacactggggactccaaaactggggaaggtgaaagggggtgagtgttgaaaagctacctgttggatacaatgttcactatttgggtgatattttcactagaagccaaaaactcagcatcacacaatatgtccatgtaacctccacatgtactccctgaaactaaaataaaaataaatgaagtaatgaatgagactgagttccagctaaagtaaaaaaaagccataaataacacagattagtgagtagatagaagtccaagttttctcactcttaatccagttttgtttttattcatattctgacaggtatttctgtagcattccaagagacagacatttctgtagtcaagacactgcatatatgtatgtacgtatgtatatatgccacgtgtccttagtttccaatctgtgaaaaagtgtcatgtggttggatactttaaggttatacaaatatcctgtttctcatcatacctttgaacacgtgtacatatatgaaaatagatatgacttgttgggggtcatcttcaatgagatgagctttgaaagaagattaaaagttggccaggtgaaaggaattaggaatatcattctaagtaggaatggtgcttaaaattctgcttctggcaaacttaaattagttatgatgtctcatcaattcctctgggttatcaactagatgttaccatagttgcaatggttctggtaaaagaagtgcctgctgccagctggataactaatttcaaatatatatatatatatatattcctgactggcttgggaactgtgagatcatatgctgttctggcaccagggcagcagcataaggcatctgatcagagaatacatataacctccaatcctctgatactatgtctctgggttgaacatgcagcctcagctttaattggtgagctggtgacaagaatttcctcagttctggaagcctggctccaaattgtgtgtgtgtgtgtgtgtgtgtgtgtgtgtgtgtgtgtgtgtgtgtgtcttaactgtgttacagcacttaacctgtttaaacgctatgggttgtttaagtggaacatctctctggatttatctaatctggccaaagattacgcaattcagattacctgaacttgtcctttccttcattggtttcaaacgtgttcagattagcctacaaagaggataagttcaacaagggagatgtaaggcattaacatttaagatcaattcatcacacagttctgaaaataacagtgtaaaggcaagttcaggcagagttaaaccaaatgattattttctgcagggtgggtagttttggatcttgagcttgtgtcattgttttggtgacatgcggaatttatgcatctgtatttgaacaagatttaacactagtacaacagctgttccttagaacaaatgaactctttgcttatataagaacctttaacctaacctagagagggagaaaacagtgcctcatatggtttactcacgtgtgatcttttgccccaagcctgccttcagactttcgaacaatagacttaatacatttgggattgcaggtgtttttataagtgtatccattgcaagactagccactgggttgcaacagctttgaggcttgaagaacccaaataaaaagatgaaaagtttggtgatagaaattttagtttgttaaactattcattgtccccaggttaaaaactttatgggcctctatttaatggctgatgcctttgcccagattctctgttaataaaactaaattcccaattgtaacaatttctaattgtatcatcaaatgtagtagcataaaaactttaagccatgtttgccttaaagatttgattgatgtggtggggtggaggactagtgagtaatacctttattatctgacttgtgtaggctcattctaccttaacccaccctccaaccattgtatagtctactcatgtcctaattccataagacattagagtaatttctgttgcataaatgatagctttcattgcttataaaatgtgcttcaatacactcaataatgtcttcttcaaacttatattgcattgattacatctggcagccccatatggtaaaacgtagttatgacccttctaattaaattatagttagaaactcacttctggggtgcagctcagcaatctaccaaatttctcagtgacattcagaacatgaaataacttggggagaataaatttgcaacacaaatgggaacagaggagaaggttttcaatctctatttatttttcaaaattcattacttgtacaatttattttccaaactaattctaagcaaagatgagtaatactaccttggcaggagtctgtgcttaagatatttccatatgtttaagcagaaatacctagtatggtactttccctataagtagaatgccatgaaaaacgttcttaagacaggttctccagcacctccttccacccttggtctcgatgaaggaccccatgtcctatttcacagagaaaagggaaaccttcagaaaacttccacactcactaccacttgtttccacccaaaagcatctgtacccatgtactttaccttttctcctgtttctatagatacgttgtcggtgcttctctataaggtcaatgcctctgcttgtgttctagacttcattccctctcctctcctcatgataccactcctgcagtgcccttctcctccaaataatcaacttccccctcccctagatcattacccctaggaaacaaacgtgctgttttttctcctgtcttaaacaaactagaaaacgaagaaaactctttcttgactactcccttctccacccagctactgttcttcaagagttttctttgctcagtttctaaatttttgttccccattcttccttaactcagtctaatgaggctttcagtttcactctccacctcagcctccccattccacctgtattggcttcttgctgatctgtggattaaccagactcattcctcagcatttgcacttgctaatccctggcttctgaccctagatatccagagtttagcttcttcaccttcctccttgaaacctttgttcaaaaatcacctattcagtgaagcttcctaatctttttatttaaaattgcgatactccctctcacctccttactttcttatcccctttcactgaggttttttttttccaggatatttatcacattctaatattctacatgacttattttctaaataaaattccttacagaggtttttgaagacttgaatgtttaacaggcaaagtagatagaagcctcctttacgaacaaattgaatgcccggtgacattcaattcaaggaggggatgttgggaaggaaggggtctggactttggagccagacctgattgattctctgcttactatttttcagctgtgtcattttaggtaatctacccaaagtccccaggtctcagttggctcatgtgtaagtagggaaaatatacctaaatcattcattcagcaaacattgagtgcagacttgggccaagcagtgggctaggtcctggtagtcctaagtgggtcggatgtggtttctgttcctcatggagcttgcagtctagggagcaaattgatgttaggcaataatgctagaaaaaaaagataaaaatcacagctagtagattgcaaaggaataagtggtctggcttgtaattattgctcaattatttcctcgtttcccattcctctcatgccaccactgtcatatttcaaccacagttttgtgtgtgtgtgtgtgtgtgtatgtgtgtgtgtgtgtgttgagacaggatcttactctgtcacccaggctcaagtgtagcggtgtgatcttggctcactgcaacctccacctcctaggctcaagcaatcccctcacctcagcctcccaagtaactggaaacacaggtgtgcaccaccacgcccagctaatttatcttgtatctttggtggagacgcagttccaacatgttgctcaggctgctataccacgattttactgacaggcatatcccagttggtattctaccagctcgttttccacacttgagtgtgtctaacaatcacctgaaatatccgttaaaaatacaggcaactgaggtcaatatgtagaatttctttttcaagagtttggtgatgtaacccccaaactggattttaaccatctcctaggaaattctgaagtagcaatcaccagaccacacactcagaagtgccaggtttgagaaatagttgtattgtctctctttttaataataggttatgaaaacactttaaagtcatgtcattctgaataaattatattctcccaaaagctatttaatctagaacttttgcctcacattaataatactaatgatctttagagagcacacactattgaattatactaggatctaaatcttaactcactccccaaggacaccttttgtttcctggtatctttattgcaaaaaacacttaaataatttttaaattgcatcaattataatggctaaaaagtaaggaacagcaagagagccacaaccaaaaagaaaactgaccacagagagccttcctgccacaggcactgaggacagcaatcaacagatggtgctaactgctgtgattattaagccaaacacatttgtattagtctattttcacgctgctgatcaattcatacccaaatttatacagggaaaagggtttaatggacttacagttccacgtggctggggaggcctcacaatcatggtggaaggcaaggaggagcaagtcatatcttacatggatggcagcaggcagagagagagagcttgtgcaggggaactcctctttttaaaactatcagatctcatgacacatgttcactatcatgagaacagcattggaaagacttgcccccatggtgcaattacctcctactgggtccctcccacaacacatgggaattcaagatgagatttgggtggggacacagccataccatgttattccacttctggctcctcccaaatctgacatcctaacatttcaaaactaatcatgtcttcacaacagtccttcaaagtcttaactcatttcagcattaactccaaagtccacaatccacagtctcatctgagacaaggcaagtcccttctacctatgagcttgtaaaatcaaaagcaggttagttgcttcatagatacaatgggggtacaggcattgcataaatacagccgttgcaaatgggagaaattggccaaaacaaaggggctaaaggaaccatgcaagtctgaaatccagcagggcagtcaaatcttaaagctccaaaatgatctcctttgacttcatgtttcacatccaggtcacactgatgcaagaggtaggttctcattgtcttgggcagctccacccctgtgactttgcagggtacaccctccctcctagctgccttcacaagctagcattgagtgtctgtggcttttccaggcacacagtgcaagctatcagtgcatctaccattctggggtctggtggacagtggccctctcctcacatatccactagacagtgctccagtagggactctgtgtggaggctccaaccccacatttctcttccacattaccctagcagaggtactgcatgagagtcccacccctgcagcaaacttctgcctgggcaatcaggcgtttgcatacatcttctgaaatctaggtggaggttcccaaatctcaattcttgacttctgtgcactcacaggctcaacaccatatggtagctgccaaggcttgaagcttgcaccctctgaagccacagcccaagctctacattgtcccctttcagccacagctggagtggctaggacgcagtgcaccaagtccccaggctgcacacagcacggggttcctgggcccagcccatgaaaccactttttcctcctaggcctctgggcctgtaatgggaggagctgccacagaagtctctgacatgtcctggagacattttccctattgtcttggggataacattcagctccttgttacttatgcagatttcttcagctggcttgaatttctcctcaaaaaatagaattttcttttctatagcattgtcaggctgcaaattttctgaacttttatgctctacttctcttataaaactcaatgcctttaacagcacccaagtcaatttttgaatgctttgctgcttagaaatttcctctgccagataccctaaatcatctctgtcaagttcaaagttccacagatctctagggcaggggcaaaatgctgccagtctctttgctaaaacataacaagagtcacctttgctgcagttcccaataagctcatctccatctgagaccaccccagcctggaccttattgttcatatcactatcagcatttttgtcaaagcaattcaacaagtctctaggaagctccaaaatttcccacacttccctgtcttcttctgagccctccaaacttttccaacctctgcctgttacccagttccaaagtcgcttccacatttgtgggtatcttttcagcaatgcaccaccctactggtaccaatttactgtattagttcattttcatgctgctgataaatacgtacccaagactgggcaatttacctaaaaaaaaaaaaaaaaaagatttaatggacttccagtcccacatgactggagaggcttcacaatcatggcagaaggcaaggggagcaactcacatcttatatggatggcagcaggcaaagagagagagagcttgtgcaggggaactcccatttttaaaaccatcagatcccttgagatttattcactatcatgagaacagcctaagaaagacacacacccctgattcaattatctcccactgggtctctcccacaacacgtgggaattacgggtgctacaacttgagatttgggtggggacacagagccaaaccatatcagtgaggaaggcatgttaaaagctgagataggccaaaagctcggcctcctgtgccaaggagcaagccaagtcgtgaatgcaaagaaaaaatcctgaagtcagttaattaaaaatgccactccagtgagcacatggatgatagaaggttaaacaggcctattgctgatatggagaaagttttagtggtctagatagatcaaaccagccataaaattcctttaaattaaagcctaatccagagcaatagcctaactcctaaattctatgaaggctgagagaagtgaagaggtttcagaagaaaagattgaagccagcagagagattggttcatgaggtttaagaaaggaagccatctccgtaacataaaagcgtatggagaagcagcaagtgctgatggagaagctgcagcaagttatccagaagatctagctaagatgactgatgaaggtggctacactaaacaacatattttcactgtcgatgaaacacccttatactgtaagacagtgccatctaggactttcatagctggagagataaagtcaatgtctggttttaaaacttcaaaggacaggctgactctcattatgggctaaatgcagctggtgattttaagttggagccaatgctcatttaccatttggataatcttagggcacttaagaattatgctaaatctactctgcctgtgctctacaaatggaacaacacaacctgaatgacagcacatctgttttgcagcatgacttagtggttattttaagctcactgttgagacctactgcttggaaaaacaggttcctttcaaaatattactgctcgttgacagtgtatctgatcacccaagagctctgatggaaatgtacatggagattaatgttgtcttcatgcctactaacctggaatccactctgcagcccatggatcaaggagtaattttgactttcaattcttattatttaaaaatatattttgtatgtttatagagccatagatagtgattcctctcttagatctgggcaaagtaaattgaaatttttctggaaaggattcactagaatggcatcatttagtgatgccatttggaaaaaatgttatcttttttgtaaagaaaatttttgattcacgggagaaagttaaagtgtcaacattaaagagagtttggaagaaattgattccaaccctcatggatgattttgaggggttcattgaagtcttcagtggaggaagtaactgtggatatggaagaagtaacaagagaactcgaattggagcctgaagataataactgaatttctgcaatctcatgatcaaatttgaagggatgaggcattgcttcttatggatgagcaaaggaagtgtttttttggaggtggaatctactggtgaagatgctgtgaacattgttgaaattacaagaaagaatttagactattacaaaaactcagttgataaagcaatggtagggtttgagaggactgaatccaattttgaaagaagttctactatgggtaaaatgctatcaaacaacattgcatgatacagaagaaatattttgtgagagtccatagatgtggcaaacttcactgttgtcttattttaagatattgctacaaccacccaaaccttcagcaaccgccagccttatcagtgagcagccatcaacatcaaggtaagaccctccaccaatgaaaagcttatgacttgctgatggctgagatgatcattagcatttttcagcaataaagtatttttacattaaggtatgtgccttatttttttagacataatgctattgcacacttaatggattacagtagagtgtaagcataacttttatatacagtggaaaaccaaaaagttcatataactcactttattgtgttattaactttattgtggcgacctggatccagaccagcaatatcgctgaggtatgcctgtactcaattcaaaactgaagaagactgaaaaatctgacttgtgggttaaaaacaaaagcacatcagtgatcatgcattatttgtgttttacactatagcaatatagctagctacagccacaaagaaagttgttcttctgtgtatctgagttttctagaaaactgaaatgtatcctgttgaatattccaatattgtgtttcagatggcttatggaatttctctaacgtattatgcacatccctgaagatcctactgaatagaataggttactatttctgagatggttgaagggcatcatcatgagtatccagcactggctgctgcaggaataccatgatccgcataggaaatatgcttatggtaaaggtcctagactttaagggtttatttgaggtctgccaagtttttcatttgctgcagaccagctttttttatggcttcttcctaaagccagtatgcctgtctccaggagcccctccctctaattttgttcttttgtttgtttgtttgtttgtttgtttgttttgagatggagtgtggctctgtcaccaggctggagtgcagtggcatgatctcagctcactgcaacctctgcctcccaggttcagagagttctcctgcctcagcctcccgagtagctgggactacaggtgcacaccaccatgcccagctaatttttgtatttttagtagaaacggggtttcaccatgttggccaggatggtctcaatctcttgaccttgtgatccacccgccttggcctctcaaagtgctgggattacaggcatgagccaccatgcctggccctaattttgttcttttaattgccaacgacaggaagccaaaacaaaacatgcatgtattttaagatcatacataaaataaaattaaacattctagggtagggattacatacttctgcccctccgagttaactatacagactttgatacaaaatatttaactttatggattcttatttttgactatttaaagatcttaaagtttgtgcttattctagtttatcagatgcattctggataagagaaatcatctaatattgtgacctttgtataagtaagaaagaaccataaaatcccagccctaaagattatagacatattctacaacttttaagaggtgactgcttttctgtcccagttcatttttttacaagtcatgccttagagtcattctctaatattaagagtgtgacccttaatatttttatcagtctgttaagtgactaatggtacctcagtgtagtttattttaattaataattattgaaaagtttgaccatgtttttacctgtttaaaagccatttgtaatatcttttttatgatgtattcatatcctttgcctgtttttctatagaattttggttgatttttttaatttataaaagtcctttgtagagtaggaaaattattcttttgtctgtgatttaagatttttcagtttttcacttgtctcttgactgtagttacatgtttttttttttcctgtggattatttttattttaacataggcatgtttactttttttttttttaatgatgcctaggtctttgtcacacttgggccttctctgatgcaaccttatatattcagatataacatatgcatatatatgcacacatatatgtatgtgcctatatggaaaagatatgtacaaatatatgtatgtatatatttacatatgaatatatgtttttaaagtatatgtttaaaaaagttcatgattttttcctggaacttttaagtttcattgtttacttttaaagtctgatctctctggaatttattttgatttgaagtacaaagtaatcttctttattgatttaacacaaaaatatattgttctcccaacacaagttattatttactgaataatctcttttaaaaccactgatttgaagtgccaagttttatcatatagtagattatatttcgaaccaccctattttaattattgtagctttttaatgcattttagtatcttatcactgtttttattcctcaaaattttctttggtattcttaattttttctacataaactttaaaattagtctaatttttttaaagctctatttttattgaaattttattaaatgtttagtataatatagggagaactgacatcttttcaatattgcatattcctattgaagaataaggtatcaatttccacttattctagtctttttccacaattgtctcaattactataaatgacttttacaatttgtttcaacagtaaaataaagcccaggcatagtaatttgttgacgtgcatctcaaatctcttaagccatctgtttccctgtttctccagctctcactaacctttatttctatgttacgtttgttgaaactgatcaactgtcctgtacattttcccaccatctggaccttgctgatgtaccctcatggtgttgtttatcatgttaatctgtccttattttgctaagaatactacttaaaagatgaaggattctagtcttttctgtgtttattcctcagcagcattttatctgttcttttgtatagatccttcttatttctgtttgagtatatttttagggtttttaataatataacctctgtagagggcaatttgacagtatttatcaaaattataagtacttgtatcttttgacccaacaatttaacttctcagaatttatcctgtggagataattgcccacctgtgaaatgctatatatctgaaattacttgttgtggcattatttatgtagtaaggttgcgataatctaaattcccattggtggaagactaattaaataaatacagtgaaatgttataaagatgattttttttaaatgagaagattctttatgtaatgctaggaaatagtatccaacatatgctgttaaatgaaagtaaaaatgtaaaccagtgtatacgaatgtatattatgttgttatttctgtaagaaaagggaccatacatatactgtatatacataagatatctctggaagataactttggttggtttcactgagggaaactggctaagggacaagggaatgtggggaagagaatcttcactatatacctttttataacttttgcctttgtgctctgttagtgttttacctgtttaactttttttttagttaaaacatttaagtactgtaatgaaataaatgacaggttaacatcccaataaatatattttatgtttcagacctgttgtagaattatttggcacaagtaggaccgatatgttaaatgtcatccacacttaaggagtaccttgccagcaagtaagacagtttaaaactagatggactgtgtgtgagtgtgtgtgtgtgcgcgtgtgtgtgtgtgcgcgcacgcgcacgcacatgcacacatggaatttagcagagtcggtcttttacagggaattcttgcattaaattaacagaagtgaacctgatgacctctaaatatcatccaacatgggcagcatggcatagtgaaatagtacgaggcttgaagccttcagatgaaggttcagatcccctcttcactccttaataaactgtgtgaacatgttatagtatcttcaacttaataggtttcagtttcttaatctacaaatggggttgcttccatctacctataggcttgttatgagcattagcaataatttatattatgtctggaagtttggttcattatactgttattccatctccacagatctatgaatgaatgatccttggggagaaaattgaggtcaaagatatattttatgggaggaacttctcctttcattttgaaacttagatatttctatcatattcctgaatgttattaacaattctctagatcttttacctcccatccactcacctatgaaattctacaagcaatactagaagtgaggaaatgtgaccgtacatcccaacctatttgggtagcccgccttgcacttacctcaagttgagctttgcctcttactgcttttcttattgggattttaaaattgtatattcaaatatagctgtatagatctcttatggagtaaaatccatgatgctcatggcaacccgatgtccatcatgtagtcattctctgcagggctaattgtctgtatttttaaaaagtgaagtcaagagaattgtttcattttattctaattcatttatggacatgtcttatctccatgacagtctctgacacataccttggagtcattaaaatattctctgaaattcaagtgcagtggagtgtacctatagtatcagctgctcaggaagatgaggcaggaaaattgcttgaatagccattgtattccagcctgggcagtatcttgagactctctctctctctctctctctctctctctctctctctctctatatatatatatatatatatatatatatacacacacacacacacacacacacacacatgcatatatacatatacatatatacacatatatatgtatatgtgtgtatatatatgtatatatatatatttctctgaagtttatctgacacaactaactttaacttttggtagtgcttaagacaagaagcaaatcagaagttaaaaaacaaaaagactccaacatatttgcctgcatttcatcatgactattctgagaactttcagtggttacctaaggagagggacacatcctaactataccagggcagtgaatgctattgctcacaatgtaagatccattaattacactccccattctacctgtccaatgatgggaaaagctttaagctgctatgtaagcagcttgataagagacagtttcctgttagtgaggactgttaaacttggatttgattcagaaaaataaattaaatccatttctctcgagatctccgaaaataagagtggtcgatttactattttaagtgccttgtgaagaactacaatatttcccctactttttttcacctacaccaacattaacattggctgatttccttgacacatctttctacataacttcctaaagctgttactatattataaatgttgtcctgaaaattacaagcaaatgtaactagaatactttgatagagcctttttaaaatctacttatgttttagttgtttgcccacactgcaataaaaattataagttgtcttttcagtcattcacactgatgaacaggaacaggaaaccaaagtttcttttagaaatacctctattacaatgtgtgtggcaggtttataaatagaattaacaggcaggtattttcagatagctttagcacagtgttagtcaatgtcagggaaatttttttaagtttatgggagctttaaaaaacaaaacagtaaaattacttttgacacattctttgttactttgactttcaccacagtctatagtcctgaaaaagactgtttataaagtaacgtacataacttaatttccccagggtaaaataagtgtcagccacaagtatttttgtgattaagaaagagccacttaacttaggttggtgttccatatcagttagagatttcttctgtcaatttctagcatttctaccacaagtttttttctaaaaaaaagaattcttagaggaaataataaagatttttttccagatatctaaattagtatacatttttaaaaacatcataataactctatgaaatataaagtagcaaaacagcatatgaaagttctcatcttcagcttgggacacagctaatgcttagtaagtagcagattgaggcatatgaggttgccaatatttgaccactttgacttataaaaatgacaatttcatgagattcaagttaatattagtattcttccttatttgcattggtgtcagaatcccattagcctaattcatcttaccaaaagggccctcagatcttgagaaaattatggttattggccaagataaaagtgtatctgcatggcttcagtagctactgcagcaaagtgaacctatacatttcacctcaagagagtttagggatgttctcaaacctcatacctgatcttataaagcagaggtccccaatccctgggccatggaccagtactggtcagtgacctgttaggaaccaggccatacagtaggaggtgaatggtgggcaagcgagaattaccaacccgagctccacctcctgtcagaccagcagcagcattagattctcataggagcctaaaccctattgtcaactgtgcatgtgagggatctaggttgtgcactcctcatgagaatctaactaatgcctgatgatctgaggtggagcagtttcatccccaaaccatcccctcacccctgtctattgaaaaattgtctcccacgaaacctgtccctggtgcccaaaaggttgggggccactgttataaagtacagcaagaagttaaagctaaaggagtaaaataacagttgtgaggctgacattgtagtggagagagacacagaatccaaaaaagcaaaaaaggacaaaaacaagctacaaatataatacaaataccatttaatatgggtggctttgatgtgtacgtatgactaacagccctatatcctgctgtcctgtattaagatatcattatattataataacatgtttccagttctgactgttcattatcaagataagtttaaaactgtctttgaatgctctaaaagtctgtgtgaattttaagtgtgtgttctagtaacttctctgaaaattttacgtgatttcccagcccttcagggtacaacgaagtgtcactttattattattattattattattattattattattattattattattattatttgagacagagtctcgctctgttgcccaggctgcagtgcagtggcgcagtctcagctcactgcaacctccgcctcctgggttcaaacagttctcctgcctcagcctccagagtagctgggattagacacctgccaccacgcccggctaatttttgtatttttagtagagatgggcttcacctgaagtgtgactttaacacatgaatgattagaggatgagtcaggctacaactctgtttattagcaaaacaattggggagcaactttatatctgagtatttttagactttcagggacacagccaacttttaaaattttattacacgaaaacattttaataataaaaaattagaaactgtaatatgtttttaaattctgcatgaaaaactgaatatctccttgaacaatgtagacctagtagatgaaaaataccacaaaagtgggttgcttttttcatcctgttttttctgtatccctagcatctagctcaggggctggcacatagctggcaagaatacatatttgttgaatgaatgaatggagtgaatgcaattctaagtattgcattaatatgtaagtccttagctcattaaatatcctttttgtacaagaaattgttcagtaaaaatactcttttctccactgcactccagcctgggcgacagagtgagaccccgtcccaaaaaaaagcgaaaaaaaaatactcttttctcacctacaaaatggggggaggccttaccaggtgtttccagcataaatattccacagtcttgtaaacaggcaagcccactgtctagggaagagatcaaacagtagggatttcttaaagcattaatgggtaagttaagaccattaatgcctggcttcgttccacaatggccttgggccacatgcaaccttgattgatgatgactttttacccgtctctctgaaactacttgctgagttttgtcttagggcttgtgtgtcacttgtttagctctcctgacattaatccaaaggaagtcattcattggcaagtacaaattctccccaattatgccaaagagaattattcattacattttatggaaagcccaaatcttatttccaggagggctggggacctgccagctcactgggttttgttggcattgattgattttgctttccccaggcttttaaccaaaagcctttcgaattccaaatggagcctctttatcatttgagatctcctgaagacacggaatttggttttaaataaaaatatcttagctaaggacacatgttttgtgggattaatgctactaatttttctctgcttttgttttaaacacttgaattatgggctctttggtcaagaaccaatgttaggaaaagttgatctgtttagcctacttctagctgtgtctgcactgtttaatgcagtaggcactagccacatgtgactatttgattaatcaaattaaaagttaagttccttgatttgactagtcaaattgcaagaactcaatagccaaaagtggctgctggctgtctcactggagatgcacacatatgtagtatttctgtcagcacagaaagttgtgttagacaacactggcaaagactatctccttgactgaacttgagtcagactcctctgaactgtcttcaggccctgaccttggactctgtccttgacctacttggtccagttttagtaagaatcctgctgagtcagtatagcgagaatcccctagtcttgatatgtgataaaattcctcatcttgcccaacctacccccatcatcctccatatcttatcactctggcctgccttcaccaagaatcctgtcaggtcagtttaagtaggggccccccttattcctgatctttcctcttagtaattttccatccactgacatccactctgctccttggctataaattcccacttgtcctggtatttggagttaaacacgttctctctctactactacaaaacccccactgcagtagtccttcttgaacagtcctccttatcatctttgacaatgtcatattttttctttattgacattatcttaagttctaaaaggacacaaaatattcaagtattttagcttttaattttaaaaatttcttattacctaagatgggaagaggattgaccagagatttatttattcaacatttatttattgagtcaatacagtttcacaagaggttattgtagttgtgaaatattcttggaggtttacagcctctatctcccactacacaggtgatgttgtggtccagggaagcacctggggaaagcccaaaagctttttggaagtctcagacactgctaaagaaagggagtcttctcttctgagtcacagttcatcttcatttcacccacccttctctcaatgctgaggaattcaaatttaatatattaaatatataagaaagtactttagaaattctagggactgttggcactacatattctcttagttgtttccaaacgtttccagggctagattgtgttacagtttgaatgtgccctccaaaagtttacgtgttggaaacttgattgccactgtaacaatgttaagaggtagggctttggaggtgattgggctatgagggctctgccctcaggaatggattaatgctgttatcatgggagtgggctggttatggtaggagtttggcctccttttcctctccatactgccctctctcatcttctcttgcctttttacctttcagccttccacaatgggatgaccctcatctgatgctggtgccatgctcttggacttcccagcattcagaatcatttgccaaataaacttcttttctttataaattacccagtctgtggttattctattatagcaacagaaaacagactaagacaacttgttagtccccaaatgagcaggtcatcaggcccagctgtactcttgcatgcatgtaaaataaccaagaattttagtcctgtgttacagcccaatgggttcttcttgcctgctgcacagataaagccaatacactaagacaacactgttgcagcagagaaaggatttaattatcgcaaagcagctcagcagtagagtgggagatatttctcaaatttgccttcctgagatcacaaaggctatggtttgtaaggataatttggtgggcagggggctaggaaatgggtttctctgattggttggggatgaaatcataggagattcaaactgtctttggaagctgagtcagtgtctgtgtggggatcacaggaccagttgggtccgttcgtttgtgtgaatcactgatctgggtggcatcagttggtccacctgaattcaaaagtctgaaaaatatctcaaagacaagtcttagattttgataatagtgatgtgatttataggagcaattaggaaagtttcaaatcttgtgacctctggctacatgattcctgagcagtaagcaagctagagaacaatggctgattatcagttaactatgcttataggctggcagaattcaggcccttaccataattcccgaacaagaaaggagttagtctggggaagaggctattgtcatcattgctttaaagttaagccataagctaaattcctctcatagttagcttggccaatgccaaggaatgagcaaggacagatagtttggggggttagaagcaagatgacatcagctgtgttagattcatcctgctacgataatctttgcaaagacaatttcaactgtagcacagccaggtcagtgctagttgctatgtgatcagtaattccaagctacagagttctaccaaatcattttgggctatcattgataccgtacaaattcaagcaatgattaagtgattaagaaaagcctaatattccagtaccttcctagtctaattattggattattctatgaaaacacatatttttaaaagaaaaatttctagcttaaaaatttttttaaaccgattaaatggtaattatttttaagaaggttataatcttgactctcatacaaatgcaaaacgaacacatatcaaagtttttttagctcaataattaatgagataaccagtaagctatgagaaccaattcaggaaaggatccaaaaagcaaatgaatatataagccttcagaaataccaaaatacatttgcttaatagatgcaaactggccaatatccacagggcaataatcaattgcattccactatacatgtatattgtgcattattatggactagaatcatttgcctcatgaccagttttctacaacatagagagttgtaaaattgttcaaagaaaacttcaaaacccatagagtcagataacctagaaatgtatgttttcgataatacctagttttcattgaagacatccagtaatcatcttggcccattcccaaatcttccataattttttcttccggtaaattaactcttcatatattactctgtccatggttatgcccttttgatgtacctggccattttctcaagttcatgttatttgagagatacatgaggagctctcccttttgtttgattcaatagtacagaaaaaaagagcacgtctcctattacaaactccaagttaagaggtatgggaagggtcacagtgagctgggtaactagagggagaggcaaaagaaagagaaaaaggagaaaggattaaatcatttatatcataatttcatggatagtattatagaattaaacctctttgtagtcacttatttcacaggttctggcccattggctttaagaggcatctcagtttagtaatggtttcttggaggagaaagaaaatttgaaaaggaaaaaatatatacttctttaaaaaatggagtatatttataccatggcatattattccctcagtaaacaacggtttaaacctttttaacattcttttgaatcactttgtccatcatttatcatgcatatgacttgatactttcatagtgcatttcctgattgaaacctttttagcagctttgtgattgaaaatgtaatcttaaagcatttcaaagaatactgggatattttctacataatccaccctatactcctactctctctacacactccaatttaattatatacctgaggttacacagctaattttgaaagttgtaaggaaggttttgatagcttaccgcctaagcagttgtcctcagcatagcattcatgggttattcacttttcctagctttgaaaacactgtgatctattctgtaagactgacaaatccttctgcctttaactgtgctggttggcatccaacagacagtccttttgaataacccaaggccaaaagatttattaacttgcacagatttatctacttccatgtgttttctattcttgggtcctctgtaaaacatttaattgttattttacaagagaatcacttggttcattccttgagtgatgaatgtttgcatcacttgcagtaaatttacatcctgtggtgctcttcattctcttctgcatacacagtactttttctgttcacttctgccatcacagtacagtcctattgaggacaagtccacatccaaatttaaggaaaactactgtgagaggcaggaccaatggaaacaattcaactgagcgaacaaggataaacaaatagcctaaagtacacacttgtctaggcaatggctcatgcacagaaaataacagctctaacacataattgtctgtgtgatgatcagctgatttctttggacattgattataagatttattagaattgggaaagggaaggaacactatgcatgaggaatttgcaaaattacagatttctaaaatacagattgtttcacaaagtgtgacccccttttcttttgacaagtttttttgacaaagttcctagcttcattgctgctgatctaattgtgcctttctcttagcaaatcaggaaacacaggcccggaaactttcacttattccaactttcaccaaggtagctagtattaaccaaagttaaagcagtggattccaaactcccagttttccaaacaccatgataaagttttcaccagtctgtggcaaaatgaaaaaaacaaagtagtaatttttatgagttcaaaaatatctacttcaagggattgttttattttcatgttgaaatattcattttttatgtgattgatgtagtcattcttttgtatgattaaaagaggcattatttttgtaaatttttttgccgccaccccaatatattagcagaacaaaaatttagtagccctatgtaggttctttcaattaaaggaattactagtcctttacatacaaaagtctgagaattaacaggcagggaacttctaatacagtgttctttttgttaggcatttctccctagttatttcttttggcctttttttttttttttttttttttttactggagaaagggcctccctcaagcatttttctcagctaccaaaggacacttctctctttttctcaactcacaattatgaaaccattttttataattttaaaataattgggttataaaaaagatgcatttgtgaataatcaataccttataaattagatgaactaccagggaagttaaaaaacactatctttttttataatgcggactttcagttttgtgattcatcatacctcaattacaagaagatttagttcccttacttgttttaatgaagtgttttctaaagtagtatacacatatacacttatatgcaacttactctaccactggtaaccaagaagagaaatgcaagaattaaggatagtttattcatagctaacctacttctaccttttctactaccatagcactgtctattactattctggtactgcagcctcttgttgtttttatgtaaaggcattttacagagtagctagaaaaataataaatctccaatgtaattgtctatgtgaaagtaactcatttgagaatgtattgattattatgattaataatagggccctggcattttgtagactaatgttaatattgtaatattttggtaccaccttctgcgattgttcaaggtagtgtacttgttattatattacgtgtccagtcattggtgacaataccactttgtcaggctgtaaagatggaaacactttttcaaagagaagaaaaaattgagctgctacccctgggctcaaagtagattagccttaataatttagaagtgacaactactcttgctgttccttctgaaacagcattatgggcctttacttgtcacactatattaatttaataaatatttatttggcacctactatgtgtaattaattaggtgctcattctgattatcttaagacatacaaagatgaatatccttccatttgtgtcctcaaaaagcttaggacaagagatgatccatgtatgaaattacctgtaacagaaggaagcagtgatatgtgctattggagaggtagagataaaaatttgccaagatttcaaaggagggaggaagttgctgttttaattgaagaaccaagcgggtattcatgaaggagacgaaaatagaacagaaccttgagaagtgctttggatttgaacatatggaacttgggctaggttcgtttcagaaagagaactacacaagccagtaataggagaggaaaattctggtgtatctgatgcaaaacggagtctggctagagttacaggatccatgaaggagagtaagtagaaagttgtgctgcgtcacagtacaaatgctgtgttatgttcaggactaaagattttgggctttggtctacagggatgagagaactcctgaggttttgtaaacataggaatagcctggtcataaggagtatcaagacaattgatctggaggctcagcatatgttggattgaagaggccaataaccagcagttcagagagtggctggaaaccagaaccattggtatagtccttgagatacattgagaggaagaactgccattgtggccatgggaatggccatgggatgatcaacaggagaggtcccagggtgcaacatggaatgagtgtttgacaatgaattgaacatgagggaaaaagagatggaggggagtcaaatgctttgacattgaaagaaaaaagagtaggtttgattgataagataaggagtcctgtttgggcctccttgaattcaaactgctggcaggcatcaacgaataaatatcccaagaacaattaccaatgcatatcagaaattaagataaaaatgaagccagagctataattttacttatttgggaatagtcttaatagatataatagttgaagtatctttgttttgagagttcaccagtgggcatgagaagtgtactaccaagaagagagaagggccaggactagatctgtggagaatatcaacacttaaaatgtagaacaaggaaaccactccctccagcgcccacccagccaaaaacctagaaactaaaaataaccacccaacattcaggagaagtcagaggtagcagaggcaaaggagggagccagcaaccagcaaccagcagcagagaggctagagtagactagcagaggtaattttgcttgcaagctggacatcttgccttcaaaaggaagaaagatcacttaactgtggatagacacgtgtgtttccagagcagagttctttcagctctctgaaagagttccctgacaggacctgctcccacaattcacagccacatggtccaaatttcttggcagaatgtgtcatcagtggcctgctgcccactgccctggcagaggccctctcccacaaacataatgggagctctttccaggagtccagaagcccaaagatacatctgtggttttgacatcccattttccccagtaagaaaaacctgcagagctgcaggtccatctaacattgctttttttttctatctgaccatctgtaacctctgtaaaccagaggtttttaacctgaggtcagtgaatattctggccagtggatataattttctgctatccatgtgcatgtattttcctgcagggatgatttattcttctcattcttaaaaagatctattttcttaaagagccactgtaatattaattgtacactcttgcaaataatgtgagttccttgaggacaagagcctgtccttataaattttgataacctcatggaacctctatcagtcttggctgaatgaatggctaatggtgctacattagttgggcaacagagatgattgtattagtccgttctcacacggctatgaagaaatacccgagactgggtaatttataaaggaaagaggtttaattgactcacagttccacattgctagggaggcctcaggagacttacaatcatggtggaaggcaaagaagaagcaggcaacttcttcacagggtggcaggatggagagagtgcaagcatgggaaatgacagatgcttataaaaccatcagatcttgtgaaactcactcactattatgagaacagcaatggggaagctgccctcatgatctaattacctccacctgatcctgctctttaccagattggggattatggggattacaattcaagatgagattttcgctggggacatagcaaaaccatatccatgataaaaatactcattttggttctctgacctattgtttaacttaaaaaaatatagatacctaggaaacattttttcataatgtcctctgttagaataacttgttgttaaaatgagtgcttcgccccaagcatggtggctcacacctgtaatcccagcactttgggaggccgaggcgggtggatcatgaggtcaagagatcgagaccatcctggccaacatggtgaaaccccgtctctactaaaaatacaaaaattagctgggcgtggtggcatgcgcctgtagtagtctcagctacttgggaggcagaggcaggagagtcgcttgaactcgggaggtggaggttgcagtgagctgagatctcaccactgcactccagcctagcaacagagcgagactgtgtctcaaaaaaaaagagtgctttgcacactctctcttatttatttccttaataattttgcagagtgcggattaataccttttttcattaatgaggatgctagggctgagagaattcatgtgacttgctgagggtcaaacagcatgatagccaacttgggacttacatccaagtctttgttctccaagtcttatatattgtcccacttatccaaggactggagagccaggttagtttagtaggtaaaaccctgtaaagatggcttgggctctaatcctggctctagcacttcctgtgtgactttgggcaaattcctaacctctgtaagcctgcatttccattaataaaatggagataataagtgtctgtacttataaggtgattgcaaagtttaaataagatagttgttttaagtattcaaaaatgttaactattattattatcatctcatggtacgttcatttgtaaacaaaaatgcctgggatcatagtagattttgccttgttttatggaatgcttattggcaataggttggattttgttttatacaaatacaatatttttcttagcctaaaatatgatattcatgttaaatgcagtggtttccaaatagttgtgttattgactgacagatacaagtatcatacagtaaatttaattgcttggtcttacacacttattgcctaatgacagagatatatttgaacaaatgagtcattaggcaatttcactcttgtggcaacatcaccgagtatacttacacaaacctagatagcatagcctactacacacctgggctatatggtattacgtagctcctcggctacaaacttgtacagcatgttactgtactgaatatggtaggcagttgtaacacagtggtatttgtgtatctaaacacagaaaaggaatagtgaaatacactataacctgcctttccagtccttggataagtgggacaagatataagacttggagaagataggccgggtgtggtggctcacgcctgtaatcccagcactttgggaggccaaggcgggcggatcacttgaggtcaggagttcgagaccagtctggccaacatggtgaaaccccgtctctactaaaaatacaaaaaaaaaattagccgggcgttgtggcaggcgcctgtagtcccagctacttgggaggctgaggcaggagaaaggcgtgaacccgggaggcggaggttgcagtgagccgagatcgcaccactgcactccagcctgggcgacagagggagactccgtctcaaaaaaaaaaaaaaaaaaaagacttaaagaagataaaatatgatgtacctgtaaaggacacttactatgaatggagcttgcatgggtagaagttttctgggtaaatcggtgaatgagtggtcagtgagtgtgatgcctagaacattactgtatgttaccgtagaatttataaacactgtatactttggctatactaaatttattaaaaatgcctttcttcaataataaattaactttcacttactgtaacttttatactttataaagttttaaatgtttaaaaaactttttgaccgttttgtaatgccaccacatctggctccagtagtgtacagcaatgtcctaggcttcatattcacttacctcttactcactcacttacccaaagaacttctacccatgcaagctgtgttcagtaagtgtgtaagtgtgtaacaacacttaaaacacagacacatcatacagctgtacaaaagcattttctttctttatatccttactctataagctttttttctaattttctactttttatttttatatttttactttttaaacatttttgttaaaacttaagacacaaatacacatattcgcccaggcctgcacatgatcaggttaatcaacatcactgtcttccacctctacatcttatcccactagatggtcttcaggggcaataacacccatggagctgtcatctcctgtgataacaatgccttcttctggaatacctcctgaaggatctgcctgaggctgtataacagttatttttttaaaatgataagaagtatggtatagtaaatacataaaccagtaacacagtcatttattatcattatcaagtattgtgtattgtatgtaattgtgctatacttttatacaacttgcagtacagtaggtttgtttaaacctatcacatgcgtcaccacgagtaaagcttctgccttttcctggagttctctggagtacaaaaggaagtaagaatgccaaagcagtggcagccccccaacggtggctgaaatcagtagactggcagggctgctgtgctcttggcacctggctttatcctaatgctgcatgagtgacagagcctgccccgcagcagtgcactccatctcccattagctgtcatcccattagcaacggaggtggtgagagttcatatttacaaagaggctgagacttaccttcctaaacaagcaataactatttaaacttccatacaaatgcaggagggtgaaggggtgagggcagaggacgttggaacttttcagacaaaaaaactgttgcttctaacatgaaaatgtgaaggacttacaaagtcaccaggcagttctctgaaattggagttacaaataaatgttacaggactgattaggatcttctaattcataagcctgttggaatcactctgctcttcagttaaatgtgtatgtactctgttaattgaataatggagactattaatgctcaaccataattaaaatacaattttccaaatgcatttgctcaatatcacttgacatgttgttttagtgatttttttaaatgatcaagaacaagtaagttacttaattgtatgaataaacagtttagctttccaaatgcctgcagtgacaaaatgggagaatacaaaggaaagaggaaatcgtgtccccagtgtgcacaagtcaggctgtttgtgggaagacagggcttctggaacactggcatgccaagaagcagagatattattcagagatatctgggcactgacggtgcttttttttctccaagagaaaatgtggccttgatgcccttcaatttggttcaagaacctgatgagcctgataattagaaatattaatttaaatagaaacaccagtttgtttggtgtaagctgaaatggtaacataagcctgaatataaatggactgtgtcgtagcaagaattcagcctcattctcaactttggtagggggctcctccctgcccaaagattgtcactgggagagcagcaacctcctaggaaccaatacgtgaggaacaatcacacaaggatgtgctgagtctgctccttctctggtttaccacttcctgtggactctgcaacctggaatgaataaactgggatttgaggcaggtatatgtctgatctccgctcaccagttggtaacccagctgcaaggtgcatttactttataaatgggtgcagtgacattttcaaatgcctagtggtgctagttcatcttaagccctgtaaatatcttttggttttcattatacttgtcctagacctatgtagtttagtgaaagctagagtaagtccattcaaagtcatgatcaaactgtatttggcgaggctatgaaaaactgataaattagtttcaccaaacatgacttgtaattacttgttgtataagtaactatacatactcttaaccccgtgaaggtggggaccatggtatcttgttcctgggagaatcctcagaacttagcagtgttatttgttcatttaactgttaattgactttttaaaagtagaacctcccaacatatccttccatgagacttttgttatagagataactaataattaatatgtaaattgttgttttttaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtaagagtgatcaggtttgatttctcaagacttttgaatttgactttgactcagttatgttgtattcttattctagacacagcaatatttacacagggtaaaaaacaatctcattgaaatggtatggctagaaggattaggaaacccaagaaatgtgttaattcctgattccacttctggctgaatgaatctaaggaaattacatcttttaaaaattattatgatttacataaactccttgtgatcaaaaaaagcaaacatttttctggagttttcagtgtagagagagaggcacatatttatcgcacaaataaatgaaaaattacaaatatgatgagtactacaaagaaagacagcatggtttgctaagaatatcagaaatttttgcttaaaatcagcagtatcctcttgtttaaatagcatccaagattttttttgaagtgttatcttattataaaaattctatgtattgggggaaatttctagcctaatggtattttgtaatcactttgacatgatgtttgatttctattttaatgctctgatatacgtgtgaattagctcattaaaaagttaaaaattaaaacaatttctaatggcttttctagttttaaaattaaaaggtctactgagtaaaatgtaaaggatgatcttgaattttaaactaggtacttttttctaatagtataaaagaagtttaatttcatcaaagtaacctagtaatttggaagaaaacagtctctatagattgtagcaaaataacaatgaaataaaaaataatatcagtagatgatattaacttgcaaaaagttaatttgagcatctagaaatagtacaagtattggaccatatcaatgtgggggaaagcctggcacttttcccccaggtgcctgtttggttaatctcccttgctgtgctttaatgctcctccactctccttgacatttcaccgtgtttgttctacaaataaacttatcctttctcatctttcaggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacagtatgtcacttggttcctttcttcctctagtagcttagttttaactgtctttaacttctgaaagtatttcctccttgttccttttgcattttgaatgtttgagagcatttagttgggtatctaataattattttgtatagattatggcctatttgagaaacattgttatgaatgaacatttgagaaagaagttaaatcttttggcatatatagaatttggcagtgataatctgaaatctttactctctgattgatgggtttcctctgtaatcttaaccactttatgaaattttgcttgtcctatttaataaattagttactagatagaatggcagttggctttcataacaatgtgattaaaatagagtaaaaaagaattaaaaatcagagtttatacaggtttgttggcttttgaaccaaagaacttcattggtaatttaaaacatttgtatatgattcattttcaaaagagcagcttattttaagtcccccaaaatggagagaaattagaatgagatgcattcattcgaaattttattgctattttatatttttaaaatgtatttagggtttccaaatgtttcatattttagcattttattttccaattttaccagcaaaataattgaaatcacagtcctaaaattgagactaaattaaaagtaaatttttatagctgttcattaaatgaagccatattttcaaagctacccaaatcatgttaatcttgaactttacattggaacaacaacaaaaataaccctgaacagatactcaatatcccttaatctccaagatgtaggcatcttttaccttaagaagtgccatgattaatacaatgagagaatacagagcaaatttttgtcatatgttttttatctatgagattaaaaaaagatgacaataaaagaaacttaaatgtagtcttttaatagtcaaagaatacatcaaggggtgataatgcatatgaagtagattcaactattaaaacccatttgttttcaaactcctttagacacgtttagcaaacagcaaagacccaatatcctttaaaatagatttggaaaggaatatttcagatgataaacactaatacatcatgatttaaactggctttcattcatctgttttcacctacccaaaagcaattggtatattggcagaatgatgtccagtatacacagggaagaatttgaaattgataatttaatcacgtacattgttcaagaataaacttaggactgggcacagtggctcatgccctgtaatcccagcactctgggaggccaagtggagtggatcacttgaggctaggagtttgtgaccagcctggctgacatggtgagaccccatctcttctaaaaatacagaaattagccaggtgtggtggcacacacctgtaatcccagctgttcaggaggctgaggcatgagaatcacttgaacccaggagacagagtttgcagtgagcagagatcataccattgcactccagcctaggtgacacagagagactgtttgtaaaacaaacaaacaaacaaaaaacagaataaactttgaagcatttattgagtgtttactctgtgttaagagttttacatgcatcattgcaactagaaagtgattaagtctaagcttatattgtatgtggttctgtagtttgtgtatcaggaagctactagtattatttcaggtgatacgggtgttttgaatgcccttaatttcttttttatatatatatacacacacatatatatatacacacatatatatatatacacacacacatatatatatatgtagtgtgtgtgtatgtgtgtgtgtataactcttttccctttggaagtaagatactttttattttcattgtaaatttggtgtacagtttctctggaccactctatcagatggtgatttgaaaatcttctggtcccccttgatcttccagtttaacatgaatttttatctattcattttttcctaaatagatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggtaagacattttttgcttttatttctctcttcttgcagaatatcaacagatttctaagaaaaacatgaagcattcatattcaaactccttgtcaatctaatttgggctacaattcaattttttggctccattttaaaaaccctctaattagtttctgagtaaatattatattcattgatggtttccagagtattttcaaatttataagtcaaccacacctgcagagtagctttattcatctgaaaatacctgacattgtgtgagaatgttctgatttactccaaaaactcattgggtttaggatgggttttagtgaaccatatgttccacgaagcacttgatttaggctctgcaccactttttaaattacaaacattcttcttatacaaagacttttaaaaaaatttgattttagacatgtgtatgtatggccaaacataattgtttgtttatgctttaatttattgagagcctataatttttaatataattcaatatctttggcattattttcaaaggtgttttattggactcttcagaagtttagggtattagtccttcttatccactatattgacttgtaataatttgttaagtcataatcagaaaggtaatttttagccaggtatatgttagtactagtagttttattctattaaaagcacagtacaggccagctgctgtggctcatgcctgtaatcccagtactttgagagacagaggtaggaggattccttgaagccaggagttcggactagcttgggcaacacagcaagaccctttctctacaaatatatatatatatatatatatttttaattagctaggcataatggtacatacctatagtcctagctacttgggaggctgaaggaggaagatcacttgagcccaagagtttgaggctgcagtgagctatgatcacaccaccgcactccagcttaggtggcagagcaagaccctgtctctaaaattatatacatacaggttttatatgtagataaaactatatatactgtgtgtatatatatatagttcattttggccatatgtatgtgtgtgtgtgtgtgtgtgtgtgtgtgtgtgttaatttggctaagttcatagagcacaaagccaattgcctcatttacctaattacctaatttggagatatcaatattcacaaatataatagctaaatattatacaatgcttagatttcattttgactctgcaaactttgctttaaaacttgtagtttttgtgataataaagtgccaggtattaaatggtcaaattttcccttcttaaaaatcaggtgaatattgatcaatgtgctttgcagtcaacttggagccaaggctttatttttctaaccagggcttttcattgtttctaatgctacacttcagatatattgaattatctcatttaaaaataaaaatcaagtcttgaatacatgttattataaatgtgaaataattctgtggattctaaaataaaataaattatacagggctgtgaacttatttgaattttagggcctattttcaaataaacctgctttttatcagatgcttgaatttctttatattctatatactatttgggaagaaacatatataacaaatttaaacctttttatttatttttttttagattttatttcaatacttttggggaacaagtgtttttggttacatgaaaaacttctttagtggtgatttgtgagattttgttgcacaagtacctgagcagtgtacactataccaaatatgtagtctttcatctctcgcccccagctttttttaagctttgataggcatcttttatggcctttattttctttttaggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggtatgaggttcctgtgtcacccgtcccacagcatggacgatgggctatcaatgaaaatctgacccagaaaaactcttcgaactgctttcgaattataattcttgtgccactctcttcttattcttgttcttctccttctctttctccttctccttcttctttgattttcttctttttagtattctttcatagtcatttctttcatactcatgtggtccttcccgtagacacatgctcacttattggttcattcggtgctattcatcgagacctagtttcagatataattcagtgttcttgtctttgttttagaaaatttatctatctgttttgtctgaatatcatttgcattgacagtcttctgtattttattaacacttaagattgattatgactggagaggaaacaatctctgacattgctagaagaactgcaagcaagtcactgtgctaggtgctgagatgcaaccataaattagcaggaagatgcaactctgctcaaaattctccctgtggctaaaagaataagatgcacacaatgcctttgatgtcctgaatgccatccccttctcaaccccatttctggccactcaccacatcaagcatgttgtagcatgttctgtccatgtacttgtgattatgccacgtacatcatgctcttttcatgtctctgaatctccacttatgttcttgcattggcctaaactgccctcctcatatttctttcccaagatagtgttgcttagccttcagggtacacctctagaaccagttcttctctgaagcctcccatggaactacctggagcaagttaccctcatttttgcttcacttatacacctttctgttattacttgttaccatcccataataacattatctttttgtagggctagttttctttctgtaagttctagggtagagccagttttccttcctgtagaaagaacacagtaagtgtttacaaaatgaaactgaactgaaaatgtttattctatccttgaataccttaaaacctagtaggaaaactaggccagtaaacacgtagaacatgtttattagcatactatgtaaattttagtctagaaaacaagacatatcaataaaaacagattaaatatatacgtatgtatgtacgtgaaagtacagttaaaacacattccatattaagaaaattgttcaagtatgattaattactgtgagcattaaggtgataaatgagttattagtattaaagatgaattattaataactgattaacccattcatatttattctaattttaggaattatcatttaaggattacattttatgtaaatatcaatgtttctaaaaacttagctgatagtttgttatgtaagtgaaggagatctatttggaactatggagtttttgcctggaaaattgttttataatatattcataatatggaatattatgttatgtcataatttattatatagcatgtcatgttatatattcataatatataactataaatatatagccatatattttctattttttatattttattttattttaaggtctggtatatatgtgcagaatgtgcaggtttgttacataggtaaacgtgtgccatggtagtttgctgcacctatcaactcatcacctaggtattaagccttgcatgcgttagctatttatcctgatactctccctccccgcaaccccctgacaggccccaatgtgtgttgttcccctccctgtgtccatgtgttctaattgttcagctcccacttataagtgagaacatgcactgtttggttttctgttcctgtgtcagtttgctgaagataatagctcccagctccatccatgtccctgcaaagggcatgatctcattcctttttatggctgcatagtattccatggtgtatatgtacaacattttttttttatctggtctgtccttgatgggcatggcattttgggttgattccatgtctttgctattgtgaatagtgctgcaatgaacatatgtgtgcatgtatctttataatagaatgatttgtaatcctttgggtatatacccggtaatgggattgctgggtcaaatggtatttctggttctagatctttgaggagtcactgtcttccacaatggttgaactaatttacatttccaccaacagtgtaaaaaagttcctttttctccacagccttgccagcatgtgttgtttcttgactttttaataattgccattctgactggcatgagatggtatctcactgtggttttgatttgaatttctctaatgttcagtgatgttgagctgtttttcatgtttgttggctgcatacatgtcttcttttgagtcatgttgttcatgccatttgcctactttttaatgtgattgtttactccttgtaaattttcttatagattctggatattagacctttgtcagatggatagattggaagaatttcctccctttctgtaggttttctgttcactctgatgatagtttcattgctgcgcagaagctctttaatttaattaaatcccatttgttaagttttgcttttgttgcaatcgcttttgatgtttttctcatgtaatctttgcctgtgtctgtgtcctgaatggtattgcctaggttttcttctagggtttttatagtttttggttttacatttaagtctttaatccatcttgagttaacttttgtataaggtgtaaggaagggatccagtttcaattttctgcatatggctatatatagccacatattttcttgtctatatacaaaagtcaaggcaatcataacccaaatccttttggctaagatatttagcatgcataactttctgtgacaatacatatatgtagaaatattccattataagtctattcttaaggagaggtagttaatgaatacctaccaagcgttttttttttatgtatgataattgacatttatatactaaatatataaacaatgtaccttaattccaaagaacaatttacttttgaacatgaatgattaaatttaaattactatgtaaatcaggcctaaagttataaaacatttagtctatgttggccctcatctaatgacctttcacaattaattttgtattttttcttgcattttatgaagaattctttttgataaaatgagaaattcagtacagtgttaatgcttctcttattaaatccatgaattaagtgcagtgcttccaaatgctccaattctatgaggatgcaaatttatttaggagtatattaacagaattctaaatgaatgcttactaaatattatacattctaattcaaccatattcactagaaaatgtggcctctaggtcctgtccactgagaaactgaatgtggcagcagaagaaaattaaattttcatttcctaagagatactcttcaattatgaaatagtttggctgtcttgctcatattcatgcctgtactaaattaggcacaggtaattatcatgtatcaatttttccagaagttccataaattctccctgtacatggctaatgcatagatagggaggctaaatagcaaaataaataactctggattccccttttaacagaatggctcttttcaaatacttatatgttacaataatcagtgtgaaactctccaccttctccattttacagcattaggatccactaaatgtttgataatggtaatgatttatgtgacccatttttagcaaaggtaaaaatgtttttcatagctatactctgtgtttactcaagtgtcaattttaatggtttgcatagttttatccacagagagatattactctgaaaatgcaacttgcatttctgtattttgaccacattcttgtcctgcttgacaggtacttttacttcctattttgctagaatttatacaaacagctttcaaacactgtccttgaaaaccaaatactgcattttctcacttataagtgggagctaaattttgggtactcatggacataaagatggcaatgacagacactgaggatgactagaggagggaagacggaaagggggcaagggtggaaaaactattgggtgctgtgctcactatctgggtgacaggatcatttgtatcctaaacctcagcaatatgcaatatacccatgtaacaaacctacatacgtatcccttgaatctaaaataaaaggtttttttagctttttattttttcatattaaaatgcctttatatatattttttgagctttctctttatacttcaagttctgggatacatgtgcagaacatgcaggtttgttacataggtatacacgtgccatggtggtttgctgcacccatcaacccatcacctacattaggtatttctcctaatgctgtccctccccaaggccccaaccctccaacaggccccggtgtgtgatgttcccttccttgtgtccatgcattcttattgttcaactcccacttgtgagtgacaacatgcggtgtttggttttctgttcctgtgttagtttgctgaggatgatgctttccagcttcatccatgtccctgcaaaggacatgaactcattcttttttatggctgcataatattccatggtatatatgtgccacattttctttatccagtctatcactgatggacatttgggttggttccaagtctttgctattgtgaatagtgctgcaataaacatacgtgtgtgtgtgtctttatagtagaatgatttataatcctttgggtatatacccagtaatgggattgctgggtcaaatgctatttctggttctagatccttgaggaattgccacactgtcttccacaatggttgaactaatttacactcccaccaacagtgtaaaagcattactatttctccacatcctctccagcacctgttgttttctgactttttaatgatcgccattctaactggcatgagatggtggtatcttattgtgcttttgatttgcatttctctaatgaccagtgctgatgagctttttttcatatgtttgttggccacataaatgtcttcttttgagaagtgtctgttcatatcctttgcccactttttgatgggtattttttcttgtaaatttaagtttcttgtagattattatcaaaataataaaaatatataaaatgctgtctttaagaggtaaaggggagggtatatgcaggggagggtcgtgtagaagaaattgcttttgtattttagcagtttttttcctcttaacagtaagttctacagaaattatatgctgaattgaaattgtatttttatccaaaatataagaatctattcaagaaaaggtaagattgctgtacctattaccaaatccaatgaaataccgcaagatttatatacatagttgtacatctctaagatttaaataagattgccagatccttccatttatccatggtagcaaaaatagtttgtttcatatataaaatatttatgtaaaacacccaaaaagcacttaagtataaaatctgctacagcgtaagcattatgtgattattacctattgttaatattattgtagtttgtttagtgtacattttaagtcctggtatttacactgtgttaatcttataggtagctttatatatacttctctctaaattgagttttttaaacttgattcttttgaattttctcctcttcagtgtatatgcttccttttcagtctttactgatatagcttagatataaaaagatttttctaaagtcagcatcaaatactttaatacttggaagcagatgtaccttgctgtatgtagtatcagtctactctggctttgtagtctcagatttgtcatttgtgatcagagtgttggacatcaaaggatgtgaagtggttctctattttgtaaccagaaactatcctgatattttgaaataattgcctattaataaagcattttagtttcatgtttgtaaagaaaactacataagtcgtctgcttttttgttgttgctgttttgttttgttttgttttgtttttcttttagacagaatctcactctgtcacccaggctggaatgcaatggcatggtcttggctctgcaagagcactgcaacctccacctcccaggttcaaaagccattctcctgcctcagcctcctaagtagctgggattacaggcatgcgccaccatgtccagctaatttttgtgtttttagtagagatgggtttttgccatattggccaggctggtctcgaactcctgacctcaggtgatccacctgcctcggcctcccaaagtgctgggattacaggcatgggccactgcacccggccctgattttgttttttaacatgagtgcttttcattagatttttctacaaagggtatgattgggtttttaatccttatatgtgttatagtctcctacctaggatatatttgttattttctaacacttgttctgcaggtcttcaaacctctaccctccatatggctcttcaacttattcaggtagaaagttgcaaatgcagaaattacattgtatgcctttattaaaataggcatgccctttggctttataaaagcagtgtcatggcttttaatgtttataatttatgaaatgtaaaatctacttctaattttttttttaatttttaaaagttgttgttggaattatagtgattagtgatgcgggggctttactgtcagaaagacctccattcatatcctcattctaccacctattatctgtgtgattagagaaagttgcttgttgcttagctcttttaagcttcagtttagccttctgcagccaggagataatgacacttatctcatagggttgttcgagagcatcatggaaatcattaaataatatattattcataaaaggatttgcatagtgcctgaaacatagtaagcactcaatatatgggagataacgattatttatattaatattatcttttattaagaggaaagaaataataaataatcagtatttttcaatagtttgctttttaaaaaagtcaaggaatggacaactagagattatttactccctatcttcaactttgaacaaggtcttacaaacacctagattttatttcatttgcaacctatgtggtttgcttatgctagatattgcaaatattggaacagaacagagccctcagaaataatgccgcatatctacaactatctgatctttgacaaacctgagaaaaacaagcaatggggaaaggattccctatttaataaatggtgctggggaaactggctagccatatgtagaaagctgaaactggatcccttccttacaccttatacaaaaatcaattcaagatggattaaagacttaaacgttagacctaaaaccataaaaaccctagaagaaaacctaggcattaccattcgggacataggcatgggcaaggacttcatgtctaaaacaccaaaagcaatggcaacaaaagccaaaattgacaaatgggatctaattaaactaaagagcttctgcacagcaaaacaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtggccgaaggacatgaacagacacttctcaaaagaagacatttatgcagccaaaaaacacatgaaaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgaggcattattcacaatagcaaagacttggaaccaacccaaatgtccaacaatgatagactggattacgaaaatgtggcacatatacaccacggaatactatgcagccataaaaaatgatgagttcatgtcctttgtagggacatggatgaaattggaaatcatcattctcagtaaactatcgcaagatgaaaaaaccaaacaccgcatattctcactcataggtgggaattgaacaatgagaacacatggacacaggaaggggaacatcacactctggggactgttgtggggttgggggagggggagggatagcattgggatatatacctaatgctagatgacgagttagtgggtgcagcgcaccagcatggcacatgtatacatatgtaactaacctgcacattgtgcacatgtaccccaaaacttaaagtataataataataaaaataaataaataaataaataaataaataagacaatagatttggctgatttacagttaaggtggcagggattaatatagctatttaatcaaattacaccaattactactggaatgcaaacatacgacaccctaacatctataataatgtgacatgttatacataactacaatataataaatgatattaatggtatctactcctcgttgcatgcctcctgcatgctagcaccatcctatgatctaaccttatttaatctttccaacaatgctatgaaataggtattattattgccattttcctgtgccaaaactgagcctcagaaattaagaaacttgccgaagttcgcctggatcggtcactcatcatcacctgactagctagtgtttcatcactaaagtgtgaaacaaactaagctgcttttaagaagcaaaaagaatcccctactaatatcttccttctctttcttattttaaatggatcaggacaactgtaataccacctggatccatagccctgctatgctacttattaactgtatgaccttggttatacaggttatttcatctttctgctactcaatgttttctattacctgagaataacaaaaatacctgcttcaagggttgtggtgatatttaaattaatatctgttttatgctcttgcaagtttctggcatatactaagctccacataagtgttcaaaaataaatagtagcaataagcaaacgcatacacacataaacattttaagccattgaatgtattgtctgagacattctgtattttcttactcattcccttttttgagatggataccatagaacaattctacttcacaatcaatacctgcttttggtagaaaacaaaataaataatatcaagtcaaagtgcaaaatttagataaaatttagcactcagtttagtttgtttgatatacatgtactcatctgtcaatcatatttttccataactgtgaacctgctaagactattttccactaatcattccttttgtttaccgccatcatttccttctcattttccttaaaaccagacattagaaatgatgctaatgaaactttttgttgactatcacggacttatctctgttaagagaacaacctattgccttaaattttatatttataatctgtattaattaggaggcaacatcttagaaaaagtgaagcattttgttctaactagttgttttcacttttaaaataaaagtaataaatgcctttgcttgtttaaaaatgtatttcttcaggcatggtgttttatgtctgtagtcctagctactcaggaggccaaggcaggaagattgctttagaccagaatttcaagatcagcctcagcaataaagtgagacccacatctacacaaacaaattaaaaacaaaaaataaaagccaggtgctgtgatgtgcacctgtagtcctagctacttgggaggctgaagcaggagaattgcttgagcctgggggttcgaggctgcagtgaggtgtgatcatgccactgcactctagcctgggtgacagagtgaaaccctgtctcacacacacaaaaatatgttacatgatgcaggcatgcttggtccatgtctttcacaagaaagtttggtgatacaattcattagtttggggaagagtccatattaagaccaatatggcttgctgtggaaactattttttaagttaatattctgtttacgatcactatatttattttcattttgttttaaaataatgttttattttttcaaaattgatacacatttatatataataattcataaggtcaattaaaacaaaaataaagacccatgattcttttgtttaaaaaaactcttaagtgtactaatttacacttccaccaacagtgtaaaagcattcctatttctccacagcctcgctagcatctgttgtttcctgactttttaataatcaccattctgactggcgtgagatggtatctcattgtggtttttgttttcatttctctaacgaccagtgatgatgagcttttcttcatgtttgttgactgcataaatgtcttcttttgagaaatgtctgttcatatcctttgcccactttttgatgaggttgttttttcttgtaaatttgtttaagttccttgtagattctgggtattagaccttgtcagatggatagattgcaaaaatttctcccattctgtaggctgcttgttcactctgatggtagtttcttttgctgtgcagaagctctttagtttagttagatcccatttgtcaatttaggcttttgttgcaattggttttgatgttttagatatgaagtctttgcccatgcctatgtcctgaatggtattgtctaggttttcttctaggatttttatggttttaggttttacatttaagtctttaatccatcttgagttaatttttgtataagttgttaaggaaggggtctagtttctgttttctgcgtatggctagtcagttttcgcagcaccatttattaaatagggaatcctttccccattgcttgtttttgtcaggtttgtcaaagatcagatggttgtagatgtgtggtgctatttctgaggtctctgttctgttccattggtctatatatctgttttggagtaccatgctgttttctaaaaccagaaataccatttgacccagcaatcccattactaggtatatacccaaaggattacaaatcattatattataaagacacattcacatgtatgtatattgaagcactatttacaatagcaaagacttggaaccaacccaaatgtccatcaatgatagactggataaagaaaatgtggcatatatatgccatgaaatactatgaagccataaaaaaggatgagttcatttcctttgcagggacatggatgaagctggaaacgatcatcctcagcaaactaacacaggagcagaaaaccaagcaccggatgttctcactcataagtaggagtcgaacaatgagaacatgtagacttagggaggggaacatcacacactgggtcctgtctgagggggtaggggggcaaggggagggagagcattaggacaaatacctaaatgcatgtggagcttaaaacttagatgatgggttgataggtacagcaaaccaccatgatacatgtatacctatgtaacaaacctgtatgttttgtacatgtatctcagaacttaaagtaaaaaaaaaattcttcagtgtaaaagcacatggtttttaagatataatgtttaactcactctccattgattaatagtttttttgtgatgatatcatgagaacaggtttatgttttagagatcactataaccataaagatacatttttaatgtagtgcattttatttttgctttctctgagttgtagggagctgaaatgctaaatgtatttattgcaaaatagaatttgggtctaatttaaccttgtccatggcattgatgtgggtgggagttgcacagtggcagagggaaagtaacataaattgaccaggatactaagaagagaatgaaataaccgaggtaaatgtatgattagtcatctccagcttaaaaaaaaaaataaaatatattactactaggtcaaaggattttgaaagctactcatttacaagttttactcaatactatgatactaagtaatcatatggtaatgatacttgatctcaaaactcatttgttgtaccatatattatggttttgtgtctatatcatatattttcctacttatgtgtttaaattctattttgttatgtcaatctctttgatgccacctatttttccatgttcaatcaaatgctaattgcagtcaaaagccagttttagcataatttactctccataaagcagactttaaatatccacatatctaacactttgttcttgttccaggtaacaagatgctctaactaaatatttttctccctatgtgttctccaggttcacagtggaacaggaaattgatttaaaagatgttttgaaggctcttggaataactgaaattttcatcaaagatgcaaatttgacaggcctctctggtaagaaataaacacaaatttttaaaaatgttattccataagagctttattaaatgatgatattaaatcctctatttactatggagttctggggtaaaatatagttaccacttgccaaataaatctagcatgaaatacatttaacctctacaagcaaaactatagatatagtcttaacattaagtttatattatctagttcgtatcatatctttgacaatagattatattctccggaagacctgtcttaaacatctttggattccccatcccatctgacataatgccttgtagaataggtaatcaataaatgtgttgattgactatctcaatatgtcccattgtagtaaatcatgtaagaaagaaagaagggaggataaatgagtgactgctgtgagagctagaccaaagatcctttttaaaagaataaagaatacccagtgagatggtataaacatgttctaattctttaataaaaaaataaataaacagtgggctgggcatagtggctcatgcctgtaatcctagtactttgggaggctgaggtggggggatcacctgaggtcaggagtttgagaccaacctggtcaacagagtgaaaccccatctctactaaaaatacaaaaaattagccacacatggtggtgggtgcctgtaatcctagctactcgggaggctgaggcaggagaattgtttgaacccaggaggcagaggttgaagtgagccgagattgcaccattgtactccagcctgggcaacaacagcgaaactctgtctcaaaaaatagtaatgataataaataaataaataaataaataaatagtggttttaaagaagtaacttcaaagtatacctggcacattggggtgtctagtaatttattttaaatatcccaagaaaaaaatccaattgaattatttgattcaaataccctatttttttcagagtaaaaaaaaaaatcacaaaatattagccatgttaaagcatttataatttgtaaaatactttggaagtatttttaagtagctaaccccaagaaatttgccatcacaaaaaggcaacaatgaacttaagactgagtaaataagttatataaggattatttttatcatttccttagaagagagaaaataaaaatacaatctgttttctgatgagataaagatagatatatattaagataaaagaaactcaacatgtaaggcctctttatatgcaaattatttaacccaaatttccaaatagcactgagatgatagattccttagcagttcctgtgttaaaggagagaatttagttttcttagcctgaagcagcagcctatagagaatcaagctgaccaaactatagcttctaaacctggagtgtgagggcccatagactgaattcagagaagctgatgccctccaacccttgaaattgcatataaatatgtgcacacaatgcatctgcacatatacatgtaggtgtgtgtgagagagaaacagtttggggggctcgtattaatagctttcgagaaattctcagtgtgtctgtgatgaaaaaagcctttgtcctcccagatttaggattgaacgtgttgttttctaaacagcactcagcttctagcaatgagttgatactaatgtatttggtacaacttctacccctcgttcagagagcttacagccctaaacactaatagagcttttctaaatgtctactatataaatgttcctgtccacataagagaaatgagctttccctgagtaaatgttttcatggcttatatccaagcttctagggctctgaactcttcaatggggttatcaagaatgtaggactggtagagattcaaaatataatgtggtatctgtacctgagtcagaaatatattcatggctgaagcttagcataatttaacattgtcattctctcttctttaggaattgagagaaatctgtcttaccatactggccaaattccaattggataattacattgtactttcttaacgtggctctattttcagtttgattagtaattcctcactgtctcacccaaacatctaggaagttatttcaaacaaatagactacctgctgcctctcagtcctgacggagtagcactgcagtgggaaatcaattattgtggtcagtgtagcttataatttctaacatatttggaaggtttataaggtaatatttaattgcctttgcagagacagagacaatagaccataaatatgcattatgataacagatggtttagagattggaaataacactagaatcttccagagaattaatacattctatatgcaaagtatctgtttgtttgatcaaaacttccgtgggaattgaatccttctctgtgtcctactcacagttgtattcctggtaccttgtaaaaaactgacatatagttgacacacagtgaatgttcactgaagggtaaaaaagatgaggggaagaagacaagaggtttatttggccccacattacatacagtctaaggactatttgcccccttaaacataagtaaaaaaatcctggatttgccattctcaaataccaccccattcaggttttcaagatcacttgataaaagatctaaagcaaacttcccagtctttcagtgggaattctttgattattacattattagttttgccagagtctaagcagctccagtatgccatccaccctaaccaatatatccttacattccccatgccatgcacacacacattaatttatgaatcattcattcaaaaattattgttttaattataaaacttgcccctttttttcctctaaattaatagcatttatctcttcatcatttatttgagcaccatatgctctgctttgtaaggttggtatcattttcatatgtctagttttttcctctccaaataacataaccttgatgattaatgtctataactcttcataacccccataaatacccaggaaaattatttgcatgcattttgtttctactttaatgagaatctcatggtgtttaggatatataaaggcttacctcaatatattacaggtttggctctataccactgcactaaagtgaatattccaataaaatgagtcacatgaattttttgtttcccagtgcatataaaagttatatttacactataccatagtctattaaaggtacaaagacattatgtctgaaaaagtaaagcatataccttaatgtagaaatactttattgctgaaaaatgctaatgatcatctgagccatcagtgagtcataagctttttgttggtggagaatcttgccttgatattgatggtttctaatagaccagggtggtggttgctgaaggatggagtggctgtggcaatttcttaaaataagacaacaatgaagtttgctgcatccatgtactcttctttccatgaacaatttctctgtatcatgcaatgctgtttacccacagtacaacttctttcaaaattggagtcagtcctttcaaaccctaccactgctttatcaactaagtttctgtcatagtttaagtcctttgttgtcatttcaacgttgttcgcagcatcttcaccaggagtagatctcatctcaagaaaccactttctttgttcatccctatgaagcaactcctcatccatttaaatttgatcatgagatagcagcaatctagtcacattttcagggttcacttctaattcaagttctcttgctgtttctaccacatccacagttacttcctacaatgaaattttgaaactgtcagttataaaagtcagaatcaacttcttccagacccctgttaatgttgctattttgatctccttccatgaaacatcagtgtttttattggcatctagaatgctgaattctttccagaagattttttctttgcccagattttggatctgggcaaagaggccaggaattcttcctaacatctgcaatgcccaggagagctcctccacaacaaaggattatccagccaaaattgtcaatagtgaaaaggctgagaaatcctatactggagaaagcatgtggaaacagagaagaaaaaaaaattaaaagacagaatgggaacatattaggtcaaaagacagaggagtcaagcatatgaaatggctaaaaaaaaaaagaaaaagaagagaaatgaaaagacatagaacaatatatgtatgtatataggcttttaaatggctagaaaatatttgaacaatatcttagaaagtgataacggcagttgcctctggaacacgggacagaggctttagatgaaagaggagttttcatttcatatactgctctgtagtgtttggaattttaccttgtatatgtattgcttttttaattaaaattgttacttaaaaattagaaaaaacttttaaaaaataccattaataggccaggcgcagtgactcatgcctgtaattccagcactttgagaggcctacacaggacagtccaggagttcaaaaccaccctgggtaacataatgagaccttgtttcttatttaagaaaaagtcattaataatagaattaattagcaaatttgaaatcacccagagaataattcagtactatcattatattgttactttcttaaattatgtgataaaattgtatctttcttcaaaaatagcatatgtgatttagcagtggggaaaaataaaacctgctttgctttctcttgcttctagaaaaacggagtgacttgagatcttttgctaagacctctcaagtccactctttcattttttattccatggcatccactcttatttgagactctcattactgctgttgtagactatttcaatagccttctaaacagtttccaatctctctccaatctaatctattttatctgccactgccaagattaatcgccttaaaaacttactcttagatcattccagttcctgttcaaagccagccttcagtcacctgtgccccatccgctgctcagcagggcattgagaccaggcttcactctggttgattccatatacacaactcctgcccagccaaactaaatactcactctgtgtctcacctgtccccagctctctgcctttgtgaagtctcttccacaagaaaaatctcctgcactgaacctcagctttaatatccccaatttcatcaaggcatcatgactacaccaaccagaagtaatcgttccttcttaaattcctgataccttgtgcctttctttatggcacatatatctttttatctcatattattgttatttatgtgtctaatattccctgccagaatttaaaccctccaagattgattcttacacatgtttcctatagtgcccagcactgtgctttctgcttaggacctactgaatgaagaaatgaataaaatgagatgctcgatatttattacatttattttttatttcaatttgatatccattgcttttgttggtaaattccattaacataaaacacagtaaaggctcatacaataaacatggattatagaaagtgctgagaatcattttcttctcaggctctatttaaaatgctcatctacttgcagcgaggatcctgttatagagaaggtctatttttgtaatggaaatggatgactgtcagcatttggattaatagataatcctcttggaaggtgtaaggggaaggagaaagagagtactaaatccttcagcatcaagtacaagctttaataaaggagccaataaaataaaggaattaagaagacacaccaaaagccatattcaggtcagactcaagtgctgttgatttatgctggacctactcttaccctctgcccttgtttgttctctttcttcttgcgcctgtaaactacaaggctctatttctctcattgccataattccaattcttctactttcttgcctggattactgcaacagctaacaaagttcatcttcctgcccccagctgtttgcttatctgattcaccctgcacagcagctgccacagctatcttctaaaatcaaagcattgtgtcccattacttctggacaaatccaggctctctagcatcatcgtcaaagctcttaaaattatgtcctctcctactccccaacctcctcatagctcaggctccagctggaccttcaagagatccccactggggatgtaaagtttctctcactttacaaatggaatcttctgcttggaatgtccatcttgccttctctgacttttcactcttactaattgtttaagagcaagttgaaaggtcgacacatcagagacgtttgacctgacattcctcttccttcctaaatggtttacttttccttatgtggaatctggtagcactttgcacacacctctgttagcacgtttcattttctcctagactatttgtttacatacttgtctctgagctcagagctattcaaaagcatagacatctttctgtccccagaacacagaagagaatttgtggtgggggacagggtagataccgagtgggtgagtgttgtgagtaaatttcactgtaccccacctggctacaagcatggggacttctctcatacttcctgccctccccactgcagccacacagccccttctttgggtccttaagcatgcccagtttgtatctgcctctgcactagcttttccttccatctgaaatactctccctttatttcttccagtggctggctcctttgtattccttcattctcagctaagatttgccctctgagacccacctttctgaataacctgtgtcaaatagctcctcttcgctgccccagtcactaaccaacatatcaccttatcttgttagcttagttatacttactataccctgaaattgtagtcatttattgattcacttttttattgttcttttatttgatgtctgctttcctctcattaggaaggaactatttagttcatcatagtatacctggtgcatctggctcatagtaggtgctcagcacatgaatgaatgaatgaatgaaccaataaatgaatgtttgctggttttgtaaaaaatctatccagaaaagcaaacaaagaaacattattcctatcgtaagagaactcaaattctaggaacttttataaatttcatgggtggggctgaagctaaaaatattttggcaactaaagcacagagacacttttggtatgctagggttctgttataatactctcgtcattttgttattttaagcatgccgttcatgacgcagaaatctatttaaattggctgaatttaggaacagtgccacagaggaagtagtggcctacacttgcatgatggctatcctgcaagcatgatgttaatctcagatacttagagcctttggtgccctgcacaataccgcatatgtagtgggtactgaagaaatatttactaagtgactgaatgaatgcctttgtagtcttgccctgcttttttcagaagagcttgaattattgcccagttcttctctgggggaacctagggtttactggccctgttcccatctcatccattgtaaaaatcctggcctcatgctgcctggaggaaagtaggaccagtcatttggcagcactgtctgctgtggccagaaggaaaaggctgcttggtgccagcagatttaaaaacaaaaaactatttgcctttgcttgattgtttgagagaatagctaacttttctctaaccaacaagacaagctcatcagtgtaagtctccttcatacccctttgcattctgattcaatttatcaaatatctgagtgcatacctggtacccggcagtgtgcaaggtgttgtgcataagataagtagaacaggcaaagtccaggccttgaagagtgtatggcctagcaggaaagatggtcttgattgtctactgcatgacatcgcctgtttctctgcatgacctgatctacttctaagattttgtggctgcagacacatgcttgcttagaccactttctggttatattttattttaatgagactgcttgaagtttgtctcaagaaaaaaaggcttcattttctttttttccccttagtacctgtgatgtgatttctttttctttttttttctttttttttcttttttgtgagatggagtctcactctgtcactcaggctggagtgcagtggcacaatcttggctcactgcaacctctgcctcctgggttcgagcaattctctggccttagcctcctgagtagctgctattacaggtgcatgccaccacaccaggctaattcttgtacttttagtagagacggggtttcaccatgtgggccaggctgctcttgaactcctaacctcaagtgatctgcctgcctcagcctcccaaagtgctgggattacaggtgtgagccactatgcccggccttcttatttgtccattttcttctacttatgtatccaatgggatggtgtttttctgaaggctgattgtcttaaggtctcatttacaggtgtagacatttgctatccctcatgtagcagttaatcatgatatgggaatccaaacgttgcattcaatctttgctgtctttgaaataaatgcaatagcactagtctgctggatcccattctccttactcttttactcaatcagattttgaagtcttttagcacgtatgtggcctttgcactttttccctctctgctgctgttgtcaattttcttggaacgtctactttagattattgtcttatgttttatttattacaagaataaacttaaaaagaatttgtttttgagacagggtctcaccctgtgtccaggctggagtgcagtggtgcgatcttggctcactgcaacctcaaccttcttgagctcaggtgatcctcccacctcagcctcctgagtagctgggactaccacgcccagctagtttttgtaattttttgtacagatggggttttgccatgttgcccaagctggtatccgactcctgggctcaagcgatcagccccaagcgatcagcctgcctcagcctcccgtagtgctgggactacaggcatgagccacaatgcccggcctattacaagaataaactttataaccataattatgaacagagttgtggtcatagtgcacatcagatgacactgaaagactttatatacccaaagtcttataatatgaaatagttaaccactttcgttcaacaattactgaaatcctgtctatgacagtatactgggttaaagactggaaaattgaacattaccaggaaactccctctactagggttagctcattctttagaccctgctatatgccagaagacaaggttactaagaaaaatgacacaatccttgccttaaggaagtagactgtccaggaagagggaagcatcagtgcaaatatgacatattagaaaggcttcaatagaattagtttctgggttcaataggagagtgatcagatctactttagtgatttaggaattagaggagagcagaaaaagcctcacagagctagatgctgagcttctaaactagattaggtgtcttactatacaacaaaagttgagggagcttctagggaaacaaagatacagaaatgacaaagcgtgctatgttgaggctgtttcagttcatataatttgaagcacggcatatggggcaaagaatgctaatggaaggaagcaaaggcagcctgatggaggtccttatagtttatactgagcaggtatggaggtttgcaatatactgaaggtgaggtgagagggagagcaagcaggagaggggataaaatgttttaagtggagtagtggcataatttgatttgtattttgataagatcatcccggaggaagctttaaggtgaactggaggcagtcaggagagcatttctctactgctgagtcatgacacactgtaacatccattgaaattcattcaaaaagatgatttgtatatgttgctaagtttaattttctgatttctaaggaattttatcttcacgctaataggtgagcttggtctatgattttctttcttatattgttgggtttttttcattttttacagcaaagtaaaatatccacagatgagtttgatagcttttattctctttctaatgtctagaacggttttacaacaggcaatcctatctgttccttgaagatttggttaaaatcacctagaaaaccatctaggcttggagtctttaatttcaaggatggagaaagtttttgtatactgattcaattactttaatggttactggattattcaaatattctatttttttccttgactcaattttatttttatttatttatttatttatttttatttttttgagacagagtcatgcactgtcgcccaggctcgagtgcagtggccggatctcggctcactgcaagctctgcctcctgggttcacgccattctcctgcctcagcctcccgagtagctgggactacaggcgcccaccaccacgcctggctaattttttttgtatttttagtagagacggggtttcaccgtgttagccagggtggtcccgatctcctgaccttgtaatctgcccacctcggcctcccaaagtgctgggattacaggcgtgagccaccgcgcccggccaaattttataatttacacatttctataaaagagtctagctcatggtaaatctcttcattttcaaaattattcgcataaaaaagaacaaatacttttttaggatagatggaaatattttggttgtttgtttgtttgtttgtttttgagatggagtttcactcttgtcacccagactggagtgcaatggcatgttctcggctcaccgcaacctctgcctctcgggttcaagagattctcctgtctcagcctccctagcagctgggatcacaggcacacgccatcacgcctggctaatttttttgtatttttagtagagacggggtttcaccatgttggccaccctggtctcgaactcctgacctcaggttatctgcccaccttagcctcccaaagtgctgggattacaggtgtgagccaccgcgcccggccaaatattttgtattttatttgtggagaaaggttcacagatatatgtatatctatcaaaacttatcaaatcatgtataatagatattcatagtaaataacttataatctcataaagttaattaacatttactgcagaaaattatacatagtattttttgtgataaaaaattattttccatattcttgggtatgttctttttttgctcttaatattgtttatttggacaatctcttcttttttttaatgaattttgtttaaaagtttgtccagttcattatcttttaaataactagctctctgagaataacccttagcatctttgttttctttctctttctgccgtaagtaccttgcaatatccctgccacaactaccaccaccatcattttggtggggcaagtgcgaacaggcaataaagtaggtgactagaggatattacaacatttgggacacaggctagtaataaagggatgatttttcttgtttcaaagtgcctactgcagccagctggtcaagcctcatagctattggaggcaatttcctatgtgcaaattgatgtagttggaatattatgtggtgtctttgaggagaaccccttttagaattcttcagaagggcttagctgacaatgtggatactcattaccctgtaggaactgggttctagcacctttgtattcaaggtcatgatattggctcttgatgcttaactcacagactgatgaaaatgggcagcagaatctgaaaataatacagcatcaaatagctgctagttaatatattttactgtcttaaaatttattttttaaatgttttcttttttattattactattttaaaattaaaattagtattattttattttacatagagatgaagtctcactatattgtctaagctggtcttgagtttctgggctcaagtgatcctcctgcctcagcttccctgagtgctgggataataggcatgagccactgcgcccagctactgtcttgaaatttatgtgctgattttaccaactaaatatattcggttacttaacacaatttaaatttttcttaaaaaaaacactactcttttggatttgagggagctaattatactttattactaaatgtgaaaacttgattgcttttttatttttcttctagtcaacaaatacattctagaagaaaacatcataatatgtgaaatggactatttaataatgcactacttatatcttaataccaaataagatctgaggaagtaatattcccattaaaagtatattcagagatgccattgttagttgtcttggggcttattcaaagtaatcaggtcctctgtaacagatgtaccaaaatgttgaaaatccttccttatatgtacaagataattatgtgcttttcaaagcttgaaggaaaatgtattttgtgggtagaacttgatacttacaaagtctaactaagcaacctaatgggaaatcaattgtgcttttaatgatgctggacatcagcaacaaagttatttatctgaaatctgaattagatctcctggaattgaaagaggggttataaatttgagtaattctttttcttactctcctgtgctctttcgaaaaatgtatttgaggcatcttttgtttgttttgtttctttcttagggaaaagttgaaaccccaagattgaatgccattttatggtttgctagggctgctgtaacaagtaacaggctgagtggcttaaaaaacagaaatttattttctcacagctctagaggctgtaagtctgaaataaaagtgtcagcaagttggtttcttctgaggcctcccttcttggtgtgtagatggccgtctgtcccctctatcttcacgtggtatattagtcatatttacatgatggcagtggtggcctgtctggagtggccgctcccatgaccccggctacagcaagggagggaggagcagccagggcttcatgctccatggagccagcaggagctgggaagaagtggaagcctgcccccttctgagttggagaggcgggagcccagccaacctgggcacagctgctgtggacctgggcatctctgcactctccaggcccaggaagcccctgcccactgcaggctcagaagtgcctgctcctactgcctggcctctccctgatcccggagaccactctgatttctgagcaaagttgtggcccagtccaggtgctgtcatgagctggccgggtgtgcacatgcctggggcagtgctgacacatcaaccccctgccgactgggccccctccagactttgggcactgatgagcatgggagggaggccaagagggggctaaaggcagctcagtgcaggcctgcaggcgccgctcagcacggacagcctggatgccatgggtactgtggagggcaggccaatggtggcaggaggcagacaggctcctgggtggaaaggggagggtccccagtgaaaccccaccttcaggccagggatgacctgaggcctggggtccaggctgccagttctgtggaccagaatgagaacttacggtgctttttccgcgccacctgtggccacccatggatcaatcagcacatacttcctcccctctgaagcctataaaaacccccaaactcagtcagacttgagcagatgacaggatgacctgcctgcagagaggagctacccactgtgggtctcctctctgctaagagttggacactcgttgggacaacccgcctgcagagaggagctacccactgcagttctctgagctgttctgtcactctataaagcacctctttgccttgctcaccctccacttgtctacatgcctcattcttcctggatgtgagacaagaacctgggacccaccaaatggcaggactgaaagagctgtaacacaaatagggctgaaacatgccccttgctcgccgtgttgtaggcagcaagaaggagagaagagagaagagaagtgccgtggcccttcagggagcccagacctagtagctcccgagccagggctgtgacacccgctttgaagctctgcggttcccggtgtctccaagcttccaaacgccaccacatttcctggtgccagcagtggaagctgcttgtggtacttctggtccagctgcagcctagcagtgagccagcatccatgccagtgcctggagctgcctgccccacagtagccagagtgcctgactgtgtgcagcagacagaccccatgctcgctcactcacatgcctctcaccactccacacctggctcgcccttggcaagtgtgggatccgggctggtagcacaagccaagtgcagcctgccaggccgagtgggcacaatgaacccagcaggcctaggcaaaactcaggcaaaggcaccactggcaacagaggtttccagctgatgaagcgacaccccaaggatcctgtaacatatgtatgtgtaaatatacaaacatatatacatacataattagtcattatatacatatttctgaagagagaaaaattttaaggaattggctcatcattatggaggctttggatgctcaaaatcttcaggtagagacctggaaaaaaattgcaacccaaaggcagcctgctggcagaattcctccttgcttgggaagggccagtctttgttttattaaagccctcagctgattggatgaggcctacccacattgtgaaggtaatctgctttactcaaagtctaccaatgtcaatctcgtctaaaagcactgttatagaaacatccagacagtttgactaaatatctgagcaccatggctcagccacgctgacacgtagagttaattaaccattacacagggccttccctctgtacctgtctgtgtccaaatttcctctccttataagaacgctagtcatattggattaggacccaccctaatgacctcatttaaatttaaaattctgtctccaaatatagtcaatctctgaagtactgggggttatgactttaacatataaatttgtgtaaaacataatatagcctataacagccattaccttaaaacaggcataaataggaagggaaaaacagtcctcctaatgctaaaaatgtgttatttcctcttatcttaggataaaacgtgtttgtgaatcctcagataaaccaattaattgtaatggaaagtaactttttcataaatttacattatgaatctagaagtcaatttcatttttctttgccaagggtatttacattatcatagtaattaaatattaggttaaaaaaggaaaaaattttttattctggctgtttctgaatttttacttgttttcatttcatacttttatatttaaaattaaagagcaatgtgtgagatattttagtcttgacttatgaaataatttgaagtcactagtaaaaaaagtttccactttttctgaaaatataagacatacatatgggaaaaccaccaataaaaacagaaaagaaaattagcaaaagaatataaaatgagggcaaattaaaaaccacatcttcaatggttatctcattaatgaaatcttttaacattatctcctaggttttcttcagtatcccagtctcttagatctctaaaatccatttaacaaaagggcaaaatattttcctatctctgaatgaaaaaaaaaaatttctgattctctttttgcagataataaggagatttttctttccaaagcaattcacaagtccttcctagaggttaatgaagaaggctcagaagctgctgctgtctcaggtactgtttgctagaatcttctcccctcttctagatttgtatttttagagcaatcttgagtggggagtggggtcattttcaaaatgaagccaaaaaagtcactctgctctaacttagaagtcaagcaaatgctgaaccagccggaattttctaaatagaatgtgaagtgtgaactcactccagtgcccctttacagataactctcatcttcattttctctctaatgagagacaggaggacattggcagttctgcgaaaatagattttttctgctgtgctgcctgtttaaatattttaaatattttcctgctacccatttaaacatttttcttcctaccaaattatttgctgaagttgattcttaattttgtcagcaaaaagttcttattttttattttcatggttacatggcaaatgtatatatttatggagaatatgggatatttttgatacaggtatgtaatgcataataatgacatcagggtaaatggggtattcatcacctgaagcatttatcatttctttttattacaaacatttcaatcatacttttccagttatttttaaatgtacaacaaattgttgacttataatcactttgatgtgctatcaaatactagatcttcattctatttaactgtattttcgtacccactaactatcccaacataccccacctctatcactttcatgataggatagtattttccgaagtaaataagagcatagtagcctcaggcatcaagacagcttgaaatcttacatgtaatctggactttcttttgacaattaactatactgcagcaagtatatatcatcttataatgaggatctcaggggaatttagtagcccagtcataggatacctcgttgtatctctcactgttatattttccctttaatcactgccatcttgaccacttactagaaacctggtgacttcctatgtaaaaatacccgcttcagacaaaagaaataatgatttgaaaatatagagaaactctcttcagtttttgtttggggatttttttctttattctcccccttccttttactcaaaagtcattttagtaaagacacacatatttatgtgaggctgagaataaacatttcataacaagcagaataaattgtcctattatttttaatggagtagaaggaagaaattgtttgtttgttttgtttgtggtgtgtgtttgttttgtttcgttttgctttttaaaaagatcaagtagaaatgttaacacctttataatttttctccagttaagtctttaaaatcttgtttcctgtaaattgttgtctttgcattaggtggataggcatagatggttttgaggaattactcattagtctctgcacatccacagacatataattactttttatctgcactgtaggaatgattgcaattagtaggatggctgtgctgtatcctcaagttattgtcgaccatccatttttctttcttatcagaaacaggagaactggtaagtttattatgaaaacaaaattttatttaataggtcacaaagaacctcttttttaaatggagatttttttcctcagtactcatcatataatttcttttcacaattttatttatttattctctttccagagattgaccaactgaattatcagatagtttataatgttgaaatgattttttttaatgaaaataaggctggtgaggtggctcagactttaatctcagcacttcaggagttccaggcagggaggatcacttgaggccaggaattcaagaccagcctgggtaacatagtgagaccccatttctacataaataaaatttttaaaaaattagccaggcatggtggcacatgcctgttatcctagctactagaggtgttgggggtggaaggaatgcttgagctcaggagttcacagttacagtaagctctgatagagccactgcactccagcctgggcatcagagcaagagcctttctctagaaggaaagaagaaaggaaaggaaagggaaagggaaaaggaaggaagagagagaggaaggaaggaaggacaggaggaaggaaggaaggaaggaaggaaggagaaaataacatattttcattaattgtaagcaagaaggaagataaatattttattattttgttcaccccctcttttgtttacttctgaaccaatacaggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatgtg

SEQ ID NO: 638 - DNA, 17422 bp, Homo sapiens
acgcggccacgtgttggtaaccaatatacagatgactgggtccttcccagtcccacgcgtttactcgatgaaggcagcctcccgccgggctcctggccccgcccgagccccaccccctgctcccttccggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttggtgagtgaggcgccgggcgaggatgggggaacgtttccgggggaggccgccaggcccagccggcgcatgtgggcgggggtggtaccgggacttcccggcccgggggacgctgggaaggggcgcggggcacgtaggggtcgagcggtcccagcactttgctggtgtagcttgtagggcctctggcttcgcattccttcattgaaccagctgtgctaacccagggcttggctggagagatgaaagaccaaggctcagccgtgcgctgagggggcggagagaggtggactcagctggtgccggggaacagtgctgcctgggaacccttgctcacccgggtcttcggagtcttgtttacccttccgtccatttcccctttccttctttttcctgtacccgaggagcggtggacgtcacctaagcactgggactcaaactgcaatcttttcggacctctatctgcttatctgtgaaatggagttagtcctcctactcctcacaggggcgttgggaatatctaatgatgtaatttaggagacagtgcgctgtaaacgacggtgttttgccacctaaatgggtggtatttgttagggtgaagggcatatagtaggtaggagcctggcgcaggagccaggttgtttgggtttgaatactagctctaccctttgctggagcttgaaggagtcattgaacctttctgtgcctcactgatctcactttcaaatggagataaaagcaccttcctcatagggctgtttggggggatgaaagagttgataatgtagagaaagcatttggaacactgcctggcatggtaaatgaacactcaaatggaagctgttatgaatattaaatacgtagctccggggcccaagggagagaatacagtcatgggttctttgtttccggttgggctggtaaagccctttcctcatccctcttttcactagagacaaactaaaaaccatggctttaagctgcaaaaagcctaaaacaaaacagaacagaacaacaaaataaggcgggttggacaagcttgacttagatcatcacatcccctttcccatatatccatcctacacactttacagattatcccatctatccttcctacacactttacagattaatcttccctctttctctattcaaaaattctttaacaactcctattaggcctgggaaattcaccaactcactacccatccccgaggcagcccattctgtcttcaggtagttgttgggacagtaagaaaattcttgttaggtagcaaccagcctttacttccatttagaatgctagtgctgcctttagagccataaataacacatgaactacatcttagggacttctacagattttcagactaggaagcatctgctgatgagcacccggtgttcatcaaataatacgatttccagttactgtggtggtttttcttttctgaatatgtttgtgtctctcataaagtgatatccaaacacagaagccttgattttgaagactgtgaatttattcattctgtcttgctttcgggcatagcgacatggggagttagagagttattacacatgttgtgacatgtgccctaccttcaaggtgggggttaagtgtacacatgaggcgtaagtgtacaccaaatgactgacagcaaagtattcatatgaaagattattaaaccatgataaaatgcaatgcaaagatacagcttcttgttttacagatgttctcttaatgatttcctggactttatatcatctgttaccattttccaacttctcttatacttagaatccttacgttcttacagttgagactgattacattagtttttgattcctttaaaacaaataaggaaagatgctttttttagtgtgtttttaatataatatacttactgtagaaatacatactaaatcttattagatgtctctgcttcagacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggtgaggaagcccggtaggtgagacccaacctgttcacttgaaaatgtagatcacactgccacttactatattgctatttatggaaatctcgtggaaatctcagtaaattacttgtgttttataggcctatagcccacagttacatgtgcactttctttttttttcctaaaagcatttcagcatttcaaaaagtaatttttgttagaaaagaagtatgtttagattctttcccagtcttgtttctaataggcaagtaaacattttcttcattatatacaatctataacaacagtgcctttgcccagctcaaagataaagtgatttgagcaagacaaaatgttggacattaagaaacagttccctgggcataatcagaatgctaaaattatttttaaaaaaacttgtctacttattatggggtacataatctaattggtggtatgttagagtaaatgggtacatagcaagttgtggtgtaaactggtttcatgtaatgtttggagcttaagacaaaattgggccctccagctcaggggctataccatagagtagagcctctcttaagctggcttcctgatatgctcattcattcattcacttaattctgcaagtattttctggaagttcagaaggctatccattgtgtgacagggctaccttgcaagtgtttttgaactttctgtgtgccaggcattctgcttagtgctgtgtatagaggagtgaaaaaggtagacacagtctctaaccttatagatgcatgctttctggttagttttctacccctagtacttaaagcaaacagggtgaagatttcatcaaagaaagatctgggaccatggtctttccctaaattttccattctagggtggcttttatctttttcggagtctttttgatccaaaagcaagcttgctaaccctcaaagtgaatatatttctccttctagcttctgggttgtgaataatcaccccgtcatcaaaatttggcattctctagtctctctctcttacgtagctctcccatccaggcagtccataagacaaaacttcctctgcatctggtcccctcttcagttctggctgccattttcctttcttagaccttgtcaacttttagttgtcttactatcataactgatgtttcctccttcagcttttcctaagttctggcatattctaaatattaaaaccaggttaatcatctgaaaacacaactttgatttttagtcgttctccattgtgtcctgagtaaagaccaaacttcttagtttggcttacgagatctgtgatctggcctcttcagtcttcttagttcgggcttctctcttgcgttcagatagattatattccagccaacctggactcaacacacctgcatgctcactatgtttgttcctgcttctgagtctgcttacctggtcctgtatgtttagaatgcccagcctcaccatgtctgcctgttaaaggccttcctatcctctaagtcccattttaagcctttctggcagtgataatctgtgttatagtaatctcattttaagttgtatttttctgattattactgaagttgcttttttttttttttttttaaattcttggctatttgggcctcctctttgtacttatagcatttaatatagtctgtgtcatggtaaagttatttgtgtatatattttatattccatgtgatccctgaagtaggaaacatgttttatgcttatgttactgctgcagctgctattaccacttctactactgccttacaactgcttaatatttcacagttttcagagaactttcatgtaagtactagaattggcctgtctctaaacattcccctaaatggaacacagaaagtagttttgattcctgttctgtggagtacatgtagggcatgctggcagataaagtggtattagaaacttccctatctctagttgctaaaaatctagtagtaaaaataggaagacatgtaaaatatttaattaaatgctaaaataaaaacagaccctatttaaaattgcaatcttctcagcactccctctctgccttatttgtcttcatagcacttaacaccacctgccattgattgactgcctttctctcccagctataatgtaagctccacaagggcaatgtattttgtcccttttgtttaccaccataatccagttcttagaacagtgttcagtaagcactcaataggatttttaattttttttaaaaaaagtaagagccatgcatggtacaaaatgctgtaggaattctgtagtcctcaggaataacacacaaagggcagcatgggactgcatctagacagatacaaaaatttggatgggcattgatactggcaacaagagtatcttgccagagctgcaaatatacttctagaaattgaaccaaggttatggattctgttttaacagcggttttcaagaataatggagggaacaatccttaaattctttagggtcagctcctatctttttcagttttcaagtctggacaccatcctttgagggaggtattgacaaacccagatggtaaagcacttggaaaacatagtaagtgaactgcggttcaaaagagaaaaaaaacccaagagagagaagggagaaagagagaagatgcagaggaacataagaacaagcttcatctaatcaaagaatatatttgttcagtgattaaagccaatcgttttcctcatctctgtggtactttatagactgttgaaatttagtagttaataattttctatcttgttttaatagtttcactattaaaaatcatgttgtcggccaggcgcggtggctcatgcctgtaatcccagcactttgggaggccgaggtgggcggatcacaaggtccagatcgagaccatcctggcaaacacggtgaaaccccgtctctactaaaaatacaaaaaattagcctggcgtggtggcgggtgcctgtagtcccagctgcttggaaggctgaggcaggagaatggtgtgaacccaggaggtggagcttgcagtgagccgagatcacgccactgcactgcagcctgggcgacagagtgagactccatctgaaaaaaaaaaaaaaaatcttgtcttagcaaaattataatcttgagaataacctatactcgttttggtcccttttatgacatcaagctcattgtggcatatactaatttcttaggagtcacctgattttaaaaatgtgtttggctggataaattccaaatttgtaactagaagcaattgcttgcgctttggatttctctaccctgaaaaaaaataaggtattctgtgatatttagcatatttccatactttgaaaatctagaagtctttgctttcctggtcataatcagtgaccctgtctgcattacatacacatgaatttgaactgctcttcttctttcaggttgagcaatgtttaaagcgtttgaaaaacatgaatttggagggctcaattcaagacctgtttgagttgttttcttccaagtaagtaagtggtccagttgctttgtgatgtggtgggctgggaactcaatgtcttgtgatctccctttggatttctctatgcttgctgttggaatataaccaattatacctcagctgtataaattttgttttaatgtggggtacctggtgtttgtggtaatcttctgacattgatctatgggagtgactggtgtgacattgaaatctgggtcatggtagattatattaaaacatcagtgggctgttattgtgcttaactacctcaagttgagcttaaagcaagtcttcacttgaaaactgctatagaaatgctttatatttaaaaatgaaagtaatgggagcttgcacatagctgaaaatgtgaagggtcgcccagggaggacatggaagctctgtgcttcttctgccataccttgccctatgcatctctttgtttcaatcctttgtcatatcctttataataaactggtaaatgtaaaaaaaaaaaaaacaaaaaaaaaaccctttttttttaagtgaaagtaatgtactttttctatttttttcaagtgaaaatcagcccttaactaccaaagtatgtgttgtccccagtcagccagtggtggagttggtgttgatgaaggttttgggagcctgcaagttgttgctccgcttgttggactgctgctgcaaaacttttctgtatccttgaatatcttgaaatataccttcttttgatttggaattgtttggatatttttaacagtatttttgtttgaaagctaacactccataggagttacaacctacaggaattcttaaacttttgcttcttggcctccttttctcaggaattgcctgatgcagccattgccagagactgcctgtcactgttcagcacgtattatcctaagagcattgatagctagaaattcttaatcttagaaactaaactttaagaactaaatttaataatgggaactctagcagagtgtttataaccatattttaaagttttaaattcttaaatagaatgtgttttaaggctttaatacctttaagaaaattctctttacttccaatatatttcttcattcatgattgtaacttacaaaacccacattactttgattttgttttctaccttaaattgattttccagtttgactgtgaaacatctaggtttgcaagagttcattattttaaaccttgtgatggttgggctggtgagcaggttatggtatgtacatacctctgacatccttcatttctttctcatctcctttcagcctaggtttcttattagtagttttcaaacttattttcttatggggttatggaaggtgcaggtattctctttcttggtttgatcagagttttttgagggtagattgggaagccgagtgctgatggctgtatcaaaggagtaggctttgtatctcaatccacaagatcagcccaatcactgaacaactaaaaaaatcgggagtgactggtgtcacactgaaatctgggtcatggtaggttgtagtgaaacatcagtgggcttttactgaacattaaaaaaattaatgcctgtgactgggaattgcagtaataaaaaattgttggtagtagtcatattgcaacaggccgtttaaaatgatgctaatcctgggctggctgtatcacttgattctttctgtcactcggtttctaatttttaatggcaatgataaatgcaatttttgaccttcttatgtgctagactattttcttccatctcaaacaccactgcttttttgagcatatttagttgatgtatgctggtaatacttggaaactaaagagacatctctttcatgtctctcagtacatattgtgaaactgatctgatggataattagaatttgcccgtatctgtaagaaggcctgttttgggccatttcaaacaattaagattattagttctaatatgaatgtaagaaaacattggatggagaaaagaaaaaaagtttctgtgtttagagattgaaaaccttgctttgatatcttaacctggatatctcaaatagtatttcctattgttttattttttattctacttattcttaatcagaggtaacaatgtttgattactaatcatattattttaaaatgctaaacctttgatactctcttctgtaatgaaaatagctttaatttttgctgattataatacatgcctgttttaagaaatttaaaaagagaaatgtgaagaacctgaaatttgcctaaaatctcaccatctaccacacttaaaactttgatatgcatccttttgtacatttctccatgtagtactttttgaatatatatatatctttcctggtagactgtcttacagttttttgagtaacattttatacttggatttttctgttgggttggactaatctggctgttcgcaagtgtgcactatagtgttttttatctgtactggaggaccttgatagccatttattttcagctttcaatcttgcagtttattatgtaatctgcaaattgtaattactggctaattaatgagctcctatttctttctctagggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaaggtaatttgctttgatacagcacatactctagtaaaacaaaaaacaaataaaaagaaaccttttgaaagtaatagtcatgcattgcatagaaagaaattcaacatctcacatcttaattttgactcatattgattagagaggtatggtaatacctgtgctttctaagcttgagtactttaagttgtttatttgtttctgtagttgcttcctagttatttgcttgctttattcctttattttgtggtaatttggcaagaaatgtcatgcacttaagaatttgttgtagatttgaaaatagtatgcctaaggttttgtatctgcaatttttccacctccacagaagagtcatcagaatttgatgtgagggctttctgcaaccagctgaaacacaaagctactcaggtttgtctggcttcattaaatttagcttatgatttctgctaatttgtagaggatgcttcttaccaagggcagagattgaatcttttcattttatccccagctctaagcttagtgccttcttagttgtcagtgtgtgcttctgaatgaatagaggcaagggatttttaatacatctagttaattcagttaatagagtaccttcagaaatattttagtaggagtttctctagaattttaaagtaaccgtaagatctgttgttaagtatggattgtactgcagcttaagagtataggctttgcagtcagacagttggtttgaatcctggctttggtactagctgtgtgaccttctgtgagtttcctgatctctccgtacctctattttgtaatagtaatatgtgcctcatagggttgtgctagttttaatgcatgtaaagcgttcggtagtctggagtatggtaagcatttaattggagttagatgttattagctacggtcattttggtcatcatcctcatcattttgtcatgaagctattcctttactcctgttgaggttcaagttttaacatgattgattaatgtctgtaaattctgtttgttctggacctaacagcatataagtacatcggcattactgttttactcagtaacttgacttttttttttttttaaccctgtctttgcaaaatgtctacttctggtatttttcatgggttagtttacttcttttatttaagaattcttaaacatattttcttgaacttaaggactccagcttccattgatgttctgtccaatttatgaattcagagtgaggagtaatactttctgtgccaggcattgttctaagtgcttttatatgcatgaagtcatgtaattatatcacaaaagctctgtgaggtgggcatgcttattactgttttcatatttcagatgaggaaactgaggcatagaaaggccaagaaactgccaggccacatagtgaataaatggtagagctgcgatttgaatgcaggcagtatggtttcatagtctttcttctttactattcaccagtccccagaacagtttttcaactgtatctcaagaactatggtgctttgtgaaccttgaaacttctgcagcctgtgcacctgtttgtaggtgagctggctttgaagttggtgggtcagcatccctcttactcaaaactaactgctactatatttttagcaaatagcactaacttgcttagctttaaagcaaactacttctattgatcaccaaacataaactattgacctgggtcattacttttatattttctacttttttttaaagttccttttgagtgtaagaaatttggaagaaggtaagctttgaatgaaagagcagatcatctcgtaggcagcatattttcataaagaaatagtaaacgttagtaaaatccaaatgtgacttgatatagaaagaaggggttgaagaagtaaaggtgccttgtcagaagatggttgaagtagaattggaagtgttgctcaattgagcatttttaatagatattcagcaggcattaactgattaatgggcttattctgctgggcactctgcagggccccatatcttccctgttttcagaaacatttctaaattgaggaggtttgcccaggatacggaaataagtgaaaaacaagtcgtgataatctggtggtgtagcgaagaggggcctttcagtgatcccccaaccctctgcaattaggctttgaccagtatttaatcatgtggggtttttttattgtgtatgtgagatatgtgtgttaggatatttatgttaactttcctatgtcaatctaattcagctgcagatgggacctgtcctggtacagagggggaacaaaacaacttgtatttggagcagtggagaaaaattcagtttttaaagacataaggaaagcttagtgagcaaaaaaatttccttacagactgattttttttttttaatttttaggttttgtgggtacgtagcaggtatatatatttatggggtacgtattttgttataagcatatagtgcataataaccacagggtaaatggggtatccatcacttcaagcatttagggactgataattctaatttttaaattttgattgtgagctagctttccttgttgtcatataattacaagtcagtaacatgtccaatatatttttctcatctttccacgtttcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactaggtaggtatattgcaaaaattatgttactttactttttctgttgttgttatgagtaaaagtattcaggtcacttttctttaaaatgtgatgtccagcagccgcagcggggctaaattgggatgtactcaaactgcaattgcatttgctgcttttattgtaagagcaaagctgtatcattggaggaagaagataaacaagttaattggacttcagtccccgttatgctcttcatcatttccatcagctcattcaggaaccattaagagtgtctagtgtgctgagcctgaggatacaactgcataaagacgtgacttggtcttcagggagctcagggtcttctgggaaaggcagcccttctgcagacagcttcagtgcagtgcagtgggataagggcatgagagcagaagcagaaggtgcctgccttccatgaggcccacacaagactgctggggtgttgtactgttgctacttgctactgtttgtagcagctggactctatctatatttcttttctgtgatttttatattcacaactgtttaagggtgcttatctttgcttgtgaaccagtattgcatgaagtattacatgaatttagacattagacacttcagggcttaacggtaatgatttcagacacaaatatgtattaagagcctattccaccttcacagaggcaattattctgacctgttttttattgtattctttaacaaatatcctgtgcatgccccataatttcttatccatagtttagagctattcagggatttaaagttcattcctggggatgaaccacgtattgaaaatttgttaaattttcttttaaaatttgcataaaatatattcctgttttagaaaaaaaaaagtatacagtgagggttttgtaacacattttgattaaaagctatggggaaagtggttgaatattcctgagggataaagtgcttgaggggtttttacattgagatggctcctctaaaggtctgtaataatctaaaagtgatgtatcctatggctggagacgcagcctgagatggagagaagcattctgtttaaaattgggtttaaaatcaagggtagatgaggcagaggtaacaactaaaagttaatgagaagggtagcaaactggtgtttattggttaaaccattactcagtactcccccagatatagtgctccttcatagattgccctgttttgctgtttcattaatatatttgtagtaaactttataatttatttaatgtccataataacattgtgaggtagacagtattattcccatttcatagatgggtaaatggaggattttgctcaaggggttagatgtggaactcagttcaggccctctgttttcctttcaactctgaagtacacccaccttctccccacttaaaagccactgcttatagtgagataagaaaatggtatggaagcaaagatcatgatttactttattataatgggcttcctcaaagttttatatccatgcccgtcttttaaaatctatcacaaacagtgaaacaattcagcaaggcactgatgaaccttgtggcagtgtaccgtgtgtggaagcaaaacacctaaaatgatcagctgtttgatttctgaatttccaaacttgaagatgacatatgaatcataattagggtagcttaaggctgtctgtgtatctgggccagaagccctgtcttcatattgttttataaacccctcttagcctttattcctttttccttgttcatttcctgccacagcatgaagctgattatccagattcggattaatacgtactggcagattttttcatttgtgatgtttcctcatgtccactcattacattatgaacagattagcagttatgagggaaaagctctgacactaaagtatagggtatctcgccattcagctaattgctaggcggctgtacttttgagagtttgaaagcaaaatggggacacattcgtctacacttcaatcagagggcatttgtgctctcaaaaaacagacttggggtgaaatttttcgatgtggttctgggattgtacacaggcataggacttgtagataagttgtgtatttttcttttcagttggtaaattaaaagtgcttgagaatgtttttctcatcttaagcccagatttttcctctctctgtcttttaaagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactgg

SEQ ID NO: 639 - DNA, 22441 bp, Homo sapiens
tttcttcttgctgcttttgggtgactcagcctatgacacttttgctcctcctgaaatctccatatcttgcttttctcaaattccaaggtagcctttgcgcaacatatcactctccactgactcttgtcccatcagggcccatagtggatggctgtatgggggccatgtgactgaactcctgatcctcgtttcagcccactcatgtgacatgcatggagctcttcagcagggacttactgaccaggacaagagcttgagactttgaggggatctgattgtcactgcacaatcaaggacagtattcccaagagtggatgttgctcaagatagtccaaggaattctatgaagaaaaggactccacagacaataaattttggacaccctgtttcaacacagttaagcggctttttataattacaggacttttcagaacatttaatatgctaatgtgcattctaaatctccaagaaagaatgatgcatatttatcttttcttccaggtgcatcttagagactggtgtttgcaagtatatggagcaggaaacttcatcccgaagatggagaccccggggctgtcagcaggcgttaggcaagtgcctcaaaattcccaattcccagcaagagaagccaactgaaggatgagacagggtttctgccttccctgggtcctccagtattacatggaggggttggagtgaaccttctggaggtggggtcaatgactcttggaggtaggggaaagcttcctttgaccaagttgcacacaaagacagaaaacgtgtttgcatgggcattgtttaacctgcttaaaagaatgaaaagattttagcacttttttctttttctgtaattactaaagaagtacatgtttttgcaaaaaaaaaaaaaaatcaaacaatatacaagtatatagagtaaaaagtggaagtcctcctttcatctcctccctgcatccctccctgcaccctggagtgttccatattaaggttttggtatgcctggttcagtgggtgagaagattaatctggagtcagcactctgagattgaatctcagctttgccacatgctagctctgtttccttgggcacaagcctcactttgctcatctctaaaataaagtagccgtaggaagggcttggcaggtatgggatgagatgaaacacagaaagccctaatgcagcacctgaacctagttggattcagttaaatttggccgttagaattttccttccagaatccaggcattttttaaaaggtccaatttcattcaatggatgtgctaattcgagaatggggtccatctcttaatctgttcatgtgactcttttttaagtcctcaagggcagtttctatgcagaaaccactatttagaggtttactttattttttcaagttcatagtcaaattgtcaaagctggaaattaaaaaaaagcagattacttgactttctttattctacacattagctcgtttttaatgctaggaactaagaacttttctaggactttgatggaatgattactatcttagaaaatgccatgcctccataaatatatatgcctactatgtacctgcaaaaattaaaaataaaaactttgttaaaagaaaaaaaaaaagaaaatgccatgcttttaagttcagcttacaaaagttctcattctttttataaatccagctagaatttccagataaaataaaagttgcccaattgaatacgaactaccccaaattcaaatctacctactgttctatatttttatttgttaaatctgccaatcctaaacccaacaaacctaaataattacttataaggggtttgtggccaatttataaacattttatactttatttaatatgccctattttcttttaaaagttcttcaattgtctgaactaacaaaaaagctacttttaaaaaatactaaatcatttgaattctaataaagtaaacaaacaaaacattgatgataacctaaagtgtttataaatgttccagaactgtattcagacaaaggtttcaacgtaaagtcatgaacctgaatcaaaccctaccaagtgcacattttataagagagttacaagattttctatatagttggcccagcagctctcattaagtccatgaaataccgcatattccatcttaaaacacacaaaaagagtataccatggctctgagtctcttaaacatttctacactttaattctaaatcttttttctggttggaagatgcccattcaccaagaaagacaattaaccattccctagagctcctttttttttgtttttgtattttattgagatggaatctcactctgttgcccaggctggagtgcagtggtgcaatcttggctcactgcagcctctgcctcccaagttcaagccattctcctgcctcagcctcccaagtagctgggattataggcgcccaccaccacgcctggctaatttttgtatttttagtagagacagggtttcaccatgttggccaggctggccttgaactcctgacctcaagtgatccacccacctcagcctcccaaagtgctggggctacaggagtgagccactgcgcccggcccagagccacctttaccagagattcaaccaggcctgaggtcttaggttgcagacaacagggagattcattgcagcacgaactcaggaaaccatttccttccatgtactatttggggttatcttatagaattcctggcatgcttggccagtatgctgcctggatgtatgttggggatatatgtataattttccctgtggctgtggccacagacccatcaccacaagaggggttggtccacagatcccgatgctggcttggagttattcttattccctacccttttcacagaattgtctttgccaaagtccattaatataccttgattggattttgcttttttttttaatttttttttgctttacagatcttcatagtttcctgcccatatctctaaaagtcattttgcttgagttgatatcctacagttcttacaagacctttctctcccagggtcacacaactctcgccaatattaaattaatatcagcttcaatcacgggtctctccatgggtttcacgggctatttgctcgcagagtccagggacattttcctcatccattccatcagatccccaattgctttctctggcaacacactcctagtatttgtacggtaaagctgcctaaaaaaattaagtaattcaaactactcttgaccttactttacaccaccagggcaattagagtcacagtctgggtgtgtctgaggacagcaggccgccaaatcccagtgatttagagaaaaccgagcagaatttcccatgcctcctgcctcattgtcccccagcagaaggttccgtcaccccaggtgccctctagggtggaccacttccgagttcatccactgtcaggaaaaggcacatggcatgcaaccgcaagaccgatgactagatgtcagagctggctcccggttgggatatgagtgactttgtggaggatggcgcctaaatgaggcatgccaatttctgcaccagggtgacgaacataagggctccttaaaggctagcccaatgtatctgtatttccttggggattaaaacccatgatcttcagttcctcagagaactgaaagttgcaaggagaaatccagtaattcctgttatctgcaggctttataagtcagtggagcctgcggaagtggccagaatccagcactccaagcactgctgtcttctcacagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtgagcccctttcctgggaggaggatcccagacacccctcacaccctctctcctgtctgcagactttaagagactcaaggaacttaaagttggcccttagggggaatgtagaagctggcttggaacaataaccacttcaactctctgtacctcctgccgtcatcttaaaacaggggtgataacaatggttccctccagggttgctggggggactacaggagttggcaaatggaaagctcttaatgtagtatctggctcattatacgttccagataagggttagccattatgatttttattgctatttattgaatgcctgtatcaggcactataagcacatggtttcacttcataatctttatgaagagggactattactccccatgtagaggtgatgaacaaagaaagatgaagtaaccttatacagctactccttttcaccagcaaagcccagctcctttctctctctttccttttcttctttctttcttttctttctttctctctttctttctttctttttctttcttcctttttctttcttcctttttctttcttctttctgtcttttctttcttcttcctttctctttttctttgtttctttcttcctttcccttccttacttttttccttccttccttctctctcccatcctcatcatccctccctctctttgtctttctttcttcttctcctccttccttcctctctccctctcctctacttccccactccttccactttcgcttacgctttccttgggtgatatacccaatgtccggggacactgcttgctttctctggagtcaattgactccctttatcctacaggttaattaatttttgatgctggcaacttaaccctttcccaggactctggaaaggtacttattaccttaggaaacctgagacaccatggtgtggtaggggggccaggagccctgggtccagattccacctaccagacttgtgagcttgggaggccctgcccctccctgaaccaccagctcccctagtaaaatggcgaccacatccaaataccacctgtagcactggctggtgaagagaactcagggtgcctgaggcacccagcagagcctgcagcaaggtgggtattcatgagccagagccgctgctgttgctgtcactgggaaggaggattggagtgaggactggcaggctctgttcttccttggacgagcctctcagacccaggtggccctgccctttgggaggtaaccaaggccttctagatggtgttgtttagccaggatagcaatgccaagcctgtgggagccatgacaagattgttcaatgggaaaccctgacatgcaaggcaatgattttccccacttcacacatggcccgtggagcctgggtagccactgagttcccatctccttcctcactgatgaaacccggctgtctttttgttccttggtgagtccatcatgggggcttgaactctgcatctcccctgagcagctgtgtcctgcagagcatgtccgaagtccttgtcaaggctgcctcaccctccccatcctaccaagaggccatccccaaaacactgcaagagctaccctacagggcactcacagtcacccgagaatgccaggcattcagaataggattatccctagcgcccattgaccaagcacctcctataggtgctaatttttgtatttttagtagaggcgggtttcaccatgttggccaggctggtctcgaactcctgacctcaggtgatctgcccatcttggcctcccaaagtgctggtattacaggcgtaagccaccgtgcccggctgggactgtattttaacagttcaacatggtgggctttgtagtcacgcagacctaagttcaaatcctgactctaccacctatcctggctgtatgactttaagctagtcactcaaccactctgagcttggtttctgcctatgtttaatgggctaataagcatagttaccccacagggttgttgtaaggctcggagtaggtttgcagtaaatgtcagcttttataattattatcattataattatacctctttatttctaatccagtctgttatctttgcttactaagggcttaataaatatttattattattattgtaattattcaagcaaagccaagaggcaggatattgtggggaggtcatgagcaaggggctctgggcttgaattacataggttcaaattctgcctccgccattttctagtagggtgattgggagtgtaatttactcaactttctctgagtctcacgctcctctttaaaatgtacataacaaaagcacctacctacctcagggagtccttcatttagttcagagaagaaattattttaataagcactcagtgcaatacttaaaaacagtaagtgtccaataaaaggttttatttatctgtggtaaatgacctcaaacccctgggaattctctttcttgcaggtcatcaaacgctgtgacatcatactcgtgatggaaatcaaggacagcaacaacaggatctgccccatactgatggagaagctgaacaggtaacatggggaagggtgggccctctagggctcaaggtcaagtgcaagggcatctgaaaacccctgggaactgaaagtaatgtgagatcccgcacttgaccaccagttcacacagccagtgttgcccaggagtccagctcccttagccacggtcctgagaactttcaaccagttgattttactgtgataaaatagaataggggaaatagatgaggggtctggacacagaaagaaatgaaaaaagcagatgaggctgagctaaaaagtacagttatgaagaaaatgttggagaaaagagaaaagattagaaaccaatagtagaagaaagataataaaattacaacatgctcacacacaggaatattatgcagctgttaaaagtcatgctggtggccaggtgtggtggcacgtgcctatagtctcacctacctgggaggctgaggtgggaggatcgcttgagcccatgaggtttaggctatagtgagccatgatcacaccactgcactccagcctgggccacagagcaagaccctatctcttaaaaaaaaaatcatgcttgctacagaataagttagagctaaatattccagcacggaataatggccacaatatattgaaaaaaagcaagttgagaattgcaggtaaaatagcccatttgagtcatcatgttacatgaataagggtgtgtttgtgtttccatgtgcatagagatgaaagactggaaggatgctctccaaactattaatagtggttacttctggtggggggggggggggtgtgatcagagagctgtggtgaaaggggttagtgaaggagtgaggggcacttgcttcttattttagtactttttaaatctgagactctgttgcccaggctggtatgcagcagcaagatctcggctcactgcaacctttgcctcctgggttcaagtgattctcctgcctcagcctcccaagtagctgggattacagtcacacacccactatgcctagctaatttttgtatttttagtggagtcggggttttgctatgttgcccaggctggccttaaattcctgacctcaagtgatctgcccctctcagcctcccaaagtgctgggattacaggtgtgagccgctgcacctggccatctcagcaagaaacacttaatagggacttttgaacaaaagccatgtctgggtcttgggcaggagcaagatgagatggtagatcctggtgccatcatcccccaggctctgggcttatccatcatagggaaggcatgtgtaggacaattgtagggacaggcaagaatccatgtcagtctgcctaagggcttcccttatagtaagggaactgagtgggggacctgcctgagttacccagccaggaagtggccaagcctacctttgaacttgcgtcacatctgatctcatagccagtgctctattctttgtcatctcagccttccttggagtgtccccagtcaggtttatgggagactgaggggacaggtttgtgggggactgaggggacaggtaggctccagtcatctcctccacagtcagtctggggcgagtcttttcaccaccagtggtcttggcacaccccaacctatctagactgtcgcggactccaagcagagccaagcctgtttgtctctttatcccccacaagccaggatgggccttagtcactttgcaactgagtcaccacaagcagtttgctaactcaggacttggcaggctatgttcaaaatagggccagtctccccaaagtggaagcccggcagaacctactgttcacactcctggggccccaggggctaagtctgccttagcatactgcatctgaagtcccaggaatttctgtaaggtctaagttggcccctaaataccccttctgctttttttccaactgaatctgagaatatgctgcagctttagacatgccctagatctttttgtgagcagatagagtgaaattatgttaggctctgcccagagtggagttatcagcaggtttggtaaacacacagaaagagtccgctttccctggtgcaggtgaggggcaaggtcaatgggacttcatggctgtatccccagcacccaggatataaacaacagtgaattgaaatcgtggtcccaaagcttgtaaaaaaatgcctgatggctttcagaggagagaatattcctgcttatcataaatgctcaggagtggttcgtggacacggacaggtggcctgatgacatttattccaccagaaagcatgagctgcagctgcagccatgggcatgagcggggtcaggggctgattctggccaagattgtcttctagggtctcagtggcctcccacaggtacaggccaaagcatgcgggttttggggtgagttggatctaggttcaaatcccagctttgggcttgcaaaccatagaaagggggtaatgataacactctcctcataaggcaagaaataatggctgtaaagatcgtggcagatgccacattccagccaatcaatggtggctcctctcattggactcaaaggttatgatgaacagtggcccttccacatgatgccattgggcgtatggaggcagattggaaagaaaggaacatgtacagtaggggaatgtttactcttcaagatgcagtgttaaatctttgttttctagaaattcaaggagaggcataacgtacaactatgtgattagctctcggcttggaagaaacacatataaagaacaatatgcctttctctacaagtaagtatcacctatgctccctggaacatggccaccaataaatcgtgaattgaatcaaaatgcatgtcttttcttcaaaaccaaattttgatttctaaccaattctcagtgttcatcaaaataattgctgtcaaaactaggggcctatgcaaagtattgactcttcaagctgaaaacacaaggggtctccaaacacctaatttgttggttggctccatggttggcaggccaggtgttctttactcctcatagtcaagtcctggcccagggctggaaagctgaggttctcagcacagctgattcctgaacttcgtattcttttcctcttcctgctagtaatttcttaagtctgaacattaacttttgggtgccacagataactagtatggctcagatcttcagctcccagattcgcaacagctccctggctgttgagaagagttgacttagccttgttctcaggaaaacgatcctgtgcttgagcctgctctggcttctgagaaagccatgggaacctacatctctgcttcatgaaagtagtaagaaaagggctgactcagctgggaggacttccttttccttcttatagggaaaagctggtgtctgtgaagaggagttatcactaccatgactatcaggatggagacgcagatgtgttttccagggagccctttgtggtctggttccaatctccccacactggtaagacccacacaggcctttctgtctgggacctccccaacggcccatgaatgcgcagcagccttgagcatgagcccattaaggaggcattaggctggatgtgacagtgcattgcttctaatacttcaatgtagacgatgcagttcagtgtgatggcaccaggcttgcttctcagaatgccatgactcaagacttccccagcccagaacccactttctggaagcaatggtagtccactctctttggagagtttaggctcatggaaattgttttctgcaattccttggtacctgtcaagtacaactcttccttcctttttaaaaatcctggctgggtgcggtggcgcatggctgtaatcccagcactttgggaggctgaggcaggtggatcacctgaggtcaggaacttgagaccagactggccaacatggtgaaaccccgtctctactaaaaatacaaaaattagctgggcatggtggtgcgcacctgtaatcccagctactcgggaggctgaggtaggagaatcacttgaaccagggaggcagaggttgcagtgagccgagatcgtaccactgcactccagcttgggcgatagagtgagactcttgtctcaaaaaaaaaaaaaaaatcctaagcaatggcttaggtgaacccctagcctagaggctcactctccctccagtcactgcatcgcagactcctccacaggccgcagcgggtgaggaaatccaaatggattgctccctgaactctaacaacagtacttgtactggcccctgattaagtgccagcctcctgtaatccttgcaatgactacaaggtagggagtaggattatctccactttacatttcaggaaactgaggtttaaaaaggcatggagtcacccagctactgaaatggacaggccagggttgtaacccaggccaccacctcaggagctcatgttcttttttttttcttctgtttttgagatagggccttgctctgtcatccagtctggaatgcagtggcatgatcttggctcactgcaacctccacctcctgggctcaagcaatcttcgcacctcagcctcgcaagtagctcagactataggcatgcaccaccacactcagctaattttaaaatttttaaatagcgagataggtctcgctatgttgcctaggctgttcttgaacccctgagctcaagccatctgcctgccttggcttcccaaagtgctgggattacaggtgtaagccactgtgcccagccagtggttaacatgcagtgttatgcaatgctcgatggagtcaagaatcaaatattttttcagtacctactatgtaccaggctctgttgagggcactggacaagacagaggaggtgacattgggctgtgacctgaagaagtcagccatacagagggctggagaaagggcattccacatggagggcacagtgagcacaaaagctcagaagtgggaaggaagctggaatatttagggggaccaaaaagaggatggaggagtgcagtggaggcctgaggaggagagctggcaatgaggacacgtggggccctggatgcagcctgctgggctgagttctggctcctctctgtgtgacttgagcagtgaccgccccacagcccgtgtctgttgaggtaagagtgggaatccaggctgagaatgaggggaagtcccaggaggagctgctcagaaggcgacagctgctgttagcaggtgggccaggaacggcttctgaggctcgcgcacattgccacactcaggctctcagtcctccaacggtgggggaaggttttcagacacttcacaaaagtctttcgtgaagaccatgctaatttttaaatagctttttggaacttttgttcttaattacaaaggagtataaactgacaagcctcatttttttttttttagacagagtttcactcttcttgcccaggctggagtgcagtggcgtgatctaggctcaccacaacctctgcctcccaagttcaaacgattctcctgcctcagtctcccaagtagctgggattacaggcatgcgccaccacccccagctaattttgtatttttagtagagacaggttttctccatgatggtcaggctgatctggaactcccgacctcaggtgatccatcagcctcagcctcccaaagtggtgggattacagaagtaagccaacacgcctggccaatttttttttaactagaaaatgtgcgactgggctcggtggctcatgcctgtaatcccagcactttgggaggctgagatgggtcagtttatactctttttgtaactcccagctgggtgtggtggctcacacctgtaatcccagcactttgggaggctgagatgggtggatcacctgaggttgggagtttgagagcagcctgaccaacatggagaaatcctgtctctaccaaaaaaaaaaaaaaaaaaaaaaaaacaaagctagccaggcatgatggtgcatgcctgtaatcccagttacttgggaggctgaggcaggagaatcacttgaacctgggaggcagaggttgcagtgagccgaaattgtgccattgcactccagcctgggcaacaagaacgaaactccgtctcaaaaaaaaaaaaaggaaacctttaaaaaaaagaagaaaatacaaccataaatatatgcaatttttcctgtcaattaaaaaaagaaagaagagggataaaatacatcagaaacaaaagaaaatacagatttgccacacacacaaaaaggggaaaataaaagcactcacaatgccagcatggaacacagttgttataagtaaaatgtttatttagaaacagaatgcttgttccctggtactgcaaggaaaaatcaacattcagataaaaagttttctcagcaagccaattttactttctgcagaaagggtgctccttgcagatggaacaatggcgagagcacacctgaataaaggagggaagcaatttttatcctttactcagcttgtccctgctactgtgtcctgtctctctattggctggagccagaccacacaatctaagctaacccgactggctaataatttaaacctttcttaaataggtaaaggcaagggagaacaaaggaaaagaggaagttgcttatgccaaatagggaaggggcaaaggctgtgagctggaatgtgcctgcgagctggaatgtccagcacaaatatcttggttaaggtacaaggacatagaatgtactatgtgcctgtgagcatgtctaacagctacataggatagagcttaacaaagagttattagcacaaagcaaggagacttgaaggaagttagtctttaaaggaaactattatttctaacacttatgatttattctttaataagaagggaaactttgaagaggaaacttttttactttctacaacagtctaccagctttctcttagccatgaagggcaactgggagaaatgagtctttcgtgtactaaaaataggcagcctaatgaccccaagatcattaaaatctcggccactggctggaccctctgggaactggggacccagataatgcagcctgtgccttctggaggggacagctggtttccctccagcagtgtttatgagaccttgacaggggaagtgtgtgacccccgcctctttcctgtttctcagctgtcaaagacttcgtgattatccccctgcacaccaccccagagacatccgttaaggagatcgatgagttggttgaggtctacacggacgtgaaacaccgctggaaggcggaggtgaggactgctgtgtcagacgaattcccatctagcaggggcaggctctggtccctgagtgggatgagtacctctccagggagggggaggaggaagggcatgtgcaggctaccaccacttacagcattctttaaggcctttcttcagccctaagtatcccttttgctaaatctgcctgggtaccctgcatgtgggccttgggaattgccacactttcccattaataacagatgccaacatttactgagtgaatagctagtgccaggcactgtgctgagacttgacatggacaagtttatttaatcctcccaataatcccttgaggtagctacagtacctttctcattcccactttgcaattgagaagtgtaaggcatagagcagtcaggattgtttcagttgcaagggacagaatcttaacatggctcatgaaaaaaaggagcaattgattggtttgtgtaactgaaatgtccaggagtacttcaggcatagctggatccagggctcagacaaggtaatcagagcttgatttgtctcttcctttctatctcctggttgccctttcctctgtgtggctccattctcaggttggttccatccctgggatggcaggacagccaccagcagcctccagaccaaaataaattttctttcccacaaggcaacaaatagtgtgggactgagtctcattggctctgactgggtcaggtgtccatccctgaaccaatcattgtgatcagggtgttgagctactctgattgactaaatctgtgtccaccccagctccaccccaaactcagtttgaggtggaggagggatgggtggtctcccaaaggaacttggggtgctgttttcacagaagggggcacatatttgccatccctataggctcagttctttccacttttggaagagaccacttgtggctgtgaggggctgtgaaagctcttggtaaatatggaagtgcacccaagggttcttcttctgtatttctcttttctcgtttcggaatgtgactcctgtgatcccccttcctcctcttgagttctgctgctcaaatgcaaaatgaatcaaataaagtgtgaacatagtccatcagagctggggcatggaaaagaccaggggtgtatttcattgcttattaataaataggtcaaaagaaagattcattctttccaaaaattatgaaatcattcacttattaaacaagaatgtattgagcatctattgagtgttgggctgtggggaggcatcagtggcctaaaagtgaacaagaggggaaactgcttcagtgaagcagactgggatgtgattctttttttttttttttcttgagatgaaatctcgctcttgtccccaggctggagtgcaatggtgcaatctcggctcactgcaacctccacctcccgggttcaagtgattctcctgcctcccgagtagctgggattacaggcatgtgccaccacgcctggctaatttttatatttttaatagaaatggggtttcaccatgttggccaggctggtcttgaatgcctgacctcaggtgatccacccgcctcggcttcccaaagtgctgggattacaggcgtgagccacggcgcctggctgggatgtgattcttgacttcaccatttgaacctcccagtcctgtggcctagagcaggtcacttaatctctcaatcctgtttctatagaagttagtgggctcttgtacctcctattgtttattgctgccaggtgtaaatttaaaaacacctagtgctaggcctggcacatagtgaatgttcagcaaatcatgtctatattagcagaagctggtgatcactgaggttaaggatgacactctgtcctcaactgaacccatcaatcatggggaaaattgtgatcaccaaggtcaaaataaaatgttcttgaagaaaactctgaagtcagcaatgccccaccaaacaatagcacaaacaaggaaatctggcacttcctctggattgtggaatgttgaaaattctgttccaagagccttgcagggaaaaatatttccaagataggaagtttctcttggtggccttgggtgggggtggacagctcactcaatggtcccctcccctgaagatgcctcccacctcctcaagggactgaattttcacagaaataagtttccaacttcaaaacaataggagagaaagagtgatgccagggttgtcaatacaccacccaaattcacttttcctgcttgaaagcaaaaggcgttgattcattcgtatatttacaccctacagtagtttgagccagggacaaaagatgtgagggaatagattcactgaaattttttttatccacacctgactctgcatgctgaattatggaaatgtggcgactaagaacagcaaacattctccttcctgttaagaacatcctccctggtacgcactcgcctgtcatcgactcatcaaaactgtgactcaattttaaacaacaaaaagaaatttttaaagaccttatattcatttgctagagctgccataacaaagtaccatactgaagactgggaagtttaaacaatagaaagtgagttcgtcaccgttctggaggctggagtcccagaacaaggtgtgccagcagggctggtgtcttttgggggcctctctccttggtttgtagacggccatcttcttccagtgtctttacatggtctttgctccacttttctgtgtcctaatttcccctttttacaagaacgccagtcatattggattagagcccatccatatgacctcattttaccttaattccctcttgaaaggttctatctccaaatacagtcgcattctaaggtgctgggggttagaacttcaacataggaatttggccggggcgggagcagggggtagacaagattcagcccataacagaccctgttgtttactgggcctgggacgcagagtctttgctagagtccagtgtgaaagcattctgcagcagcacccaccaggtgacagttccaaatcttgtcttttagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggtaggaggccctgcagggtgctgctggctcaccacagtgcttggtgtgcactaggaaagacgcaaggtggctgggcactgtggctcacgccagtagtcctagcactttgggaggcctcgatggatggatcgcttgagtacaggagtttgagaccagcctgggcaacatgatgaaaccccgtctctacaaaaaatacaaaaattagccaggcatggtggcacacacctatactcccagctactcaggaggctgaggtgggaggatcgcttgagcccagaaggtggaggctgcagtgagccaggatcgcaccactgcactccagcctgggtaacagagtgagactttgtctcaaaaataaaaaataaaaataaaaataagaaaagcacactgcttgcagagctgagtcaattaaatgtcaggcccctctactgggtaccacatgtagcgtatgaaccacaggaccctatgcggtggccctgggcactgtagcttagcagaggtaagcactggcttcgctatcagataggcctggatttaaatcctgacattatcacttcatatgtctgtgaccaagagacaagctctctgtgtctttcatttcctcccctgtaaaatggaagttatcctagtgcctcactcatgaagatccgatgtggagtaaatgaaataacatgtcaggctgctagcacaatgcctggcatacggcaagtgctcattacattcatgggctgatcattgttccatcacaaagacttaccgcaattgatgcgcccaatccccatcattaggcattgggttattaccaagggtttgctgttataaatactgctaaaatcaatatcctctgtgcattttgtgcaagtatttatgatttcctcaggaagcaaccctaaaaatgagaccaattagtgcaacggtatttatatttttaaagctttagctacatattcctaaatgcaatgcatacatttaagtcctagcattccctcgtgctttttaaagtcccttcagggattttcaaacagctttcatctttgctccttcaatggggacagaggggggagtgcctgaggcgtgtgaatgttagtgatcttccatcacagagaccacaggtggggaaacccctaggagcctggtcccaggtggtggccacagttcccagagctcagcctgccacgaggaagtgtgagatggccatctgcatgagagccaccaggccactcgttttcacttcctctcggagttttttttttttttttttttttttttagacagagtctcgctctgttgcccaggctggagtgcagtggtgcgatctcggctcactgcaagctccgcctcccgggttcacgccattctcctgcctcagcctcccgagtagctgggactacaggcgcccgccaccacgcctggctaatttttttttttttttgtatttttagtagagacagggtttcaccatgttacccaggatggtcttgatttcttgacctcgtgatccgcccgcctcggcctcccaaagtgctgggattacaggcgtgagccaccatgcccggcctgttcctcttggagcttttgaggctggtgtttcctttgcagaagttatcactctgcaaagtgggaacccaaggcggggagttacaggggtctaagtgcccagaccccctattttgaaggacttccagcaaagcctggacgatggccactcactcagttacacatggcagttgtgtgcccgtgggtaggtcaagtcccttctccagcgccattcttctcccctggcaaatgagtgggaagtgattgaaaatgatacagaagaatcagaaggcaacatggccacagtagatcaggtcaggggtagaacaggttagaaaaagatgtttactaaaaggatcctgattttatacacatgtatcccaaaggatggtgggattacatgtgacattttaaagattcatttcttattttgatgctctgaattttgtttctcataacaacatgtataactcttgtgcctcttttttttcttttttttgagacagagtcctgctctgtcgcccaggctggagtgcagtggcaggatcttggctcactgcaacctccgcctcccgggttcaagcgattttcctgcctcagcctcccaagtagctgggattacaggcatacacaaacatgccccgcttttttttttttttttttttttttttgtaattttagtagagatggggtttcgccatgttggccaggctggtcttgaactcgtgacctcaggtgatccgcctgctttggcctcccaaagtgcttggattacaggtgtgagccaccatgcccggcctcttgtggcttttaaaaagtcataggccagttgtggtggcatatgctgtaatcccagctacttgggaggctgaggcaggaggatcacttgagcccaggagttcaaggctttagagcaacatgatcacatgcctgtgaatagccacggcactccagcctggacaacatagtgagacctgtctcaatacaataaaataaaaagtaaaattaaataaaataaacggagaaaatgaaaagccataaaaatgatgttttaaaaatgtaattagacaagatggtctcagttccagtctttgttccatgttcacatatttatcaaacacctctcatgtgctgagtgctgggggaacatgcaaagatgcccaggatctggctggtgccctggactgaaaacgtcacatgaacactggcctggtcctgcacatccctagaagaagtcagaaatggaagagcctttaacatgtcattctttgctttctgagtcttaaagaaagctttcacaaatgtctaacttgatgcgaagaatttacatttgggttgaattaaaagccgtagcccgggccgggcgtggtggctcacacctgtaatcccagcactttgggaggctgcggccggtggatcacgaggtcaggagatcgagaccatcctggctaacacagtgaaaccccgtctctactaaaaaatacaaaaaaaattagccaggcgtggtgccgggcacctgtagtcccagctactcgggaggctgaggcaggagaatggcatgaacccaggaggcagagcttgcagtgagccgagattgcgccactgcactctagcctgggtgacacagagagactccgtctcaaaaaaagaaaaaaaaaagccgtagccctggagcggtggcttacaccggtaatcccagcactttgggaggttgaggtgggcggatcacctaaggtcacgagttcaagaccagcctggccaacagggataaaccccgtctctactaaaaatacaaaaattagccaggcgtggtggcacacacctataattccagctacttgggaggctgaggcaggagaatcgcttcaacccggaaggtggaggttgcagtgagctgagatggcgcactgcactccaacctgggtgacagagcatgactgtgtctcaaaaaaaaaaaaaaaaaaaaaaaagttagttgtgctggtgatgttagcaaatgcagataccaaaactgttgattagaatggggaaggcccactggtcactcatgaaatggcagtttgactcaccttgccattcctcgggaagtcactcaggaccacgtagaccacaactgcatcacccaacttgggatatgttagtttgtttccaaaactcatttgactacctcattcttactttttgtcattattgcaaagcacatatgctgtgatttttctcgatattttccattaaatcgcttaatttcttgctgaaataaatttttaaaagaaatttcatgatactagcatgagtaagaaagcagcagcatttgccataaattgaaggtaacgtaaaaattaagtccagtgaaaatcacgccttgttaaattctgccttaattctcttgcctgcagaatgctcggagatggcagcctactctctgtcaacacgggactgagggaggtattaaagacaaaccagcacctccctgagaatttctccataatcaaatcagggaaagtgaaaaataattgaaaaaggaacagcgttctcagtacgcaagtcattgttgtgtgggatagtgtgcgtgtgtcatataaaatcttctcctactccaccagaacattgcccacactgggagacagtgtcctggtgtccacagaaccatggcagggactgatcctatttcacagttgtaggcactgtcctttggggtcacaggctaaaaccagctctggactttgagcgccacatgaaagggccagactgctcggttaattccagacagcaaacacagaccttggtttgatctcagcaatcacaggttggattaacacaactgttttccctccccttgttccaggattgtgcttagaggacaagaaatcgtcagttctgttgttcccaagtcaaacagtgtttttgacttccagaaagcttacaagctgactgaagaggaggtaaggttgccatcttgtctttctatgccattgtcctggaaagatgagttagcttgggcaacatgatgagactccatctctatgaaaaattcaaaaaaattagctgggcatggtgatgcatgcctatggtcccagctacttgggaggctgaggtgggaggatcacttgagtccaggaagcggaggttgcagtgagccaagatcgcaccactgcactccaggctgggcaacagagtgagatcctgtctcaaaaaaaaaaaaaaaaaaagatgggttgatgccaccctttgaggtcaccactgaagacacaacattgggcactagaccttgaccctcaatgcctatgattctgtgatttgaggcccctccaaaatttctgatcgagctggtcttggaatgacgcttaccagtaagtgttctgtggggtgacttcgggcatttcctctcccctccctggtcctaaatttgctcatcgctaaaatgaaagcatctcccaggcatctcctaatttccatgtctacctcccctttctccttataggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagatatgaactgctccctgtacttaggaaacaagagtgatccaactgctttcattttttgacctgaatttattctgacttgagccaaattggaaggagaatcttttgtatctctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatgaccagaaacaccaaggccccagctgcccctgtgatttgggcaattaactgttttaagagtctg

SEQ ID NO: 640 - DNA, 61102 bp, Homo sapiens
catcttttacaagaaaccttcgctgcaaccgctgcgtcacatcaccgcgtctcccagggacaggaaagcctctccgtgtttggtgaagcttcaggggaagcagtcatcctgtcgtcgcatacggcaaaatcctccattgccgtagccgttcggctgacgtgacaagggaggtgcaggccaacacggcgactccgcgccctctggcggcagtgccggagcagcggcgctgtctttgacctatccggcattcggcttccgggaccgcttggcggctgtgaatgcagagctggggcgacgtggggctcgcttcctgggactgggtgtgagcttgcgcagtgagccatatgggggtcatggcctggcgtgggggcgtggccgggtggggccgctggatttggtgctggaaagctagggaagtagtcgtgcgtttaagaacggccggccggcggggtggctcaagcatgtaatcccagcactttgggaggccgaggcgggcggaccacgaggtcaggggttcgagaccagcctggccaacatggcgaaaccccgtctctactaaaaatacaaaaattagccagcgtggtggcgtctgtagtcccagctacttggaagcctgaggcaggagaattgcttgaacccaggaggcagaggttgcagtgagccgagatcgtgccacttcactccagcctgtgcaacagagggacactcgtccccccccaaaaaaaagcccgggctgggtggcttacacctgtaatcccagtactttgggaggccgaggcaggcggatcatctgaggtcgggagttcgagaccagcttcatcaacatggagaactcacccatctctactaaaaatacaaaattagctgggcatgatggcgcatgcctgtaatcccagctactcaggaggctgaggcaggagaattgcttgaacccaggaggtggaggttgcggtgagctgagattgcaccattgcactccagcctgggcagcaagagtgaaactttgtctctctctctctttctgtctctggcacatacacacacacacgcacacacacgggcctcctgtggtctcacttggtcctctttgtgacagtgccattgttaccatttacagaggaggaactgaagctcatggttgagcctctcacttgcccactttgccaaaccctggtagggatgggattagaggctccttttctttcgtgaaatgagacaacgatctgggggatcgttggaaggattaaaatgagtattcagattacaatgctggattcttaatagtgtcctctgttaataataataataatgtagtagcaacagtcacgtagtctttacagtcacaggtgcatgtgtgtagatggggttctctctgtattagccaggctggtctccaactcctggcctcaggctatcttcgcacctctgcctcccttagtgctggtattacagatgtgagccactacaccagcctgcagtttttactacaactctgtgaggtgattagtactagcattcccatttgacaaataaggacagtgaagaaagcagaagtaacttggccaaggtcacagaacagccatagcaattcctgggtggtgtggagtggaaggctctggccttaactgctacacattgtctctggtaacaaggccctgcctgaagtatattccggcttctagaggttgcaaggaaatggaccactcatcagttcttgcagcctccttatgatctacagtgggacttcgcaaaggcaggcctagtaggaaaacaaagagaagagggttggaagaagggaaggattggggctcagaaattatgagggaatggactagaaaggatagaaacaaagctcttgggcaggtgcagtggctcacacctgtaatcccagcactttgggagggcaagatgggagaatcaattgaggtcagaagttctaggccagcctggccaacatggtgaaaccccatctctactaaaaatacaaaaaaagaaaaaagaaaaaagaaaaaatgggtcgggagcagtggctcacacctgtaatcccagcactttgggaggctgaggcgggcggattacctgaggtcaggagttttataccagcctggccaacatggagaaaccccatctctactaaaaatacaaaattagccggccatggtggtgcatgcctgtaatcccagctactcaggaggctgagtcaggagaatcacttgaacccaggaggtggaggttgcagtgagctgagattgcgccattgcactccagcctggacaacaagagtaaaactccatctaaaaaaaaaaaaaaaaattagctgtgcttagtggcacatacctgtaatcccagttactcaggaggctgaggcaggagaatcgcttgaactagggggatggaggttgcagtgagctgagatcgtgctactccactccagcctgggcgacagagccagactctgtctcaaaaaacaaaacaaaacaaaacaaaaattaactgggcatggtgttgcaggcctgtaatcccagctaatttggaggctgaggcaggaaaattgcttgaacccgggaggtggaggttgcagtgagccgagatcctgccactgtactccaacgtgggtggcagagcgagactccgtctcaaaaaaaaaaaaaagaaacaaagcttttgtccccatctccaccagaagtgaagaaaagaatggcttccagcttgaggaatggggaatggggatgatggtactacactactactactactattaaatactactgctactgctacaacactacacattcatatctattcttagaaggtattaatcccagaaattcaggttgaggttgggaaaagtaggttccttatccttgggaatctgtttacttacctataaaaccagagtgtagtaaataggaatccctgtcctggctgcctagccaggttgttaggaggaaagagagatttggtgtcctatactagcattcagaatgacttgtgatgggacactgtttgcaaggctggggaaagcaggctgtgatacctacaagtgggagtgtacatttttacaactccatgaggaggcaagctggcatatctgttaatgtaacattaatcctttgtaccaatcctttgattaagcacttcagggccaaggaaactatcttacatatgtattcccccatgtgcacagacaaacgtagaaagaggtacagttgagggctgtttgaatggcaaaagcatggaagcaaactaattgttcataaataggggactggcttgatttttgaaaaatgacacatcaagcctgagcaacatggtgaaacgctgtctctacaaaaaatacaaaaatgagctgggcgtggtggcaggcacctgtagtcccagctactcaggaggctgaggcaggaggatcacttgagctgcagaggcagaggttgcagtgagtggagatcgcactactgcactccaacctgggtgacagagtgacaccacatctcaaaaaaaaaaaaaagacacatttgtttaacaggaattctatgcagcccctcctacaaaataaagtagtactgttgtagaataagctccaagatttatcacatataattataattatgactgtggctgcaaataacaatgtagccttctatagtgcaaataacaatgcaaattacattgcaaataacaatgtagccttctatagtggcttaaacagacaagggttaatctgtctcaagcaataagtagcaataagggcaggcacatctgagtcttgtatggggcattggtgtgttgtcaggaatgcagactctttttctttttaaaatttcaaaagccttaagaaggtcacagtggcacatgcctgtagtcccagctactcagaaggctgaggcaggaggatcgcttgagcccaggagttccaggctgtaatgagccatgatcatgcctgtgaatagccactgcactccagcctgggcaacatagcaagacctcatttctaaaacaactttttttaaaatttaaaaactttttgcctcatttcaccagatccctggcttggggagccttccttccccatggtgggacacctggctttggatttcaccttcttgccccttccaggtggtggaggtaatgggtcagcggggcgggagctggacttggctaagcttccaaggcaggaattgggccgggtgttgggccaggctctgagatgtgggggtttctcccgtgccccccactgcatgagttccgtgggcagatggtatactctgggtctccggttgcagtggggctagtgccccaaggtggcttgaagacctctcagcctgagggcgaggcaggagcctgggtggagagcaactgtgaggggcctccctggagccttgcactgccccagctggtgccatgaagctagagaaggagaagctggagcaaaacctcaacgagtcccaggacatcaaagctctgtaatttgccaagctcctgaagcagaagaggatcaccctgggatatatccaggcccgtgtggggctcaccctgggggctctttttttaaatgtttatttatttgtttatttatttttgagacagggtctcactctgttgcccaggctggagtgcagtggcgtgaccttcgctcaccacaacctcttgttgtgcccaggggtgttagagagaacgccacactttgagacgatttaagagtcctttattaagccggcggccaaagagacggctaacgctcaaaattctcttggccccgaggaagggggttgattaacttttatacctaggtttaggaaggggaggggaactcaaatgcaataattctacagaagtaaaaacatgcaagaataaaaaaaaaatggttacaaagagataaacaatttaaaagacaaatggttacaagaagagcaacggtaccaggtgcaaggctttaaacctttattataattagatatagggggtatgccggacaggaactcaaggctttatgttgttatctctttgagaaaaatcctgggaacttcatacattgttggtgctagtaccttatcagttaattgggctactttgaaatgctgaggatctgcttacacaggttaactccttgcggaagggggttgggtaaggagcccttagtatcttgtaaattaaggggtcaattggagtttgtctggctttcccagctagagagagtcttatttacatgagaagcaaggctaggtgattaaagagacaagcaggataaaattcaaagtaacgagttagagtaaaaacaaggttaggcgtttcactctgcctcctgggttcaagcgattctcgtgcctcagcctcccaagtagctgggattacatgcatgtgccactatgcccagctaatttttgtatttttagtagagacggggtttctccatgttacaggccaggctggtcttgaacttctgacttcccaccttggcctcccaaagtgctaggattacagaagtgagtcaccatgcccagcctctggggggttctatttgggaaggtgttcagccaaatgaccatcagctgctttgaggctctgcagctcagtttcaagaacatgtgtaagctgcctcccttgctgcagaagtgggtggaggaagcagccaacaatgaagagcttcaggagatatgcaaagcagagaccctcaggcaggccgaaagaacaagaacccgggccagtcgcggtggctcacacctgtaatcccagcactttgggaggccgaggcgggaggatcacgaagtcaggagatcgagaccatcctggctgacaaagtgaaaccctgtctctactaaaaatacaaaaaaaaattagccgggtgtggtcacgggcacctgtagtcccagctactcaggaggctgaggcgggagaattgcctgaacccggaaggcggagcttgcagtgagcagagatcgcgccactgcactccagcctgggcgacagagcgagactccatctcaaaaaaaaaaaaaaaaaaaaaaagaagaagaaccgagtgagaggcaagctggagaacttgttcctgcagtgcctgaaacccacactacagcagattagccacattgcccagcagatcagccacatcagccagtgcgcccacaaacccacactgcagcagatctccaggttgggctggagaggatgtggccccagtgtggttctgtaactggcgccagaagggtaagtgatgaagcaatgactatgcactacgagaggattttcaggctgctgggtctcccttatcagggggccagtgttctttcctccggccccagggccccattttgataccccaggctatgggagcccccacttcactatgctgcgaggggaagcctttaccccgtctctgttgccacttggccctgccatgaattgaaactgaggtgcctgcccttctaggaatgggggacagaggaagggaagaagctaggggaggagaacctggagtttgtgccagggcttttgggcttaagttcctcattcactaaggaaggaattgggcacacaaagggtgggggcaggggattttgggacaactggttggagggaaggtgaagttcaatgatgcttttgcttttaatccctacatcatgtatcactttgttcttaaagaaacctgggacacagtaaaaaataaataaaataaggccgggcgtggtggctcacgcctgtaatcccagcactgtgggaggccgaaatgggcagatcacgaggtcaaaagattgagatcattctggccaatatggtgaaatcccatctctactaaaaatacaaaaattagctgggcgtggtgccacgtgcctgtagtcccagctactcaggaggctgcgacaggagaatcacttgaacccaggaagcagaggttgagtgagccaagattgtgccactgcactccagcgcggtggctcatgcctgtaatcccagcactttgggaggccaaggtgggaagatcacctgaggccaggagttcaagaccagcctggccaacatggtgaaaccctatctctacaaaaaatacaaaatattggccgagtataatggtgcaagcctgtaggcccagctactaaggaggctgaggcaggagaattgcttgaacctgggaggcggaggttgcggtgagccgagatcacgccattgcactccagcctgggcaacaagagctagactctgtctcaaaaaaaaaaaaaaaaaaaaaaaaaatgtgatgccctgttagaagccagagaccactatgctgccttaggtggggtgaataggcccacgtcagaaatggagcaggtcaaaactcctgtgctgatcagtagtgggatagtgcctatgaatcaccactgcactccagcctgggcaacatagtgagattctgtctcaaaacaaaagttagctagctgggcacagtggcttatgcctataatcccagcattttgggaggctgaggcaggaggatcacttgagcctaggagtttgagaccaacctgggcaacatggtgaaaccccatctctacaaaaaatacaaaaattagctgggcacagtggctcacgcctgtaatcccagcactttgggaagccgaggtgggcggatcacttgaggtcaggagttcgagactagcttggcaaacgtggtgaaacctcctctctactaaaaatacaaaaattagctggacgtggtggcatgtgtctgtaatcccagctactcaggaggctgaggcaggagaatcgcttgaacctgggaggcggaggttgcagtgagcttagatcacaccactgcatccagccttggcgacagagcaagactctgtctcaaaaacaaacaaacaaacaacaaaaacaactatatatatatatatatagatatatatgtagctgggtgtggtggcatgcacctgtagtcccagctactggggaggctgaggtgggaggatcttgtgagcctggaagctggaggttgcaatgagtgcccctgcactccagcctgggtgacagagcgagaccttgtctcaaaaaaaaaaaaaaaaaaaaagtgggctaaagaccttaatagacaccttagcaaagaaggtctacagacagcaaatcaagcagaagaaagatccttcctatcatctatcatcaggggaatgcaaattaaaacaatgagataccactggacacctattagaatggcccaagtgctgacgaggatgtggagcaacattaactctcattcattgttgatgggaatgtaaaatggcacagccactttggaagacagtttggcagtttcatactgaactaaacatacccttaccatacaattcatacaattgtactccttggtattcacccaaaggagttgaaaatttgtgtcacacaaaaacctgcacatggatgtgtattcatttattcataattgccaaaacttggaagcaaccaagatgtctttcagtaggtgaatggataagttcctgtggaaaatccaatgtaatgttatttagtgctaaaaacaaaagacatagaagcattttttttttttttagacagggtcttgctctgtcacccaagctggagtgcagtggtgccatgacatctcactgcagcctcaacctcctggacacaagcagtccttctggttcaacctcccaagtagctgggactacagatttgccaccatgcccacataatttaaaaaaaaaaattttttggtagaaactgggcctcactatcttgcccaggttagtcttgaactcctgggttcaagaaatctccccacctcagtctcccaaagtgctgggattacaagcgtggaccaccactcctgaccaaggaaacttaagtgcacattactaagtgaaagaagacaatctgaaaagcctacataatgtattattccaactatatgacattctggaaatggcataaattatggggacagtaaaatatcagtgggccgggcgtggtggctcatgcctgtaatcctagcactttgggaggccaaggtgggtggatcacctgaggtcaggagtttgagaccagcctggccaacatggcaaaactccatctctagtaaaaatacaaaaattagctgggcgtggtggcacacacctgtaatcccagttactcgagaggctaaagaaggaaaatcccttgaacccaggtggtggaggctgcagtgagccgagatcgcaccactgcactccggcctgtgggacaggagggagactatctcaaaaaaaaaaaaaaaagatcagtggcttccgggggctaaagcgaggtgaggtggaagaatggatgaataggcagaacacagaggacttttagggcagtgaaaatactgtgtaatgctaaaatggtggacgatgtatgtcattatacatttgtccaaacccatagactgtccaacaccaggactgagcctcatgcaaactatggactcagtgatcaatgatatgcccgggtggggtcatccactgtgacaaatgcaccactctgctggggatatggacagtggggaaggctgtgcatgcgtgggggcaggaggcatatgagaactctctgtaccttctgttcaattttactgtgaatctaatactgctcttaaaaaataaaggctttaaaatgcaaatgttagctttacagtcacatgatgtggaggaagccagtcatatcacgtgagtaaaatgacatgacagtatgagggaagaggtggaggggaaatatgattgggagagtacgcaagtcacagccacctctgacatgggcaggcagaaggagatatacacacagcacatacacagtgagctcagaggtcatcatgtttggccaggggtggtggctcatgcctgtaatcccagcactttgggaggctgaggcgggtggatcgcctgaggtcaggagatagagaccatcctggccaacatagtgaaaccttgtctctactaaaaaaaaaaaaaaaaaaaaagccgggcgtggtggcggccgcctgtaatcctagcaacttgggaggctgaggcatgagaatcccttcaacccaggaggcagaggttgcagtgagccgagatcacaccactgcacttcagcctggcgaaagagtgagactttgtctcaaaaaaaaaaaaaaaaaaaaaaaaaagaagagatcatcatgttctgagttattggtaaaaatagaaataaaacccatttatgtaattttaaggttctttttttttttttttgagatggagtttcgctctgttgcccaggctggagtatagtggcgcaatctcagctcactacaacctctgcctcctgggttcaagcaatcctcctgcctcagcctcctgagtagctgggactacaggcatatgccaccacgcccggctaattttttgtatttttagtagagacggggattcaccatgttgcccaggctggtcttgaactcctgacctcaggtgatcggcccgcctcagcctcccaaagtgctgggattacaggtgtgagccaccgcgccaggctcaatggaaaacgtttttctaaaaagaagtgttcttatttgaagaaaaatagccaggtgcagtggctcaagcctgtaatcccagcactttgggaggccaaggcgggcggatcacgaggtcaggagatcgagaccagcctggctaacacagtgaaaccccgtctctactaaaaatataaaaaaaaattagccgggtgtggtggcgggcgcctgtagtcccagctactcaggaggctgaggcaggagaatggcatgaacccaggaggtggaggttgcagtgagccaagatcgcgccactgcactccagcctgggcaacagagcaagactccatctcaaaataaataaataaataaataataaataaaataatttttgtctaattcaaaggttatttaaagattatttatgaaatgaagtaaaagaaatgagtaaataggggacatataaagaaagtatgaaccaaaaagtatttgagacaagtctcaatcaatttagaagtttattttgctaagcttaaggacacaggagacaggtctgtgtatttctccaaagatgagtttggattccaagtctggcatacttttaagtgttacatcaggagtgtctaacaacaaagcctgatatttccgtaagtgtcctcgtcatccactggtgtcctttagcttctaggactccttgtacttggtgtggggttaaaacctccagatgttgtcctaaagccagtttattggtttcatctactaaaagagcagttgctgcaactgtcctgaagcatccaggcctgataagaaaggtgtgtgaggaaaccaaagtccctgaagaacagcttagatgataggtaaaatgctctctatgggcttgtccatctaccctgtgatcatacagttttggggtgacagaggcccattataatgggacaaaacagaataagcagcccagaaggaagttaatattcttacctgccaaagtcaagggttcccaaggctcctccagagatatggctagttgtctgatgggagctgtggcggaaggttttggccctgtcactcctggacttgcctggctatttcgtggttcctttctttctttctttttctctttctttctttctctctctctctctttcctttctttctttcttccttccttccttccctccctccctccctcctttcttttcttttcttttccttttctttctcagagtctcactctgttgcccaggctggagtgcagtggcaccatctcagctcactgcaacctccgcctcccggtttcaagagattctcctgactcagcctcccgagtagccaggattacaggcatgtgtcactatgcccggctactttttgtgtttttagtagagaggtggtttcaccatgttggccaggctggtctcgaactcttgacctcaggtgatccacccaccttggcctcccaaagtgctgggattacaggcatgagccaccgcgcctggccttgcctggctatttcagccatcattggttcgggcgcggatagctccttccagtgcggtgggcagtccctcttccaatggccagttttcttacggtgtgcacactgattcatgcccaagacacagtgactggaacacccagctttgggcttcctgcctttctgcttcccttgttcagtccaagagcaaggaaagcaatcccatgtgggaggtgagcttaaggctgcagccaagagctacaccttgtgggaggtccttcttgctctttctgcttcctctgctttgtccgttattaaaaactaaaaatgccaggctgggtgcggtggctcacacctgtaatcccagcactttgggaggccgaggcgggcagatcacgaggtcaggagatcgagaccattctggctaaaatggtgaaaccctgtctctagtaaaaatacaaaaaattagctgggcatggtagcgggcacctgtaatcccagctactcaggaggctgaggcagcagaatggcatgaacccaggaggcagagcttgctgtgagctgagatcgtgccactgcactccagcctgggcaacagagcaaggctgcatctcaaaaaaacccacaaaaaacaaaaaactaaaaatgccatatccaaaagctgttccataggaatttggggacccatagctgctttttgtagtttcctacgggtatcaggggcagaatgggttataaaatgtactccgaaaagggtttgtccttcccttgaggcaggatcagtgttactgtagtttctgatagcctcaatgaaacgcccttgaaacaaaactggattctcatctttaccctgagaaacttccttaaccttttcagagttaacaggctttttcatacctttcttcatccctttcaacaaacaagtgaccatatgatctttcctccccaagtcctcactgcccctttgatagttccactttggatcttgatctggaactgctatacctcctgcctgatatatataatggtttgggttgtgagccaatacctcgtctgcatgggtcctagctgtccccaaaatgtgttgtttctcttccactaaacaacacagagacaaaaagacatgcagatcctgccaagttaaactataggttggagttaatttctccaactcatctatgaattgtcctggatcttcagagaaaagaccaaacttctctttgcatagagccaaatcagacatagaaaagggaacatgtgctctcacagtgccttcttccccatttgccacctctctaagtggataaaggtttcccactggaggttgataggaggctccaatatgagtggtacttgctggactaagttcctcagggagtggtgggtacagagtgggactagacgggtaagaaggaggggatgaagcgttctcaatagagttttcaggtggactagagggagaaatgaccgacacatctgaaccttcatagctgacagaaggaggttctgctccacccaaaaatgcctgctgtccctttgtggtcaccagaaatatgttacaggacaggggtccccatccaggccccaagagagggttcttggatcttgtgaaagaaagaattcagggcgagtccatagtgcaaagtaaaagcaagtttattaagcaagtaaagtagtgagcccggtgtggtggctcacgcctataatcccagcactttgggaggccaaggtgggcagatcacctgaggtcgggagttcgaaaccagcctgaccaatgtggagaaaccccgtctctagtaaaaatacaaaattagctgggcatggtggtgcatgcctgtaatcccagctacttgggaggctgaggccggagaatcacttgaacccaggaggcggagattgcggtgacccgagcaagtccagccgttgcagtccagcctgggcaagaagaatgaaacttcgtctcaaaaaaaagtaaagtagtgaaagaacagctacaccatagacagagtaggacattcccgaaagtaagaggaggaatgcatccaccctaggtacaatgcttgtatatatgtggggagatgtgctctgctacaagggtttgttataaaggattaattttttaaattactatattttgcaaaaatcaatactattatcgatttgctttaaagcaaaattaggaactatgtctttgttctccagatattgggatatctggatactctcaagtctgggtctgtttagtaaactttttttttttttttgagatgggatctcgctctgtcacccagtctggagtgcaatggcgtgatcacggctcactgcaacctctgcctccctggttcaagcaattctcctgcctcagcctcctgagtaactgggattacaggggcacaccaccacacccggctaatttttgtatttttagtagagatggggtttcaccatgttggtcaggctggtctcgaactcctgaccttgtgatctgcccgcctcagcctcccaaagtgctgggattacaggcgcgagccaccacacctggccccccccctttttttttttttttttttgagaaggagtatcgctctgtctcccaggctggagtgcagtggcgcgatctcagttcactgcaacctccgccttctgggttcaagcaattctcctgcctcagtctcttgagtagctgggattacaggcacccaccacccgcccagctaatttttgtatttgagtggagacggggtttcatcatgttggccaggctgggtctcgaactcctgaccttgtgatccgcccgggctagtaatgcctaattttctgagcatgcagcccagcaagttccagccgcattttcctagccctcactcaaaatggagtcactccatcctggctaacacggtgaaaccctgtctctactaaaaatgcaaaaaatcagctgggcgtggtgccgggcgcccgtagtcccagctactcgggaggctgaggcaggagaacggcgtgaacccgggaggcggagcttgcaatgagccgagatcgcgccactgcactccagaacagagcgagactccgtctcaaaaaaaaaaaaaaaaaaaaaaatggagtcactctgggccgggcgcggtggctcaggcctgtaatcccagcactctgcaaggccaaggtgggcggatcacctgaggttgggagtttgagaccagcctgaccaacatggagaaaccccgcctctacaaaaaataaaaaatcagctgggtgtggcggtgcatgcctgcaatcccagctactagggaggctgaggcaggagaatagctttaacccaggaggcagaggctgtggtgagccgagattgtgccattgcactccagcctgggcaacaagagcacaagtgtgcctcaaaaacaaacaaacaaaaaaccggagtcactcttgttcgaacgcctccaacactatcactaagtaaaggagaatttataataaaggaaaatttacatcctgtctttaagtggtaaaggaagggggaggatagaaagaccttttttctttgtcctgctctaggcaaacagggaaggcagagagctcccccacatgtttcttatctttaattcaacatcctttatgttttggggaaaaatattctggcttccttcaatgaccgtgctaataatgtctgttttgtagtctttttctgataaatccaaattcataggcaatttcctccttttttgttttcttctggtggatcatgaatacatttctgtttcttcgtataccttgtactttgttggaaatgggacattttggataatatgctgtagggattctagatcttgaccctcctcccctttagggtttaattatttgcttttgtatttgtttagtgacttactgaatttttttttttttttctgagacagtctctctctgtcccccaggctggagtgcagtggcacgatcttagcttactgcaacctccatctcccggtttctcctgccttctcctgcctcagactcccaagttgctgggattacaggtgcctgccactgtatctggctaatttttgtagttttagtagagacggggtttcaccatgttggccaggctggtctcgaactcctgacctcaggtgatccacccgccttggtctcccaaagtactgggatcacaggcatgagccactgcgcccagctgacttactggattttttttttttttttttttttttttttgagacggagtctcactctgtcccccaggctggagtgcagtggcatgatctcggctcactgcaacctctgctcccgggttcacgccattctcctgcctcagcctcccaggtagctgggactacaggcgcccgccaccacgcctggctaattttttttgtatttttagtagagatgggatttcaccatgttagccaggatggtatccatctcctgacctcgtgatccgcccgccttggcctcccaaagtgctgggattacaggcatgagccaccgcacctggtctgacttactggaatcttttagtgaaggctgtcttttctctcacagagtaaatcctctttcttccttttctttattttctttctttttttgacagagtgttgctctagttgcccaggctggagtgcaatggtgcgatctcagctccccacaacctccacctcccaggttcaagcgattcttcctcctcagccttcccaagtagctgggattataggcatgtgccaccaagcctggctcattttgtatttttagtagagatagggtttctccatatgggtcaggctggtctccaactcccgacctcaggtgatcctcccacctcagcctcccaaagtgctgggattacaggcatgaaccaccgtgccccaccactttctttcttttttctttccttctttctctttttctttctttcttttttttttttgacagagtctttgttctgtcgcccaggctgtagtgtaatggtgtgatctcggttcactgcaatctctttctcctgggttcaagcaattctcatgcctcagcctcctgagtagctggaattacaggtgactgccaccatgtccagctaattttcgtatttttggtagagacgccatgttggctaggctggtctcgaactcctgacctcaggtgacaccttggcctcccaaagtgctgggattacaggtgtgagccaccgtgctcggccaatcctccttgtttcttaaggaggtacagctatgggtaaatccatagctgtcttgggatgacagttgccttgatagaggtgttgtcctgtctttccctgacaacaccctgcagtttaatttaattaagttaaattaagcagctgattgcttaagagttttcaacaatgatgggggcagggcataaattgctcttcaaagtaatccaatcaaatgtgctcctttgaaggaatagtttctgatctcagtgttttgcatttgtcctaatcctaggaggcctcttctcacctgtcttattcaccattccctcttataaactagcggttctccagttctgcctttcactttaaccttcattgtttaattgcttttcattgagagcacccatgatcttgcaaatgggaggagattagaagctacctgttttactgcctgcttctctcccctggcaaaatctcagagaacagggtaaagacaatggcaagttcttgctgagtgacacctggacgctaggacctaagcactcagtgggtggggaagtgtgggagaagccaaattcctctccactggcctctcttgaaatgcaaagtactgggacgagggtgaccagggctccagtctcctcagtgcaccatgcctaaggtagcacctttgtcctgcaagttgggactgaatagcggaagagaaactgctactctcagctgtacttgcctactatcttagattaaacaacaggtagctggaggcaggatgagaaacgctgaccttttcctcatcccaaagataaagccttcttttttatttttattttttattttgagacggagtctcactctgtcgcccaggctggagtgcagtggcaggatctcatctgactgcaccctccgcctcccgggttcaagctattcttctgcctcagcctcctgggtagctgggactacaggagtgcgcaaccaggcccggctaattttcatatttttagtagagacggggtttcaccattgttgggaacaagccccccaaaatctggccataaactggccccaaaactggccataaacaaaatctctgcagcactgtgacatgttcataatggccctaacgcctgcactggaaggttgtgggtttacgggaatgagggcaaggaacacctggcccgcccagggcagaaaaccgcttaaaggcattcctaaaccacaaacaatagcatgagcaatctgtgccttaaggacatgctcctgctgcagttaactagcccaacctattcctttaattcggcccatctctttgttttccataagggatacttttagttaatttaatatctatagaaacaatgctaatgactggcttgctgttaataaatacgtgggtaaatctctgttcgggcctctcagctctgaaggctgtgagacccctgatttcccacttcacacctctatatttctgtgtgtgtgtctttaattcctctagcgctgctggattagggtctcccccaccgagctggtctcagcacaccatattggccaggctggtctcaaactcttgacctcatgatccacccgcctcggcctcccaaagtgctgggattacaggtgtgagccactgcacctggccagataaagccttctgactaagagctgcagggagagggagccctgtctggcagcagcaatctgcagcagattctctgccttgctgatctgatagggaggagagtggtggcagtcttggttcagatacctgagatgcttgcttttcctacagaatattcatagattttattgaataagtgtttctgcattttcctgttgcccttatgacaatttctagagtttttgtttgtttgtttgtttgtttttgagacaggatctgcagccttgacctcctaggctcaggcaatcctcctgcctcagcctcttgagtagctgggaccataggtgcatgctaccatgcccagttattttttaatttatctgtagagacggggtctccccatattgtcctggctggtctcaaattcctcggctcaagcaattcttccacctgagccttccaaagtggtgggattataggtatgagccactgtgaccagctcgtttctagaggttttaagtagttgggtctttatagttttcacaagtcttactggagaataggtcatggagctcctcatgctttcatgctggaatttggtattctacttatgtctgttttttttgttttgttttgttttttgtgatggagtctcactctgttgcccaggctagagtgtagtggtacaatctcagctcactgcaatctctgcctcccaggttcaagtgattctcctgcctcagtctcccgagtagctggaattacaggcatgtgccaccatgcccagctaattttttgtatttgtagtagaaatggggttttaccatgttgcccagtctggtcttcaattcctgacctcaggtgatctacctgccttggcctcccaaagtgctgggattacaggcatgagccaatgcctagcgtgttatagtctttttgttaaagttctgaaaacattgatttttaccatttctgccagtattcttatggcattaatggatgtaaaccaaaaataaaattctaagccccccaaccacctgaatggattcctcctcttggccaagggcattccaaaataaacctgaaacattatttcagaccatcatgggaatgggtggtgggacaggccacattataccttcctctcgttgaaattcaggcacaactgaccagcattaacattaaaacagagaccttgagacggagagagcagactctgtagcaataagataccaacatgacagattgcagtcacaaaataaataaaaaggccgagcgtggtggctcatgtctgtaatcccagcactttgggaggctgaggcatgtggatcacctgaggttaggagttcgagaccagcttgaccaacatggtgaaactccatctctactaaaaatacaaaaaattagccaggcgtggtggtgcatgtctgtaatcccagctacttgggaggctgagacaggagaattgcttgaacccaggagttggaggttgcagtgagccaagcttgtgccactgcactccagcctgggcaacagagtgagactctgtctcaaaaaaaaaaaaaataaataaataaaaatattttatcccaaaatatattgcttcgacatattttgaaatgggcctgcaaaactgtctctttaagtctgataaaaacatttacaatctattctctttgaagcctgcataatagaacctgaatttcatctgcataataagaaccccttattttaaccccagacactcccttctattgattccaaggctttagataaactctcaaccaataaccaatcagaaaatctttgagtccaccgataacctggaatgcacccccttcctgctttgagtcatcccacctttccagatggaaccaatgtacatcttttgtttttttttttgagacagagtctcaccctgttgcccaggctggagtgcaatggagcgattttcgctcactgcaacatctgcctcccagattcaaacgattctcctgcctcagcctcccgagtagctgggattacaagtgcccaccacgacgctcatctaatttttgttttattagtagagacggggtttcaccatgttggccaggccggtctcgaactcctgacctcgtgatccacccgctgcagcctcccagagtgctgggattacaggcttaagccaccacgcatggtggaaccaatatacatcttacatatattgactgatgtctaaaatgtgtaaaaccaagctgtaaccctaccaccttggcacaggatctcctctcgctgtgtcacaggccatggtcaatcacatttgactcacatttcaaatattttacaaagtttcacactttttgttgacttggaggacagaattttttagaggtcctgactttcccattcctactgatattgtcttacccatataatactcacagaagtctttacctttcttttcatctaggatgttttcgctttttggtattacaggcaatgcttctgcgtatatttttgtctatgtagctgggggtacatgtgctcacatttctctagggtatatgtttaggaatgacattggtaggccgcagggtttgcatatctttttttttttttttttgagacagagtctcgctctgtagcccaggctggagtgcagcagcgtgatctcagctcactgcaagctccacctcccgggttcacgccattctcctgcctcagcctcccgagtagctgggactacaggtgcccaccaccgcgcgcggctaattttttgtatttttagtagagatggggtttcaccatggtctcaaactcctgacctcggatgatctacctgcctcagcctcccaaggtgttggaattacagacgtgagccatcgtgcctggcctgcacttccctaattattaatgacattatatgtcctataaccccactggccatttgtatactcttctttttttttgttgttttttgagacagagtctcgctctgtcacccagcctggggtgcagtgacgcaatctcggctcactgcaacgtcggccacgtgggttcaagcaattctctgcctcggcctcccaagtagctgggattacaggtgcctgccactacgcccggctaatttgttttgtattttggccaggctgatcttgaactcctgacctcatgatccatccgcctcagcctcccaaagtgctgggattacaggcatgagccactgcgccctgctgtatattcttcttttagaagtacggcgtcaattcttctgctcatttttctattatctttttcttagtaagttgtctttttgtgtatattttgggtatgagttttctgcctgttagatgtatttcaattatcttctcccactctgaagctttctttctactccgttaatggtatctttttctctaattttgaatttctgatatataggaattgaaaaaataatagagagaattcttgcctgatctaggagtgtctgcgcagctgccaatttgcatctggcatctttcacccagcattcccttatgtgaacatcttacaaaataataaagaattgggtgggcatccttttttcttttctttttttttttttttgagacggagtctcgctctgtcgcccaggctggagtgcagtggcacgatctcggttcactgaaagctccgcctgccaggttcacgccattctcctgcctcagcctccagagcctgggactacaggtgccccccacaatgcccggctaattttttgtatttttagtagagacggggtttcactgtgttagccaggatggtctcgatctcctgacctcgtgatctgcccgcctcggcctcccaaagtgctgggattacaggcatgagccaccgcgcccggccttttttttttttttttttttttttgagacggagttgccacctcctcctaccgggttcaagcgattctcctgcttcagcctccccagtagctgggattacaggcatgtgccaccacgcccgggacatgttggtctccatgttggtcaggctggtctgcaactcctgacctcaggtgatccgcccgccttgggcctccgaaaatgttgggattacaggcataagtgaccgcgcctggcaccccgtctttttttttgtttttttttagacggagtcttgctcttgtcgcccaggctggagtacgatgccatgatctcagctcactgcaaccaatgcctcatgttatcagtgtctgtgaaggagaaagcagagagaagcaatagggcaactgatgggcttgagaacagcagaaccccaaaacacacaactgggattccctagcgagcacagcaggccaatgtgaggagtggctgaaactcggagcagttgtgccctgcctaatggtgagtgaaacgggcctgcagaaggtctacgagtctgcagcagtctagtccctgagagcagaactccccttctgtgacagtgccctacaatgaggagaaactactcaacagaatcaaaattgagcatgatagggacaagggagctcaaaaaccgagcaggggaaagctcagaaagcaagccacatgtttttgcagtatactacatgaaaacagcagagatctgggaaggtacaaaggccatcctaaaccatccctccttccgaaaggtcacattaaaaatgatcaacagacagtggttcatgcctgtaatcccagcactttgggaggcagaggtgggcagatcacctgaggtgaggagttcgagaccagcctcaccaacatggtgaaaccccgtctctactaaattttttttgtatttttagtagagatggggtttcaccgtgttagccaggatggtctcgatctcctgacctcatgatccccctgcctcggcctcccaaagtgctgggattactggcgtgaaccacggcgcccggctcgttttttcgtttaaaacttttctgggctgggtgtggtggtgtgcgcctgtaatcccagttactcaggatgctgaggcagaggaatcgcttgaacctggaagatggaggttgcagtgagccgagattgtgccactgcactccagcctgggcgacagagtgagactcggtgtcaaaaaaaaaaaaaaaaaaggaaaaaaaaaacaaaaaatgattcaagacaaagtgcaaaatattgaagatgggtaaaaccgaacagtaaaataagaggaatccccaaaaaagaagactttcaaaaaggtttgaaactacaagctgaaagaacataatgcatgcccagaactatcactgctaagatatgttctaataaaatattaaggctttaggctgggtgagtggctcacacctttaatcccagcactttgggaggccgatgcaggtggatcacctgaggtcaggagttcgagaccagcctggccaacatggcgaaactctgtctctactaaaaatacaaaaattagctgggcatgttggcgcatgcctataatcccagctactcaggaggctgaggcaggagaatggcttgaacccaggaggtggatgttgcagtgagccgagattgcgacactgcactccagcctgggcaacagagtgagatgccatctcaaaaaaacaaaaaacaaaaaaacacacaaaaaaagttatttgcagaaatttgtggctggcctgcaggtggtaatttgcagactcatgctctgtagggaaggaacatgccctcctggttcctacttctcattagctggtgctctgatttacatgtttttgtaccctccaaaaattcatattggaatttattccctaatgccacagaattggaaggagtggcctttgggagatgattgagtaatgaaggctttgcctttgtgaattgtattaagttcccttataaaatggcttgatggggggggagttcactgcttttttgcccttcttccatatgaacacccagcattcctttccctggaagatgcagcatcaagccaccctcttaaaagcagagagcagccctcaccagacagccagtcctgctgatgtcttttttttttttttttgagacggagtctcgctctgtcgcccaggctatagtgcagtggcatgatctcggctcactgcaagctccgcctcccgggttcacaccattctcctgcctcagcctccagagtagctgggactacaggcaaccgccatcacgccctgctaatttttctatttttagtagagacggggtttcaccgtgttagccaggatggtctcaaactcctgaccttgtgatctgcccgcctaggcctcccaaagtgtgggattacaggcgtgagccaccgcgcccagcctggtttcgatcccttgacctcgtgatccgcttgcctcagcctcccaaggtgctgggattacaggtgcgaaccactgtgcctggctgagttttgactaatatagataataacagaaatttggagtgtgaaggaactgttctgaacattcttccatgtgcatttggtgggctcagtatttttgtttcctgtgatatctggttagttctatatttccaaaattagggaataaggaggtttcgctaatctgctgatgtgcagtgtggtatttctcacgtttacttgactatgtggaaacacttttctagagctttttactgagacttgcaacaccccagtcactctggaagtcatcaatggggaagaaatggagggaaccttggtgttctcctttcccacaaggaaaatcaggtgcacatacaacctatgaggagacatggaggtaagaaggattaatatttgaagagtcggttattttgtagaattttcttcaattttggtttgtctgattttatctattttttttattattactatttttttgagatggagtcttgctctgtcacccaggctggagtgcagtggcatgatcttggctcactgcaacttctgtctcctgggttcaaatgattctccggcctcaacctcccaggtagctggaattacaggtgtgtgccaccatacctggctaattttttgtatttttagtagacacggggtttcaccatgttggcctggctggtcttgaactcctgacctcaggtgatctgcctgccacagcctcccaaagttttgggattacaggcgtgagccatggcgtccggccttcttttttcttttttttttttttttgagacaaagtctcactttgtcatccagggtggagtgcagtgtcatgatcacagctcactgcagctacaacctcccaggcccaagtgatcctcccacttcagcctcttgagtagctgggactacaggggcatgccaccacactaggctaatttaaaatattttttgtaaagatagaatgttgctatgttgtccagactggtctcaaactccttggggtcaagcaatcctcctgccttggccttccaaagtgctgtgattacaagcatgagccaccatgcccagccttgttttgttttttgagacagggtcttgctgtcacccaggctgaagcggcatgaacatagcttactgaagccttgatctccggggctccagtgatcctcctgcttcagcctctcaagtagcggagactacaggtgtcagaggcatgtgaacgacaacaactccatcctgaataggaactgggtaaaacgaggttgaaacctgtgagctgcattcccatacagttaaggcattttaagtcacagcgtgttgggaattggtgggttcttggtctcactgacttcaagaatgaaaccgcagacccttgcggtgagtgttacagttcttaaaggtggcgtgtctggagtttgctccttctgatgtttggatgtgttcggagtttcttccttctggtggggttcgtggtctcgctggctcgggagtgaagcggaggaccttcgcggtgagtgttaacagctcttaaggaggcgcgtctggagttgttcgttcctcccggtaggtttgtggtctcgctggcttcaggagtgaagctgcagaccttcgtggtgtgtgttacagctcataaaggcagcgtggacccaaagagtgaacagcagcaagatttattgccaagagcgaaagaacaaactctccagtgtggaaggagaccccagcgggttgccactgctggctctggcagcctgcctttattttcttatctggccctacccacatcctgctgattggttcattttacagagaggggagaggtctgttttgacagtgtgctgattggtgtctttataatccctgagctagacacaaaggttctccacgtccccactagattagctagatacagagtgtccacacaaaggttctccaagtccccaccagagtagttagatacagagtgtcaactggtgcattcacaaaccctgagctagacacagggtgctgattggtgtgtttacaaaccttgagctagatacagactgccgattggtgtatttacaatcccttagctagacataaagattctccaagtccccaacagtctcaggagcccagctggcttcacccagtgaatcctgcacccgggcggcagggggagctgcctgccagtccccggccgtgcgcccgcactcctcagcccttgcgtggtcgatgggactgggcgccttggagcagggggcggcgctcgtcggggaggctggggccgcacagcagcccacggaggagggggaggctcaggcatggcgggctgcaggtcccgagccctgccctgcggggaggcagctaaggcccggcgagaaatcgagtgcagcgcccgtgggccggcactgctgggggacccagcacaccctccgcagccgctggccggggtgctaagcccctcattgcccagggctggcagggccggccggccggccgctccgagtgcggggcccgccaagcccaggcccacccagaactccagctggcccgcaagcgccgtgcgcagcctcggttcccgctcgcgcctctccctccacacctccctgcaagctgaaggagccggctccggccttggccagcccagaagggggctcccacagtgcagcggtgggctgaagggctcctcaagcgcggccagagtgggcgccaaggccgaggaggcgccgagagcgagggagggcgcacgctgtcacctctcaacaggatgagatagaaggtcggcacaaaatactggtcataaagaccttactgataaaacaggttgcggtaaaggagccggccaaaacccaccaaaaccaaaatggcaatgagtcctcactactacactcccaccagcgccatgacagtttgcaaatgccatggcaacatcaggaagttatcctatatggtctaaaaaggggaggcatgaataatccaccccttgtatagcatatcatcaagaaataaccataaagatgggcaaccagcagtcctcgggctgctctgtcaatggagtagccattcttttattcttttactttcttaataaacttgctggctgggggcggtggctcatgcctgtaatcccagcactttgggaggctgaggcaggtgggtcacgaggtcaggagtgcaagaccagcctggccaagatgttgaaaccccgtctctactaaaaatacaaaaattagccgggcgtggtggcgggcgcctgtaatcgcagctacttgggaggctaaggcagagaattgcttgaacccgggaggcacaggttgctgtgagccaagactgcgccactgcaatccagcctgggcaacagagcgagactccatctcaaataaataaataaataaaataaaaaataataaacttgctttcactttgcactgcggactcatcctgaattctttcttgcgtgagatccaggaaccctctcttggggtcaggatccagacccctttcctgtaacacaggcacttgtcaccaggcccggctgatttttgattttttgtagagatggggttttaccctgttgcccggtctagttttgaactccttggctcaagggatcctccctacttggcctcccaaagtgctgggattggtggcatgagccactgtgcctggccttgtctgatatttatgactagattgaggtaatggattttcaataattttgtggcaataccacagaagtgatgtgcctttctcaatggatcctattagtagatacctaatgttactatattttatatgtggtgatgttaactttgatcacttgtttaaagtggtgcctgccaggattctccactgtaaactattttttcctttgtaattactaaacattttatttttattttttaatttccttttgagagggagtctcgcccagtcgcccaggctggagtgcagtggcacgatcttggctcactgcatctcctgcctcccgggttcaaatgattctggtacctcagcctctggagtagctgggattacaggcacgcaccaccacacccggctaattttattttatttatttatttatttattttgagaaggagtctcaccctgtcgcctaggctggagtgcaatggcgcgatcttagctcactgcaacctccgcctcccaggttcaagcgattctcctgcctcagccaccccaagtagctggaattacaggcgcctgccaccacgcccggctaattttttgtatctttagtatagacggggtttcaccatgttggccaggctggtctcgaactcctgacctcaggtgatccacccgcctcggcctcctaaagcgctggaattacaggcgtgagtcaccgtgcccggcctaattactaaacattttagtagagatgttttgaaactttgcatatatcctgtttcggcttcaagttctgcctactaattttagcattcatccgtggatgttggggaaggccaacttttactttctcaatctgagcaaaatttcactgttttaaggagcaaaacgagcagaattattggacaggaagaatggtaggagagagtagagacctaggcaagggccgctcctgtaaaaattaggtaagtgaaaactagtaataataagtacactcgcggctgggcgcagtggctcacgcttgtaatccagcacttcgggaggccgaggtgggcggatcacgaggtcaggagatggaggccacagtgaaaccccatctctactaaaaatataaaaaaaaattagccgggcgtggtggcgggcgcctgtagtcccagccacccgggaggctgaggcaggagaatggtgtgaacccgggaggcggagcttgcagtgagctgagatcgtgccactgcactccagcctgggcgacagagcgagactccgtctcaaaaaaaaaaaaaaaaaaaaaaaaaaaaaaaaaaaaaagtaagtacactcgcactacgaacagaaggatatcccgagcagctctgagagggctttagcaatcaggcgccgggtcggcttcccggttgccccggagacagggtccttccttgttcggcgccgccatcttgtgtcaccagcccttgcccaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtgagtgtgggcgacccctcgccgccgctcccgggacccttcccgcctcccttcctggcggtcccccgactccgcccgcgcccctctaggcctcaggaaatgcggagacccgggcggcgggcggggcacagggggtccgtgggattgcctcggggcccgcgaggagtcctgggtggccaggggccccggcgcctccgctgcccccggtgcgcgcccgccctcctgcctgggccacgtcagcaccggcctgcccccgcgcgggtcgctgctcacgtgggcagctgctgggatccgcggccgaccagcctcggagcttgcccctgtttgggccgttctcggcaccgctcgggagacctcgggccggtagaacgcacctcccttccgtaaggcgagcgcggcagcccctcggcccggtgccagcgggcgccagacttcatttctcacggcccgacgaggtggctcaagtagaggacaaataaatgaattaaagtgaatttcattctcttaattcagtatctggtccgttgtaggtgcttctttctagacatagagaaccatcagaaatgtaacaggtttcgcatttttaagttggtaatcacttgaaatccctatgaatgtgatgcattttaaggttcctagtgaacgctttctaaatgttaaaactctttttaaagttagttttaaaactcctgcacgtaatataagttctcttatgctgtacagaaaaggaaagtccaattttctcccttccccctgctgcttctcattcttacacctcggcaataaatggctgtgtttggcttaaatgtttccaggtatttcagtgatcaccaaagaaaatgttgggtttgggagtaaagggaatgtacatacacagaggtttggtttttattactattgttgttaaacaatttcattaaatgattacctaattatttgttgagagaatagtcattatagtgtcacatttcttctaagcacacttcgttctctgactgaatatggagctataaagatgggtttatagagattacgtttctgaaatgactcctattttctttcatgcgttgtccatgatgaaataaagttttactcaaaggcttgtggaaagatagatcaaaacttcatgtaaatttgccttgccatctttgaatgtcttgaatgttaaatcccgttctttatagaagccagttgtgatttaatgagcttgttacagtataagtggaccacagcaggagctcggctatcctgccatcatgcctgcgagctaggttaatgtacttattttatcttgtttttattttttctcccaactttattgaggtataattggtatacaaaaaactgcctattattagtatattcaaaatacgtatacactggtgtaaccattaccacaatccgggtaataaacatatctgtcacctccagaagtttccttttgtcctttagtttgtttgtttctgtggtaagatactttcttactgggactctactgtgtgtcagatattatggtgggtattttaaatatattctcatttagccctcatagcaaccatttaaggtataaatcctcatatagcaggcaaggaggctgtagtctgtcaggttaagttatttagccccttacatgcggtcttacagtgcagagtaagtcagggctccagcttattccgtaagttgtgtgttctcacactgtataatgttgcctcttctggcttttatggctgtgagataggattgtattgggtataagacttgcagtcacattaacagatttatttaaaatcattttcaattttgtagtccaagacaccagttaaatggatatatgtgctattttgtactcctatcccagtgggaaacaactggatgataaacttaacaaggagatgtatattttccaacagttgtgttggaaactgatgaggttgctgaaatgtttttcagtgggttcttttctttttctttttttttttgagacggagtttcactctcgttgcccatgctggagtgcaatggcgctatcttggctcactgcaacctctgcctcctgggttcaagcaattctcctgtctctcctctggagtaactgggattacaggtgcatgccaccacgcctggctaatttttgtattttttttttgatgcagagtcttgctctgtcgccaggctggagtgcggtggtgcaatctcggctcactgcaacctctgcctcccaggttcaagtgattctcctgcctcagcctccggagtagctgggactacaggcgcgtgctgccacgcccagctaattgttgtattttttttgtagagacagggtttcacgcatgttggccaggatggtcttgatctcttgacctcatgatccgcccacctcggcctcccaaagtgctgagattacaggtgtgagccactgcgcccggccaatttttgtatttttagtagagacagggtttcatcatattggtcaggctgctctcgaactcctgacctcaggtgatctacctgcctcggcctcccaaagtgctgggattgcaggcgtgagccaccattcctggccttcagtgggttattttcaaacccttgtagaattttaggagctagcagaagggaccatggtggttactgactaggagccagtggttgcttctctttttaccaccaaggacccatctaatgatttttcctctcttttggatcctgtatctgaaatattttggcatgctaatattttattaagtaacaatatttttcaataaaacaaataagtctgtataactgaacacaatgagagttcctgatacacacacatatactagaatgttccttttttttttttttttcttgaggcaagttctcaatctgttccccagggtagagcacagtggcccagtcagagctcactgcagcctcgaatttctgggctcaagctatcctcccacctagccccctgagtagctaggactacatgtgcgcaccactacgcctggctaattaagagcaattttttgttttttcagagatggggtcttgctgtgttgcccaggctggtcttcaacacctagcctcaagcagtcctcccaaagtgttgggattacaggtgtgagccactgcacttggcctggctggaatattcccactgtgataagattctagtcaaagtaatgaaacttgtttgtattagactgtacagctttattgaggatgattgtatgattgtttttaggctttttgatatattttaaaagttctccaatacagctttttgtatcttactgggaatcactacttcagtcctaaaagatagtctaatttttgtttttttcagttgagggtgggttggcagagagatcagtgggatatgtatacccttctcccttgcagtctgctccacagtcttatgattggagataactactctttctcagaaaacccctgcagcctgctggagtgaacatccttttcctggttatgtatcttgttgctgtgagggtaccccaaacagtggtcattggctcctccccaagggtattttgccactgttaaccatttttttttttttttgagaggaagtcccactctgttgcccaggctggagtgcagtggcacgatctcagctcactgcaacctctgcctcccaggttcaagtgattctcctgcctcagcctcccaagtagctggccttaaaggtgcctgccaccacacccagctaatttttttatttttagtagagatggggtttcaccatgttggccagctgctctcaaactcctgacctcaggtgattggcctctcaaaatgctgggattacaggtgtgagccaccgcacccggccaacttttttttttatgagatggagtttcactcttgtcgcccaggctggagtgcagtggcatggtcatggctcactgcagcctccacctcctgggttcaagcaattctcctgcctcagcctcccaagtagctggattacaggcacctgccaccacgcccagctaattgttgtattttttagtagagatgaagtttcactatattggccaggctggtctcgaactcctgacctcaggtgatccgcacccctcctctgcctgtcagagtgctgggattacaggcgtgagccaccatgcctgcccagttttaacttttatattagtgaagaaacagttttaggctgggcgtggtatctcgtgcctgtaatctgtgggaggatcgcttgagcccaagagttcgaaaccagtctgggcaacatagggagatcttgtctctacaaaaataaaaacccatgagacttttttttttttttttttttttgagacggagtctcactctgtcgaccaggctggagtgcaatggcacgatctcagctcactgcaacctccgtctcccagattcacgaaattctcctgcctcagcctccacacgccaccacacccggctaattttttgtttttttagtagagatggggtttcactatattggccagactggtcttgaactcctgacctcgtgatccgcccaccttggcctcccaaagtgctgggattacaggtgtgagccactgcgcccagccctgagacttttctattacatcactaaatacatttctttgagtatgcttatttgaatgtaaatgagaaaagcatcaagaaagaggcctttgggaagtatatttggaagtgtaatctttttgtgtatgtgtgtatttctttttttgagacagagtctcgctctgtcacccaggctagagtgcagtggtggtgcaatctcggctcactgcaacctctgcctcccaggttcaagtgattgttctgcctcagcctccctagtagctgggacaacaggcgagcgccaccacgcctggttaatttttgtatttttcgtagagacggggtttcaccatactggccaggctggtctcaaactcctgacctggtgatcctcccgcctcagcctcccaaagtgttgggattacaggtgtgagctaccacacccagctgtgtgtatttcatcattcaggaaaatgttacgcatttatagcggttttatgccacttttttttttttagatggaattttgctcttgttatgcaggctggagtgtgatggcgccatctcagccggctgcaacctctgcctcccgggttcaagcaattctcctgcctcagcctcccgagtagctgggattacaggcatgtgccaccatgcctagctaatttgtatttttagtagagatggggtttctccatgttggtcaggctggtctcgaactcctgacctcaggtgatccgcccactttggcctcccaaagtgctgggattacgggtgtgagcccctgcgcctggccatatgccactttgtaaaagtaagtctttgacaatattcttgtgtttcagagaaaaaaaaattgttactgaaaagaaaattcaatctctaaaaagttctgatagtttgactgctttaatggggatgttctaaagcacttggttaattattgactcaaaatttagaagccaaaagacatgaataataaactatctttttctgttgtaggtaaagggagaagatgaggaagagaacaatttggaagtacgtgaaaccaaaattaagggtaaaaggtaagctgacaaacaatataccttgtctcttgttaaaggttatgtcagggttgggatcatatgggatcataaactaggagagttgcttaggaagtgcctgctttattacagggttttttttttgtagagaggaggtctagctatgttgcccaggctggtcttgaactcctgagctcaagccatccttctaccttggcctctcaaagtgctgggattacaggtgtgaaccactgcatctgtcctagaggatttttttttttttcttgagacagggtctgttgcccaggctccattactgtggtgccatgttgactcactgcaacctccacctccagggctcaaaccgtccttctccctcagcctcccaaataggtgggactagaggtatgtaccaccacacttggctaatatgtgtgtgtgtatatgtatgtatttttagtagacaccgggttttgccatgtcacccaggctggtcttgaactcctgtcctcaagcagttctttgcctcccagagtcctaggattataggcgtgagtccattacgccccaccgaggatgttttaattaatgtatgtgataataagcaacatgctgtaatatattctggactcatttatgacttctcattactaatgctgaaattggattcccctaagcagtggcagtttgttttataggaagaaagtagttactttctatatcagatcagttctccctcctggttccacagagctttatgtgagaactccaagctgtttgcctcagcaagtattctcctatctatgattggctaccattctgcttccatggggcagacaaccttccccctggatatctcacccctaagccttcagggcattcaaagtggtaacttctttgaaggcctactgtgaaggctgggtggggttaaacttgcatagttgtttgctcagacctcagcacctagcgtggagcctggaacttattagttattattattattattttttggagacagtgtctgttgcccaggctggagtgcagtggtgcgatggttcaagtgattctcttgcctcaggctcccgagtatctgggattacaggcgtgtgccaccatgcccggctaatttttgtattttttttttttgagagagtttcgctctctttgcctgggctggagtgcaatggcgcaatcttggctcactgcaacctcctcctcccgggttcaagtgattgtcctgtgcagcctcccgagtagctgtgattacaggcatgcaccagcacacctggctaatttttgtatttttaatagagatggggtttcaccatattggtcaggctggtcttgaactcctgacctcaggtgatctgccgcctcggcctcccaaaatgctgggattacaaatgtgagccaccgtgccccacaagttttgtgtttttagtagagacgggtttccccatgttggccaggctggtctcgaacttctgacttcaggtgatctgcctgcctcagccttccaaagtgcggggattacaggtgtgagccaccactcctggccccatagtttcaattactgtgtgatcctacctatctttgtttttttttttttttggagatggagtcttggtcttgttgcccagactggagtgcagtggcgtgatctcggctcactgcaacctcagcctcctaggttcaagcgattctcctgcctcaggctcctgagtaactgggattataggcgtccgctaccacacctggctactttttgtatttttagtagagatgggatttctccatattggccagactgttctccaactcctgacctcaggtgatctgcccgtcttggcctcccaaagtgctgggattacaggtgtgagccactgctcttggcccttttttcttttttcttttttttttgagacggaatttccctcttgttgcccaagctgaagtgcaatggcacgtgatctcggctcactgcaacctccgcctctggggttcaagcgattctcctgcctcagcctcccaagtagttgggattaaggcgcgtgctaccacgcccagttaattttttgtaattttagtagaaatggggtttcaccatgttagccaggctggtctcgaactcctcaggtgatgcacccgcctcggcctcccaaagtgttgggttacagttgtgagccactgcgcctgacccctttttttcttgtatgtgagtatatctattcttttcttttttgtgagttggagtctcggtctgtcacccaggctggaatgcagtggtgcgatcttggctcactgcaacctctgcctcccaggctcaagtgattctactgtctcagcctcccgagtagctgggattacaggtgttcaccaccacgcccagctaatttttttgtatttttagtagagagagggtttcactatgttggccaggctggttttgaattcctgacctcaggtgatccacctgccttggcctcccagagtgctaggattacaggtatcagccactacctggccaccttttttgttttctgtgttatcttcatagttgtctttctttggttgttaagtttaatccttgaattactttgagttcatgtacagcaacatcctctcaggagccacattttaatgcgtggtgattatctcaatttttcttggtgattatcttgattttccactgagtgtatgaagtaggcatctcaccagccccgaggctgtaagatctgagagttagctttaaataagtcgctattaaaattgctttctcttgctttaagagactcctctccctctctgaggctgtctgagtaccctgtctgtgtttattggctctagctgctggcttgtagcgtcttggataggcaaggtaacttagttattaggactgtgctttttgcatctttactgcctgggatcaaatcctagctctgttatgtttactagcattttcctcagtttcctcatcagtaaaataatagtgtttacctgatatgatcatggctaagagtcactaaattggccaggcgtggtggctcacgcctgtaatcccagcactttgggaggccgaggcaggcagatcacctgaggttgggagttcgagaccagcctgaccaacatggagaaaccccatctctactaaaaatgcaaaaaagttagccaggagtggtggtgcatgcctgtaaccccagctactcgggaggctgaggcaggagaaccacttgaaccgggaggcagaggttccggtgagccgagattatgccattgccagcctgggcaacaaaagcaaaactccgtgtcaaaaaaaaaaaaaaaaaaaaagattcactaaatcaatatatatataatgtacttggagccttagtaagcacttaataaattttgaattaatcacaaagaaggctaatggaatggaaggaacatttcaggcagagatatctgtaaagatacggagggttgacatttcatggtgtgtttagttaactgggctttcagagtggctcttgctcagaggaaggtgaagctgtgtagggtgggttgagttcagtttaaggactgctctgaaccattattaaaggcgtgggctttatccttaaagcccacagttgggaacattaaaaaattttttttcatagcttaccattttattcatttctagttatatgtgcatacattatatgaatttgtctttatcacctcttcctgccacagaaactgacctatatggggttctcagtaaatcagtttgagtacatgagtaaaaaaccaagtcattcacacaatgttctcccattagatccagctagagaagagctttaggaaaaaaaaaaaagacctgctccatgtacatcagtttagacagttctgtgttgtctagccttttattgattgaaaaaccttcattagctggtgcttccacattttggtaagacttgatgttcctaatgatcttggagtgctgaaaggttctgatttgtcttctgaattatcaaagcaaaattaaattatgtggcagcatttaacaacttgtaaaatgaatgtgggaatgttgatttgagattgtgtagatgggctggggggaagggagattaggagattaataggaagagatgcagtagtctaggcacatggtattggtttgaatggaggaggaggcaaaggaagggatgggtctgagaggaatttctgaggcaggattgcccaggtattggggacagggcagagtgaggcatcagaagatgcctgggtttctagcttagagttgatcagatggcagtggtattaagagagatcaagacttgggatcatgaatgataaggttttgttgaattgcatgtggggtggtcagtggagctgtctagtaaacatttgaaaatttgattttagaattcaggacagagagtgggatgagaagcacatttgggacttgaaactaagaattggttaagactgtcctgaggagaagattccgctacttatattttgagtagtgaacgtcacagttgtaatatgaaatataatggtgtgactgataaagacatgcaagttttgtgttctataaagtcatatcaggaagagtgatccatgttctcacctttgaggacaaactcattgaagcttattaattcaatttttcactagtggtttctacgtcttctaaaaattgttctcctggcttggaaaactgattcagtttagaattagtaccctgtgaattttaagtttccaggccatctgtttttcttttttttccttttttgagatggattctcgctccgtcacccaggctggagtgcagtggcacaatctcggctcactgcaacctccgcctcccaggttcaagcaattctcctgtctcagcctcccgagtatctgggactacaggcgcctgccaccacgcccggctaatttttgtacttttagtagagacagggtttcaccttgttggtaaggctggtcagccatctgtttttctttaaaatattagtagctttatttttttcttgatatgaggatgatacaagctccttataagacaaattagggcctggcgcagtggctcatgcctgtaatcccagcactttgggagcccgaggcgggtgtatcacctgaggtcaggagttcagaccatcctggccaacgtggcgaaatcccctctgtactaaaaacacaaaaattagctgggcgtggtggcggacgcctgtaatcccagctactggggaggctcaggtaggagaatcacttgaacccagcaggcggaggttgcggtgagccaagattgtgccatttcactccagcctgggctacaagagtaagactccgtctcaaaaaataataataataaaaaataaaatgaaattggaaaagacaaactaaacttattctacaaccttgagacagttaccattaacattttgttgaacattccttgaaatactattctttacattcattcatttttttttttttttttttcttgagacggtatctcgctctgtcgcccggctggagtgcagtggcacgatctcggcgcactgcaagctccgccttccgggttcacatcattctcctgccccagcctcctgagtagctgggactacaggtgcccgccacaacgcccggctatttttttttgtatttttagtagagatgggctttcactgtgttagccaggttggtcttgatctcctgacctcgtgatccacccatctcggtctcccaaagtgctgggattacaggcgtaagccaccctccccgggtctatgtatgtttttaaatggagttattctttgtcatttgtaaacagattttcgttatttacattgtacatggacatctttccatgttaatatagatatgtaggttagccatatttctaatgactgccaatattctattgtgtgaagccatatttctaacgactgtcagtattctgttgtgtggttctattaaaatttttttttttgagatggagtctctctctgtcacccaggctggagtgtagtggcgctatcttggctcactgcaacctccgcctcccgggttcaagtgatcctcccacttcaacctctcaagtagctgggactacaggtgtgcaccaccacgcccagctaatttttgtatttttaatagagacagggttttgccatgttggccaggctggtctggaactcctgacctcaggaaattcacctgacttggcctcccaaagtgctgggattacaggcatgagccactgcacccagccaagagatcacctttaatatagtaatttaagtcttttattaacaggacatggtggcaggtgccagtagtcccagctactcgggaggctgaggcaatagaatctcttgaacctgggaggtggaagttgcagtgagctgagatcatgccactgcactccagcctgggcgacagagcaacactctgtctcaaaaaaagaaaaaaataatttaagtcttctaagacagatatgtagctgtttctctcagggctgtttataaatagcaagagtgtaaaacagtgtaaatgttcaacaatggaacaaaagttaaaaacattctaataggtaatcccagctattcgggaggttgaggcaggagaatcgcttgaacccaagaggtggaggttgtggtgagccgagatcgcaccattgcactccagcctgagtgatagagtgagactccatctcaaaaaggaaaaggtgatctcttaaagataattgcttttgtctttggttcaaaattttgttgtgactttgaactgctactactgttttcagtatcctcagtctctcttacttctcttgccttgttcttcctttagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggtaagctcaggtggagtccagcccatccctgtctgcttcagagaatgtcttgcagagtgactactggttgataggcttgggtggtgtggggtggatgaaatctgcagtcatttctaaggtcatcccaaaagtgtttaacctgcagtgaaatgactccatgggggtcttgtttctccttgggggatcacaggtagaggctaggggtagcatttggagaggtggaatgggtgttggagatggaagcaaggcattccacgcagaggcagtaagagggacaaaggctttgagatggtgtggctgggcagatactggggtagcaaagctgttggagtggttgagggccttccttgaatgttgggccttggttggaacttgaagagagagggagcaattaaggcttacaaagattttgttactatggcaaatcgcaaacatgccaaagtacaaagactagtataaactcccacacacgtcacttagattcagcggttatcaggttaccataattaacctacctctttttttctttggtggagtacttaaaaaaatttttttttttaagagacaggatcctgctctgttgcccagcctggagtacagtggcataatcatagctcactgtaacctcaaactcctgggctcagtccatcctcccagctcagcctcccatgtagctggagtgacaggtgtgcgtcaccatgcccagttaattttttatttttgttgtagagacgggatcttgctttattgcccaggctagtctcaaactcctgggcccaggtgatcttcctgcctttgtctcccaaagtgctgggattacaggcatgagccatggtccctggcctttttgctagaggattttaaagcaaatctcagcagtcatgtctttttacctacttctataccatctctaaaaaatatgggtattttagacgtttaagatttctttgcactgggtgcagtggctcatgcctataatcctagcactttgggaggccaatatgggaggattatttgtgcccaggaattcaagaccagtctgggcaacatagtgagacctcatttttacaaaaaataataagctgggcatggtgacacactcctgtagtctcagctacttgggaggctgaggtgggaggattacttgagcccaggaggttaatgctgcagttagctatgattgcaccaccccactctaaaaaaaagatgtctttgcatctctctgtgtgtttagaacatgtgtcaccaaggatgtgcaatcaaaatactttgttctaatgctacttgaaataattgtttctttttttttttttgtctttattttattttattttttttgagaaggagtcttgatctgtcattcagactggagtgcagtggggcgatctcagctaaccgcaacctctgcctcctgggttcaagcaattctcctacctcagcctcctgagtagctgggattacaggtgcccgctaccacacctggctaatttttgtattttttgtagagacggggtttctccatgttggccaggctggtcttgaactcctgagctcaggtgatccgcctgcctcggcctcccaaagtgctgtgatagcaggtgtgagtcactgcgcccagcctgttttttatgtttcaaatgtcagtttgatacatagttagggctgttcgttttgggttgttttaaacttttaagaactttttattaacataattttttgaatatgaaaacaacatgatttcgtagtcaaaattacatataacaagttatgtgtaacaaaatcatataacaagttatatgtaacaaaatcatatataacaagttatgtgtaacaaaatcatatataacaagttgtatgtaacaaaatcatatataacaagttgtatgtaacaaaatcatacataacaagttgtatgtaacaaaattatacataacaagttttatataacaagttaaaaggccaggtgcatatatatatatgtatatatggccttatatatataagtgcacttatatatttatatatatacacacacgtatatatataaggccaggtgtaccattttgttttttatatatacacgtgtgtgtgtgtgtgtgtgtgtgtgtatatctatagatatctatagatatctatatatatatatatatatatatatctatatatatatatatatatatatatatctcaagttataggggcaggcgcactggctcacgcctgtaatcccagcactttgggaggctgaggcgggcagatcacttgaagctaggagttcaagaccagcctggccaacgtggtgaaaccccatctctactaaaaatacaaaaattagctgggtgtagttgcactcaactctagtcccatctactagggaggttgaggtacgagaactgcttgaacccaggaggtaggggttgcggtagccaaggttgtgccactgcactccagcctgggcaacagagcaagactctgtctccaaaaaaaaaaaataatagagaattcttgcttccaattctcccattcatttgttctccttggtaaccatttatgttagctttaggtttattcttctagtgtttccttctaaatgtatgaggatttgtagtaaacatacttatattcctccatgtctcaaaacatagctccctatgtatattgttgcacggtggggttgtttttggggagagagagggtctctgtgcctcctgttgtggttgcagagtgcccagggcccacgtgcccactgtgaagatgacagccttgccactctgagctgtgctttctctaactgcatgatttcttttacttacttcaaactgagtgagagttcatgttgggacactgatttgattttcctctacgcaggcttttaaaaatataaatatttggggttttccactttcctccattttaagttaatagaacgttcatgagaggctgggtgcggtggctcaggtctgtaaccctggcactttaggaggccaaggttggcggatcacgaggtcaggagttcgagaccagcctggccaacatggtgaaaccccgtctctactaaagataaaaaaattagctgagcatgctggcgtgcacctgtaattctaactacttgagaggccgaggcaggagaatcacttgaacctgggaggtggaagttgcagtgagccaagatcgcgtcattgcactccaatctgggcgacagggtgagagtttgtctcaaaaaaaaaaaaaaaaaggtttatggagaccatttggcaaaaaggaagatttgaggtcagttcacaaccactatcgacactatggacattttagtacctgagtcgtgtctaagcatagggctttttaatgtacttattatgcttattgtcatattatgtataaagtattgtgtaatacctttgccacttagaatattctctaaacattttacatattactacattacctttgtcaacctttttttttttttccttaagacagggtcttactctcgcccaggctggagtgtagtggtgcaatctcagctcactgcaacctctgcctcttgagtttaagtgattctcccacctcagcctccccagtagctgggacttacaggcatgtgcgaccatgcctggctaatttttgtattttttgttagagacagggtttcaccatgttggccaggctggtctcaaactcctgacctcaagtgatctacccactttggcctcccaaagtgctgggattacaagtgtgagccactgtgcccggctggcctgtaaacagtttttttgttttgttgtttttgtttttgtttgtttatttgttttttttgagagacagtctcgctctgttgcccaggctggagtgcagtggcacaatctcggctcactgcagcctccgcctcccgggttcaagcgattctcctacctcagcctccttagtatctgggactacaggcgcccatcaccacacctggctaatttttctatttttagtagagacggggtttcaccatattggccaggctggtctcaaacttctgaccttgtgatctgcccgccttggcctcccaaagtttcactgtgcccagcctgtaaaccgtttttaagtggctgactcactgatttgatgtcctagagcttatttgccaagtttctatagttaaacagtttttttctatttaatattataatatacatctctgcatattatacaaaagttatgaatttttgtattctcaggattttctgaagtaatgtttttcaaattgaaggatatgaacattttaaaatctcttgctggttgggcacagtggcttatgcttgtaatcccagcactttgggaggtcaaggtgggtagattgcttgagaccagcttggggaacatggtgaaattccatgtctacaaaaaatacaaaaaattagctgggcgtggtggcatgcacctggaatcccagccactcatggggcttgaggtgggaggattgcttgagcccaggaggttgagactgcattgagccaagattgtgccactgtactccagcctgggtgacagagtgagaccgtttataatttaaaaaaaaaaagaaaaaaaaagaaaaacctcttgctgtattttgccaagtagtttttcaaaagatttaatcaattttttaggattccagtgtgtgaaactgccggtttccttatgcccttgcttgtactggcattaaatgctatcaaatatgattatgagtgaattgtagttttaaaaatctagtcatagaatgagtgaataaactagcgaataaactagttgtaagagctaacaaaatagatcttgtccttttcatggacttttgggaagcaaggtgtgttgggccttattgagaggtagtatttaccacatagaagagtgaaatcgggctgggcacgatggcttgctgggcacggtggctcatgcctgtaatcccagcactttggtaggccaaggtgggcagatcacctgaggtcaggggttcgagaccagcttggccaacatggtgaaaccccatctctactaaaaatacaaaaattagccagatgtggtggcacacgcctgtaatcccagctactagggaggctaaggcaggagaatcgcttgaacccaggaggcggaggttgcagtgagctgaggttgtaccattgtactccagcctgggtgacagagcaagactctgtctcaaaaagaaagaaaaaaaagtgaagtcagaacttagcagaccttgtattgccacttaggtttatgaccttgaacaagatattggaaactgccagggcttgaaatttttatttgtcaaatggggataagtagttcttatttcatcatattgtcttgagaatgagatgagataatgcacttatttagaactcttacaaaactgcctaatacaatcagctccagacacattatttttttgtgtcctattttttgagttaataatatatcatgaatatttattcccatatgttagcaagaagtcctagtaaacataattttaaaatgttgcatacgttagatacatcataatttacccgttctgttgctgatatataggttgtctccaatcaatctgatttaaactaatggtgcattctctgttgccaaaactttgaactatttgtttccttccttccaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaaggtatggaatgttcaacttggacattgtgagaaatgaggactttatcacagctacctattctttgcttttcgaaactagctaaatatttaggcagttgtttagggttgactgatgttcatcttgttgattggcagtgttagaaaccaacagaatcttaaaaaatacccccccatatatatagataagccattttcttttttttctttgagacagagtctcactctgccacccaggctggagcatagtggcgtgatctctgctcattgcagcctccgcctcctgggttcaagtgattcttctgcctcagactcctgaatagctgggattacacgcatgcaccactacacctggctaatttttgtatttttagtagagacaggatttcaccatgttggccaggctggtcttgaactcctggcctcaagtgatccacctgccttggcttctctttcttttttttttttttcttgagacggagttttgctcttgttgcccaggctggagggcaatggcgcgatctcggctcgccacaacctccgcctcccaggttcaagcaattctcccgcctcagcctcccgagtagctgggattacaggcatgcaccaccaagcctggctaatttttttttgtatttttagtagagacagggtttctccatgttggacaggctggtctcgaactcctgacttcaggtgatccgcccacttcggcctcccaaagtgctgggattacaggcatgagccaccgcgcccggccgccttggcctctcaaagtgctgggattacaggcgtgagccaccatgcccagcctaaaccatatattttttttttttttggagacagagtctcgctctattgcccaggctggagtgtagtggcacgatctcggctcacggcaagctctgcctcccgggttcatgctattctcctgcctcagcctcccgagtagctgggactacaggcgcccgccaccatgcccagctaattttttgtgtttttagtagagacggggtttcaccatgttagccaggatggtctcgatcttctgaccttgtgatccgcccgcctcggcctcccaaagtgctgggattacaggcgtgagccaccgtgcccggcctaaaccatattttttaagtgaaaatttgaatagaaaaaggaaaagcatattcatagtactgcgccacccaaacacagctgtcattttgatctatttctttgttcttttgtagtgtttttaaaaaacattttatcatattgcatatacagtttttaaatcttttttgtcccataaatgaaatcttataaacttttttttttacttatgtatgatagaaggggtcagtatgtgaacaaaggtattataccttcctcccatgatcaaaatacactgacagatttggaagatacaataaagtatatcaggtagaaaaaccctttctgtaaccctaccacctagtaatttgatgaaatttcttccgtcttctatctttacttttcttctctgcaaaataacttgcaagattatttttacctttgtattaagtcttcaatgttcacaaaggtatttgcatttcccttaattatttactgtttagaagaatttgggtagttagcacccttgattgagaagtcgacgcaaacctttgtggggaaagttagacttttttaggttgtttatgtttggggactattttaattaagtagtaccatgtgaggatcttggtgcaggaagtcttctgtgtttaggatcatttcctctcagctggttcctggagttttagaagggcatatccactctcttgcagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtcagtcttcaatagtaagggagaaactaaccttttctttaatttcgtgaatttttttctttcaattatcagtctttatagatggggtgtgttcatttgtcattctgaggaaggctggttttatcaggaacaactttttataagtgggtacgagttagtattgtaaaagtaatacatgcatttgatagtcaatccgaacagtatgtaaaagtcttcttcttacttgcagttctgtcatcagatggaaccgctgaaattcctttaaatagtttttgagttatttaaaaaatgaaaattcagagaataataaaaaacacttttatatgaacacccagaactaatgattgaaaacattttgtcatattttctttcaagtctttcttttttttgagacggaatctcactcttgccacccaggctggagtggaatggtgcgattttggctcactgcaacctccacctcctggttcaagcgattctcctgcctcagcctcctgagtagctgggattataggtgcccgccaccacgctcagctaattttttgtatttctagtagagatggggtttcaccatgttggccaggttggtcttgaactcctgacctcaggtgatccacaggcctcggcctcccaaagtgctaggattataggtgacagccaccatgcccggccaagtcttttttttaaacctttttactgaaaaataagatacagaaaaccatacaaaaaatgtatagctcagtgaattattatgaggaagaccttgtgccgctccccaccccctcctgtcaagaaatcaaaatttgctagctactcaaaaagtgttccatgtacctcttccttctcaaagtcattgccccgactttgagtaatcactttcttgaatatctttgtagttttatcacccaagtgtatatctctacatactataccttagttttgcccttttcaatctattcaatttgccttatctattaatctgcagttaatacctacatctgtttttcttggcttgatcttcactcactgcaacctctgcctcctaggttcaagcgattctcttgcctcagcctcccgagtagctgagactacaggcacccgccatcatgcctggttattttttgtatttttagtagagatggggtttaactacgttggtcaggcaggttttgaactcctgacctcaagtgatctgctcgccttggcctcctaaagtgctgggattataggtgtaagccactgtgccaggcctgttttttcatttaaaacttttctgggaggctgaggtgggaggattgcttgcactcaggagtttgagaccagccggggcaacatggtgaaaacgggtctctacaaaaaaatttttaaaaatgaaaaattatctggctcacacctgtagtctcagctactcgggaggctgaggcaggagtaacacttgagtccaggaagttgccctttagcctgggtgacagagcaagaccctgtctctaaaaaataattaaagttgcttttctttgcatttatgttaaagcattattatttgttgttattcactctaatccatcttaattagccttaattcctaaaatgcctcttttatttctaaatttttttcctgatttctatcatttttctgaatttttcttttttttttttctgtctcactttgttgcccaggctggagtgcagtggagcgatctcagttcactgtaacctcccaggctggagtgcattggcgcgatctcagctcattgcaacctccgcctcctgggttcaagagattctcctgcctcagcttctggagtagctgggactacaggcatgcaccactacgcccagctaattttttatttttagtagagatggggtttcactatgttggccaggctggtctcgaactcctgacctcaggtgatccacccacctcagccttccaaagtgctgggattacaggagtgagccaccgcgcccggcctgaatttttctaattattgtttacattgttcttgcatgacttacatgattttattaatacctttagcttgttttggaatagcaggagcagtctcctggttcgtttttatgggcgtcttgctggcatgttttcattttcttacaggggtgttcttgttttcatcccatttttcttatataacttaatcttttttttttttttttttgagatggagtcttgcactgtttcccaggctggagtacggtggcacaatctcagcttactgcaacctccacctcctgggttccagtgattttcttacctcagcttcccaagttgctgggattacaggcatgtgccaccacacctgactaatttttatagttttagtagagatggggtttcaccatgttggccaggctggtcttgaactcctgacctcaggtgatctgcctgcctctgcctcccaaagtactgggattacaggcatgagccactgtctgttgatcatttttaatgtgacctttccgaaggagggatggtttagagtggcttttgtaccttcccagatctctgctattttagtgcaaaaacatgtggcttgctttctgagctttcctctgtgcggtttttgagttccattgtccctatcatgttcatttttgattgtgttgagcagtttctcctcactgtagggcactgtcccagaaggggagttctgctctcagggactagactgctgcagactcgtagaccttctgcaggcccgtttcactcaccattaggcagggcacaactgctccgagtttcagccactcctcacactggcctgctgtgctctctagggaatcccggttgtgtgttttggggttctgctgttctcaagcccatcagttgccctgtttcttctctctgcgttctccttcacagacactgataacgtgaaggtcttgtggctgtcggtgttttgacccccatccctgtctctgtgttgtggggttcagtagagatactttgttgcctggttttgttgtaaacatggtccgtgggtttttggttttgctgtctacttgctctgtctttatgtgagcccctgtacttctttctctcctgcccatttgatccgttttccacatcattgcttatgcttgcttgatccttcaggtgaccagtatgcactgaagatgaggtttgtggaccatgtgtttgatgaacaagtgatagattctctgactgtgaagatcatcctgcctgaaggagccaagtgagtgtgactgttcctctcctttgcacccgatttctctggttgtacccttgtggtaccctaaggagagcctatgttctaggggcacagtctttgtgtcacttttctctagatttactttatcagggaacatctacttggcctctcttgagtcacatgtccactctgactgccagaatgagagaccccttgattttcttcctgtggagaatgttccatagtggaagagtagttcctcatgcaaatccaggctgtgctgtttaccaggagaagggacagtgggcctgggcagacaaaagcaggacatgtcccctgccccgtaagaagctcttattcatgtgaagagaaagaacattcagaacagctcgtgaggcatctgttcaagcctcccagggattcactgggtaggatgtacaggagagctgtgtcaactttgtgactccaaggagtggggccagtactggtgagaacttgggagtggaggattcagagggacagttgttgccccagcagacaagggctttaaaacaaagggctttctggcactggctcccctgtctcaagagagtgggtgttctccatagctgagaagggagcagagtggaggagtgtgaatttagtgatcttgaaaggctccttagccttggaattctctgatcctaaatctggtttattgatgtagttggttggaggctatattttattcccatcttcttccaggaacattgaaattgatagtccctatgaaatcagccgtgccccagatgagctgcactacacctatctggacacatttggccgccctgtgattgttgcctacaagaaaaatctggtagaacagcacattcaggacattgtggtgagtggctccactgtttgccttccatggcgtcttccccagacagtgggctctgggggccaagaactcaccttctgtccctccttgggctggagtcatttgagctcatggcgtcttctggtcttggggtggggcagcaggtcgagtgggccagcctgggtgagtctaggctcccatgtccctacagccccgatgaagcctgtcctcttgcttctcccaggtccactacacgttcaacaaggtgctcatgctgcaggagcccctgctggtggtggcggccttctacatcctgttcttcaccgttatcatctatgttcggctggacttctccatcaccaaggtaccgtctctgccttcttcctgcttgtcatttgtgtccttggtaatatttcaccagcttgagcactgatcctcacagtgagcccagggcaggacgccatggccaaaagacccctgcctgtgctcatccttgccggaagggtactttgtttttgttgcttgtggtcactagcacaggaggttaagtccctgcttctgtcttgctttggctctggagacagagtaacttggatgctcagttgaggtaggaaaaacatgaaaagattggtgcttatttagctgttttgcttcttgttattcagtggaacttggaggtggaagtcccctcttagtcccctctccctccccacctcccccttggtgattccttgttgggagcagaaaccactgacctggccctgtcagcaccgttctccccactcccactctctgctccctgacaggctccgtggctccttggtcctccccaggctgcactgctgttatcctcaggtcatcctcttgctcttttcttccttccttcctccatttctcattctctcattgttccttagggctcttggctccatgccccagggtaggcactagtaccaggcacttattgtagtcaggtgggtgaggcctggtggaggagatgagcacagctggtgcttgaggactgtggaatgtgatgacaggcacagcgtgtgtttttttttttgagatggagtctcgctctgttgccatgctggagtgcagtggcgcgatctccattcactgcaacctctgcctcccgggttcgagcgattctgcctcagcctcctgtgtagctgggaccacaggtgcgcaccaagggtgtgcttctagtggggcaacttgggaggccccaaggctaccctgaggaggtgacaggcaaagaaggtggggaagggcattcagttggaggggctgatgtttgtgagacagcagggaggggttttggtaggacctgtgagcaaagatgttgatccagccgaactgtgtgggtccacttatatgcagatttttttcttttcgttttcttttttttttttcctgagacggagtcttgctctgttgcccaggctggagtgcagtggtgcgctctcagcttgctgcaacctccgcctcctgggttcgagcaattctcctgccttggcctctcgaatagctgggactacaggtacgtgccaccacgcccggctaattttttgtatttttagtagagacggggtttcaccgtgttaggatggtctcaatctcctgacctcgtgatccacccgcctcggcctcccaaagtgctgggattacaggcatgagacaccgtgcctggtcagatttttataatcaaatgcagataggaaatacagtactcaatacagtgtttgagggaactgaaaccaaatatgtggagggctgactttttgtatacttgggtttcacagggctgactacaggacttgagtatgtgcagatagtcggagatgcgggggggcgggggctcgaggaataactgtgtgtgtgtgtgtgtgcgtgtgtgtgtgtgtaattatttctgctgaatcattggaggttaagttgcagacgttgtgcccctttacccttgaatagttgagcatgtgtgtagcctgagagcaagggtattctcttacataatcataatacaatgatcaaattcaggaaatgtaatgttgccaaaaatctggtagaacagcacgttcagaactttgtggtgtgttctgccttctgtgccttcttcctcaaagaatgggtaatgtaattgtccattagttagttaatactattaactggccagttaattagtactgttgaccaacatccagtccataattttgctgactgtcccccgatcaatcacagctcactgcagcctcaaactcctgggctcaagccatcctcccacctcatcctcccaagtagtttgggactacaggagcataccatcatgcccagctaattaaaaaaatgttttttttctcgagacagagtctcactctgttacccaggctggagtgcagtggcacgatcagggctcactgcagcctcgacctcctgggctaaagagatcctaccatctcagctccctgagtagctgggactacaagcatgcaccaccatgcccggctaattttctgtatttttattagagatggggttttgccatgttggctaggctggtctcgaactcctggactcaagcaatctgcctgcctcggccttctacaatgttgggattacaggtgtgagccactgcacctggccaaaatatttttttgtagagacggagtctcattatgttacccaggctggtcttgaacgcctgacctcaagtgatcctcctgcctcagctgcccaaagtgtggggattataggtgtgacccaccattcctggtcctttctttgtgtttaataaccttgacatttgtggtgttgtagagaccagttttatagaatgtcccttaattttggtttatctaatgtttcctgctgattaaatgggcaagactgctgtaatatatatgcagggcacactgacattatcatccttgttcacatctatctgtctgccttactggactgtgaagtgaaatgtctgcttcatctttttttttttttttttgagatggagtttcgctctgtcgcccaggctggagtgcagtggtgcgatctcggctcactgcaacctccgcctcctgggttcaggtgattctcctgcctcagcctcctgagtagctgagattacaggtgcctgccaccatgcccggctaatttttttttctatttttagtagagatgggatgtcaccatattggtcaggctggtcttgaactcctgacctcgtgatctgcccaccttggcctcccaaagtgctgggattacaggcgtgagccaccaggcccggctggtctgctcatctttatggccctagttttgcccattgctgaacctggtccagattaggtatcagtaggggtttgactttgactttccaagaaggtggcatttcatttttggatggctgctggtggcagatgttctttgggagataaggtcagagtggacccaagcctggatgttgtcacacatggtgcctctccttccttcaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtaagtgtcgggcgtcacagagttgcttggcttggggccctccatgcctcactgctttgtctagggcagacactgggcagctctcttgcttacctgcatgcttgtgggataagactgcatctggccataacttttcatgtggtgccagtccttgtggaggaaaaagggatttttggggtcctggtgtgagctgggtgtggaggaagctctgctagcctcgtcagcactgcgtgcccttgtggccagtattgagagtagctgcatcctctcctggaggccagactgttctaggtcccaggctgcttatgttgtggtaaaatgaacctagactttagaatcaataggtttgaatccaggctctgattcagagtttgtaaacctggccaagtcacctaacttctgtgcctcagtttcctcatctataaaatgggaatgctgttagcccctcataggggttctgagtgtgaaatgagttaatgcatgcaaaatattcagaaccctgtcctgatacaagctatgtaaaggagttatctgtaaatgaggacagtaaccttttcgcagaggtgcccctcagagtcactgactcccctgtccactccctggcattccctctcctcactctgtgtgaatttcctcatagcacctaccactttttttgttgtttgtttttgagacagggtttcactctgtcgcccatgctggagtgtagtggcgcaatctctgctcactgcaagccccacctccaggctcaagcgatccttccacctcaagtagctgggatcacaggtgcacaccaccatgcctggctaattttttgtagagatggggtttcgccatgttgcccaggctggtcttgaactcctgagcccaagtgttctgcctgccttggcctccaaagtactggaattacagatgtgagccaccgtgtctggcccacgcctaccactttctgaaacgatttattcttctacttaagtgttaattatatgtcagcatctgtggacaagatcccttatctgtccttagtgctgttttctggaacctagaattgtgccgcgcgccatggctcactaaacatttgttgaatgttgaatgaatgtgactataccagtcctcaatgtgacgtacagtaggtgacaatgcctgtcacccccccttcccttgccattgatcttttgcctaattgaatccctggaactgatttgacaagctgcaaggagagaagtgatgttcatagaggagctgctatgtgccaggggcatgataggtgctgccaagtagtttcatactcagtcctcagagtcctagaatggagatgaggcccagggatggtgcagggcttgttcacaagggcgtaagaacggggcttgtgggtggtgaagttggcatttgaagccaggcctatcttcctccatagccagccctgctgccctgggacactgtgctgttggctgcatttgtggctgatacctgtggagctctggggtctgtaggcctgggagatggtggggcctgctgagtggggtgggaggacagctcacaagtcctgccctgctcttgcctcggccaggtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaagatatttttcagcctataaagccccctgttttatgcccttctaattctgatgtttgggtattgtgtgagtgcatgtgtttttttttttttttttaaagcgtgtgtgaacaaatggaaataaagcagggactgtgaa

SEQ ID NO: 641 - DNA, 51056 bp, Homo sapiens
ataaggatcttcttggagaactggggcatctgattggaacacctgcgaaagcttaagcgatgaggttgtgcccctcttgcagtacaaggctgcaaattatccaagccaagggcagaaatctcaatgtccttgttactccatatggccttgggattctcccatggccctccagtaaagcgctgctaggtcccggaaaggctgtggcagtggtggggttggggttaaggataatcccactccttggccagtggatggacagtcacccatgtctctactgtggaccacaggacagcgaaggcaccaactggcagacaagtcccaggtgggagcgagtataaggatgcgtctccttttcttccttctagagggtaactagggggatatggagggagcatgcacggtgggaggctgaggattgccacattcgattcatgagttattgtttgctgatggggtcctgagattctgactgagatctgtaattctgaagccttctcactcttcctggcagatggccaatgtttcagtattgagtttgtaagggtgctatttatgaggcaggaaaagaaaaaaaaaaatgtgttgttgtgttgcaccgcagggctatcaagtgtgaccccaatatatttctttctttttctttttttttttttttttgagactataaatctcactctgtcacttaggctggagtgcagtggtgaaatcacaactcactgcagccttgactcccacctcagcctcccaagtagctgggactacaggcacatgccaccactcttggccaattaaaaaaaaattttttttagagacaggtctccctgtgttgcccaggctggtctcaaactccctggctcaagtgatcattctgcctggacctcccgaagtgctgggattacaggtgtgagtcaccacacctagcttaccacagtatttcttaaatctcagtggccagacctgggataagttgctattcaaaagcagcttgtaggttttttgttttgttttgttttgtttttgagacagagtctcgctctgtcgccaggctggagtgcagtggcgtgatctcggcttactgcaacctccgcctcccgggttcaagtgattctcctgcctcagcctcccaagtagctgggattacgggcacgcgccaccacgcccagttaatttttagtagagatggggtttcaccatgttggccaggatggtctcgatctcttgacctcgtgatccgcctgccgcggcctcccaaagtgctgggattacaggcatgaaccaccgtgcctggcagagcttgtagttttctgatttatgtgtgtgtgtgttttttaacttggaaaaaaaaattgttctcttaggatgtatgattcgtgtttaaatgaagactgctcttttatttgggagaatcctctcccagtacttgagcgggcttcttggtttggcaaaggcaaagcccaactctcaatagtgagtggaagggacagacgtaactgaactgctttgcacaataatgccaatgactgtcttttgttaataggagtcctgactcttgattacatttacggggagtccagcctgaaatagtcggggtagaggtagagggaaaagtcccttctgttggcagcttgccaaaggtgttacgagtaaagggatggccttgaggtgaagggaattcctttgcgagacaataggccagggactatagatgctacataatctaatagccacttctaagtcttctcagctttgtaatgccccaaactttcagcaacagcctggttggtgtttgctatgcttaggggaataagggaggcgggtgtgtccacacttaggatttgcttccatcctctaggatatgaccccagcccccgaggccagagtggtggtagcttcaggtgtgtggctggtgattctgaagctctagggggtggcttgcagcacaattctggaatgctacatatatatatatatatatatatatatatatatatatatatatatacacacatacacacacacacacacacatacacacacacatgtatttattttatttatttattttttgagacagagtcttgctctgttgcctaggctggagtgcagtggtgcaatctccgcttactgcaacctccacctcccaggttcaagcgattctcctgcctcagccttccaagtagctgggattacaggagtgtactaccatgcctggctaatttttgtatttttttttttagtagagatggggttgtctcaccatgttggccaggctggtcttgaactcctgtcctcaagtgatccgcctgccttggcatcccaaaatgctgggattacaggcgtgtgccaccacacccggcctggaatgctgtctattgaggaaaggaagaggctgtactggggagtgccagcgttgaagttcaagcaagtgtaaaactctggccttaactgaatcacaagtaggaaacaagttaatcaggaatggatttgtggggcatgaaaacctttgaggattcttaggattgtttggaagaggggactggattttctatcactaaatagggtgggatttgttttacagttgataattttttgatggggtgcgtcagggtcccactctgtcaccctggctggagtgcagtggcgtgatcacgactcactgcagtctcaacctcctgggctcaagtgatcgtctcacctcagcctaccaagtagttgggactacaggtgcgtgccaccacacccggctaatttttgtattttttgtaaagatggggttttactatgttgcacagactggtctcaaactcctgggctcaagctatctgcccacctcagcctcccaaagtgctgggattaaaggcaggagccaccgcgcccggcctatagttgacaattaactagaagtgtgacattggaattatagagggagagtaacgagactcattacttactagcccagggtaggagacattagtgggccgcaggtttcatccttaaatttctgtgaagcctttcttgaggacatctgccctttccttctctccctcagtgtgtggttttcctttctctggctcccactgcactctgcacatacctttatcacagcaaccacttacggtgtattgtaatttgtaattatctatgtacatgtctccaagtagactgacctcaagggcgagggactggcgctggtactcagaccccgggttcaagttccagccacgtctctagctagttttgtgatcttagacaaataacttaatcgctctatgcctcaatttccttgacttataaaactggcttaagactctctgtcacacgccattgctgggcatattaaggtgacaatgcgtgaaaagtacgaggcaaaaggtaagtgcaaaataaagggcgcctaaaacggtaaacgtgtgttaattaacctgatctacctttacatgtgcattcagcaaacactgagcacctaatgtcctctgggaccccggaacgcctcctccggagtggagcagcctcacatgtggcctgtgggccttgtcccacgggccggctccggattggctccgccgaagagaaaaccctgccgacagcccttccgatctcgtcagcgattgggccgggaccgtcccacaattactcttgttgctgggctcggaaatagggagcggtgctaggttgcgcgtgcgcagattgagaatggagctttccggtcgggcgggaggaggtgacgtcaggagtggtggcgggcgggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacaggtgagacgagagggggctgagcgccagcctggccttaccccctcccccacagcgggctcctcggccgtgatagctttgattcagccaggctcacccgaaacaggtcgccgggatcctagtgacgtagtcgctcccgccaggctgtagggaggcagctcctgatgaaggaggagctggtcgtcttcgtagcggccggtgatggcagggtctttgacattcttgtcagaggccaagctggttgctgataacaaatggggctttgccgctcttaggctgaacactaacattgaaggaatactgtctttgttgtggctcactgtttacaaagcaccctcgcaagtgtcatctgcagacattaagtgcagttgaagtgagattcatagcttgcccaaagccgttttgactgcaagtactgtccttgcagcaagaaacagcacctgttttgttccaaaacagctgtcaaacagtctgtgtgtttggggccagaagggttttgtgctttagaattagtgaatgagtaaaaaggcttaggtgcctcactcctttaaaacaatcactagtctgtactcttaaattcggttaaaatttgggggaaacgcaaagctattcttttctttttttctttttcttttggttgagacggagtcttgctctgtcgcccaggctggagtgcagtggtgcgatctcggcttaccgcaacctccgcctcctgggttcaagcgattcccctgcctcagcctcccaagtagctgggattgcaggtgtgcaccaccacgcctggctaatttttgtgtttttagtagagatggggtttcactatattggctaggctggccttgaactcctgacctcaagtgatccgcccaccccagcctttggaagtgctgggactgcaggcatgagccactgcactcagccccaaaagctattcttatttagcatctactctttggagtgtcccattttattgtatcgacctccttacctaaaaatctggaaaataaaatactatacaaattctatgccccctcttcaactttagtgatcaagtgttaattttttttttttttgagaaggagtctcgctctgtcccccaggctggagtgcagtggcgcaatctcggctcactgcaagctctgcctccgggagtcacgccattctcctgcctcagcctccccagtagctgggactacaggcgcccgccaccatgcccggctattttttttttttttttttttgagacagagtctcattttgttgcccaggctgaagtgcggtggcacgatctcagctcactgcaacctctgcccactgggttcaggcgattcttctgcctcagcctccggaatagctgggattacaggcgcctgccactgcacccggcttatattttttgtattttttttagtagagacggggtttcaccatcttggccaggctagtcttgaactcctgacctcgtgatccacccgcctcagcctcccaaagtgctgggattacaggcctgagccacagcgcccggccactaccggctaatttttttttttttttttttttttttgaggcggagtctcgctctgtcgcccaggctggagtgcaatggcgcgatctcggctcactgcaacctccgccttccaggttcacgcctttctcctgcctcagcctcccgagtagctgggactacaggcgcccgccaccacgcccagctaattttttgtatttttagtagagacggggtttcaccgtggtctcgatctcctgacctcaggatccgcccgtctcggtctcccagagtgctgggattacaggcgtgagccaccgcgcccggccctcgcccgactaattttttgtattttttagtagagacggggtttcaccgtgttagccaggatggtctggatctcctgacctcgtgatccacccgcctcggcctcccaaaatgctgggactacagacgtgagccaccgggcccggccgttaatttcattttttaaattaagcctcaatatcaagaaaagtggaagaagtgttcatttgtgggagcttgagagaacaagatgtctaatacattagtctgagaatgcaggttattgatgagattggttgttggctaaattgcatcgtgtgttccagagatacatggttttgccttatttttctctcctatctttccgttgggttgatataaggatcatttgagaacgtggtgtaaagtgcctaaactgatgcttaatgtatataagggtagtatttgtctgtcctactctggggccttttgcagagtctggtgcatgataagcacttggtccctatttatggaataagggaaagctaatttcctctcccttgtcctctccttgatgtgaatccctgctagtcagtggaacatggtttggcgatcaaaaccttgatctttactatactttaggtgttcacatccttaatccaaaacaacacttctcagtgtaaaccaattttcagtcaaaatgaagcccggcagggcttgttggaatgtataaagttatgagctgaatggaatcctgggatctcattctattcattttttttttttgcatgtgtgaatataattgatcataagggttcagagagatgatgagtaatatactatgaccctttagcattcttgacatctgggtcctgaaactttcctcaattccaaagttctttattaccatcataatgtagtttgcgtgataaaaatgaagttaaatataacacttgattaagatttgtcttttttaagttgtagaacagttttttttaactcccttacacacacacaaaagaaaaaacagtaaaaaagaattgtcttttaaggctgttcatattaatactgtcacctaaagtaaaagatggctttctttggggatcattttcaaaaggaaattgcttgtttgttgtttttaaatcatttctggagcgaaagagaaaatactgtcctaaactcttacctgggttcatttactagctaagtgactttggccagttttaagtttgtactttaaccagatggcaaattattatttggtaagaagtttgtttctctctcaaatagttgaaactgtagcagtaagtcttcgcatgtgaaaagcctactatagaatagcattctctcttttgttttgcttttatttttagttttatttctttttaaaacaaggtctcactcttttgattaggctggagtgcagtggcatgacctgggctcactgcagccttacttcctgggctcaagtgatcctcctgccttagtgtagctgggaccacactcacttaccaccaaggctggctaattttttatttatttttttatcgtagagatgaggtcttactttgttgcccaggctgatgtcaaactccaaggctcaagcgatcctcccccttggcctcccaaagtgctgggattacaggcacgagccactgtgtcccaccagcattctcttttaaaacatcagttggatctcattttatgacaaagtgatagaagggggatgtgttatatgaatagtaagtttacttacagaaatgaatgtgtgtgtaaatctatatatatatatttttttctttctctttttcagcactctgttttctacagtggacactgatgaaataccagccaaaagaccaagattaggtactgaatataaattttaaaaatttttagtttttaaataggaaaaatatatgcatggaacaaaattcaaaaggtaaaaagtatctggtaaaaagtaagtcttggccgggcgcagtggctgtaatcctagcactttgggaggccaaggcaggcggatcacctgaggtcaggagtttgagaccagcctggccaacatggcaaaaccctgtctctactaaaaatacaaaaattagcttgctgtggtggcaggagcttgtaatcccagctactcgggaggctgaggcaggagaatcgcttgaacctgggaggtggaggttgctgtgagccaagatggtgccattgcacttcagcctggggcgacagagcaggactgtgtcaggaaaaaaaaaaacaaaaaaacttaagtctctttcctggcccgacgtggtggctcaaacctttaattccagcacttcagaggctgaggtgggaggatcacttgaggtcaggagtttgagaccagcctggccaacatggtgaaaccccatctctactaaacattaaaaaattagccaagtggtgcacgcctatagtcacagctactcgggaggctgaggcacgagaatcgcgtgaacctgggaggcggaggttgcagtgagccaagaatctgctactgcactctgcactccagcctgggcgacagagcgacactccatctcaaaaaaaaaaaaaaaaaaaaaaaagaaagtctcctttttttttttttttttttttttgagacagagtcttgctctgtcgcaggctggagtgcagtggcgcaatctcggctcactgcaagctctgcctcccaggttcacgccattctcctgcctcagcctcccgagtagctgggattacaggcacccaccaccacacctggctagtttttttgtatttttagtagagatggggtttcaccgtgttagccaggatggtctccatctcctgacctcgtgatctgcccgcctcggcctcccaaagtgctggggttacaggcgtgagccaccgcacccaacccaagaaagtctctttcctatccctttcttatcttttctagaggtaactactgttaccagggacttgtctaatccttgcaggtaaataagcctaggtgtagactgtgcattttaaaattctaaatcattctacaaagaaaagatacttcttatttatttattttttgagatggagtctcgctctgtcacccaggctggagtgtagtggtgcaatctcgactcactgcaacctccacctcccgggttcacaccattctcctgcctcagcctcctgagtagctgggactacaggcgcccgccatcatgcccggctaattttttgtatttttagtagagacggggtttcaccatgttagccaggatagtctcagtctcctgacttcgtgatccacctgcctcagcctcccaaagtgctgggattacaggcgtgagcccccgcgcctggccctacttatttttaaggaggaaatgttgtaaatgtttcaaactgaggtgactctagttcagatggctgagggaacccatcttttctatttttttttttcgagacagggtctcattctgtcacccaggctgggatgcagtggcataatcatggctcactgcagcctccacctccctgggcccaggtgatccttccatctcagcctcccaagtagttggttgggcctacaggcacgttatcacacctagctgatttttgtattttttttgtagaaacagggtcttgccacattgtccaggctgaaaataggcagcagtggcattttgaaagaatactcctgtctttaagaaccggtaatatttctttttttttttttttttttttttgagacaggatcttgctctgtcttgatcttgtcatcaacaatttttttttttaattttgtaagaggcaagggtatcactgtgttgcccaggcttcagtgcagtggcacgatcgtagctcactgcagtctcaaactcctgggctcacacaatcctcctgcctcagtctcctgagtagctgggactataggcccataccaccacacctggcaaattattttgtatgtggatactgagtctccatatgttgcccaggctgatcttggaactcctgcccttccaaagtgccgggattatggatatgagccactgtgcccagccaagtcttttacttcagtatatctgaatggataaagaaaataaaagtagattaaaggaaaaaggcatagtaaaatgctataataatatattcctctttctcaaaaatgattataaatttgggtctacctccagatgtggtaattgagtgtggacatatttgtgttaatatttcgtttaaattcagtgagtacttattgagcatgtctcagtgctaaccaatgtgttaggttttacagaaaatacaaaaattagtaagacagggtctcctttttttttttttttgagatggagtcttgctctgttgctcaggctggagtgcaatggcacattctcggcccactgcaacctccgcctcccaggttcaagtgattcccctgcctcagcttcccaagtagctgggactacaggtgcccaccaccacacccggctaatttttgtatttttagtagagacagggtttcgccatgttggccaggctggtctcaagctcctgacctcaagtgatccacctgccttggcctcccaaagtgctggaattacaggcgtgagccaccgtgcccggcctgggtctccatttttaaggaccttatatgataatatggtagggggtataagacaatcacataataatgctaatgtcaatgaaaatataaaaaataaaaaaacaaagatagtaacaaaatcctatccaattttcagctcatcgagtctcagtaaatgtttgcgggagttagtatgagttagtatgttagcccaggtcttgaaggatggataggatatcaaaggagagcaataggaaggaaaaatattctaggcagagggaatagtatgggaaagttgtgtaaattcaagaaatagtgaatagagctcagggaaaaaaaatggctgaagacaggtagatcaaattatcgttctgttttgttttgtttagttttttaatagagacagggtcttgctatattgctcaggctgatctcgaactcctgggcttaattaagtgatcctctcaccttggctttccaaaatgttgggattacaggcgtgaaccaccatccccggccaaggattttcaaatgacaggaatttatactaaattcattagaacagtatttcccaaagcacaggatagataccaatttaggaaatgattttaggggattcaacattcacagcattatgtaacatttgaatgatgattatgtactaagaaaggtgtatccttttcagttatttatttgaggtgctcacatcctgtttatttcacacagaaaatcttgatttaatgctagtatatcttcaatacttgtctaatatatgctaatctcccattttttaacaggcccaactagaacttagtattattgtgttttcatttctttttttttttttttttgagacggagtttctttctcgttgcccaagctgcagtgcaatggtgcgatcttggcttgttgcaacctccacctcccaggttcaagtgattctcctgcctcagcctcccgagtagctgggattacaggcgcccaccactatgcccggctaatttttgtgtttttaatagagacagggtttcaccatgttggccagactggtctcgaattcctgacctcaagtgatcgcccgcctcggcttcccaaagtgttggtattacaggcgtgagccacctcacccggctgtgttttcatttctttataaggcaggtgatgttggctttacatatacagtagtaatttaaaattatcttttttttttaagccaaaaaaggaagtcagttttaaagaaaaatataaatagcttgtacttggatgtggttaaaaaaaaaaaacacacacaaacgttggtattacagaaggtttctgacttaattatttaggacaatcatctgttttatggattctatgttaaggatcacttattgcatcattcccattaaatatgtagtatgattttctgaatggcaaattgtagaagggaatctaaaccaaagggtaagcggtgggtagcagagtttgtaaaggcctgtaaagtgctgcccaagagaacttcctgcagtgataactgttgagcactcgaaatgtggctagttcaactgaggaactgaattttaaactttatttgattctaataaaactttaagttaggtaaccatatctggctactagctactgtgttggacagtacaactccattggttgcttttgagagaaaaaaaagcaaagcaagggtaaaagaaaagaaagaagacctcagaatttcaggctcatgatctttttttttttttttttgggacagagtctcgctgtgtcacccaggctggagtgcagtggcacaatctcggttcactgcaacctccacctcccaggttcaagcgattctcctgcctcagtctcctgagtagctgggattacaggtgtgcaccaccatgcccagctaatttttatattttagtagagacggagtttcaccatattggccaggctggtctcgaactcctgacctcaagtgatccaccctccttggcctcccaaagtgcagctaatttttgtattttagtagagacagggtttcaccgtgttggccaggctggtcttgaactcctgacctcaagtgatccacccaccttggcctcccaaagtgctgggattacaggtgtgagccaccgtacctggctcaggctcatgaccttaaaggtgaaagagattttaagagatctatgtagtctagtttcagggaagtaaggtgatcttttccccattttacagatgaggcaggccttctgttttttaaaaaaatcagtgagatcttttgacataatctcaggggcataccgagattttgataacattcgtaggaaaataaatattatgatattgtttagtagccacaatttgctatgttaccaagaggcttcttgtcctctagagtctggatgacagactgtgggttaagcatcaatcgctaaagctcttcttctcctccttagaaagtgcagcagagtgtgtactatccctcagcactattagaaggggataacctggaattctctgattcctaaaatgaaaaacaactcatttgcatagtttggtacttataactattagcaaatttctcaaattggattgtgctttacctggccattactttttcccttttgtttgttattcccctatgtttctggaaagtagtttacatgttctggagcactgcttaaaagctaccattgcagtctatctttctctaaagcagaatggctaatgtgatgttctgtttttctcaaactagcgtcttcaaatacccttaattaggacataggatattgtagaaagcttacatcagatatatagaaagtgagaaagaggtagtgtaataaaaggaggaagtgaggaaagcactgaaacctaccctttccttttatttttggtggcaaggaagggtgagcctgagatttttttttttttttttttttgagacaggatctccctctgtcacccagactggagtgcagtgccgtgatctcacctcactgcaacctctacctcccgggttccaacgattcttctgctttagcctcccaagtagctggaattacaggcatgtgccaccaggcccagctaatttatttatttattttgagatggagtctcacgctgttgcccagactggagtacagtggtgccatcttggttcactgcaacctccgcttcctggattcaaacgattctgctgcctcagcctccagagtagctgggattataggtgtgtgccatgacgcccagctaatttttgtatttttagtagagacggtttcgccatgatggtcaggctggtcttgaactcctgacatcaagtgatctgcccgcctttgcctcccaaagtgctgggattacaggcttgagccaccgtgcccagcctaagatcttctaacacatctccactagagggatagtcttgttctatcttagatgtttaaaagctgcatattttaggccaggtgcagtggcatacacctgtaatctcagcactttgggaggctgaggcagaaggatcacttgagcccaggagttccagaccagcctgggcaacatagtgagacctgcctctaccaaaaaatcaaaaaaattagccagacatggtggtgcatgcctgtgatcccagctactcaggagactgaggtaggaggatcacttgagcctgggaggttgaggctgcagtgagtagtgatcatgccactgcactccagtctgggtgacagagtaagaccctgtctcaaaaaaaaaaaaaaagctgcatattttatactttacttagccaagctataatacgggcttagtaaatagttgtttagggcaactacagtatattgttacctgcctgggaagtaaggacaagctagtgagactatgacagtgcttcctgtagaattctgccgtactcggtggctatatgctccttgttgtttaatcatgccctcacctctgtggtaaaagtttatttatttatttatttgtttattttttgtgagacggagtctcattctgtcatccaggctggagtgcaatggcacgatctcagctcactgcaacctctgctttccaggttcaagcaattctcctgcctcagcctgccaagtagctgggactaaaggcgcacaccactgagcccagctaatttttgtattttttttagagacgggatttcaccatgtttgccaggctggtcttgaactcctgacctcgtgatctgcctgcctcggcctcccaaagcgttgggattacaggcgtgagcaaccacgcccagcaaaaatttattttatatatcctggagaactctgcttaaaagttgtcatttcagaacattttgagtgtgtgtgtgtgtgtgaatcagtatggatttgctaaagtgatggttttatgtttttatattcagatgttttatttaaaaaacacaattacaatactggtattccagttattcagctagaaaaatattatttatttgtttatttatttatttattttgagatggagtctcactctgtcgccccggctggagtggagtggcgtgatcttggctcactgcaacctccgcctcccaggttccagcgattctcctgcatcagcctcctgagtagctgggactatagtcgtgcaccaccatgcccagctaattttttgtattttcagtagggacggggtttcactgtgttggccaggatgttctcgatctcctgacctcaagtgatccacccacctcggcctcccaccaaagtgctgggattacagtcaagagccacaagtctggcccagttttttttttttgagatggagttttgcccttgttgcccaggctggagtgtaatggcgcgatcttggctcaccacaacctctgcctcctgggttcaagcgattctcctgcctcagcctcctgaataggtgggattatagggatgcgccaccacgcccagctaattctttgtattttagtagagatggggtttctccatgttagtcaggctggtctccaactcctgacctcaggtgatctgcccaccttggcctcccaaagtgctgggattacaggcgtgagccaccacaccagacctaggaaaggattatattgataaatacctttttatttcaatggttgaaaataggacttttttaaatttttgtttttcagagacagagtctcactctgttgcccaggctggagtgcagtagcacaatcacagctcactgtagcctcaatcttctgggctcaggtgatcctcccacctcagcctcccaggtagctgggactacaggcgtgtgataccatccgcagctaattttttgtacaaatggggtttctccatggtggcccaagctggtctcgagctcctgggctcaagcaatcctcccacctcagcctcccaaagtgttgggattacaggtgtgagccaccacacccagcaaatagaacttttgataaaaattgagagaggctctttccaagatatcattttattttttagctggaagtttattactttatatttacagtttgttgacactttctagattgctttattcaccaagtgaaaaacagtctctacaatgctgccagcttatttggattcccattccagctgaccacaaagcccatggtaacttctgcttgtaatggaacacggaatgtggccccttcaggagaggtcagtggggatgagactccattaggaatactgatctttatacttaatcattatattttagaaaattctctcttcgagagttaatgtgtataattacttttttccagaaatatctgtatctttattagctgtgctataaaggccaagaaattaaaggttaataaaatgaacatttaaaacatgtttacaaagagctaaatattattacatatgctttcttatttaaggatgtacaaagaaactagaattgttatttctacatcattttgtgagtcttgacaagttaaaccttaggtcttattgatggtatctcttctgtgagctacctaagaaaaagttatcttttcataatagaaagttatttaggtgacaaaatttagatgctacagaagtgattctgtttgattttaaggtattttcgaactcttcatcttgtgaactgacaggttctggatcctggaacaacatgctgaaactgggtgaggtggtcaaaaatatttctgtttcccgctacctccttctgcccatttttttcctacattttgaaaatatgaaaggaaaacactgatttgaattgggatgagaaagacattctttctaccgttctaaaaagcaaatagcttttcttcagaattgttgtctttgaatttactgttgttttttgtttgtattatcagtgtcctcaatgtgacttagatcaaggtcatattaaaaaggttcattcatttaaaaaaaaacaaaaaagcaaaaacatttcctgagaacttactctgtgccgggtgctgtgcttaagttatcaagaataacaaaataataaaaccttattcatgtcctttaggagttcatcatctagttggggagcagccttaggttcccagttatcacagttttatggactagggacttccatgtcatccttagatcctgaagtggaattgtcattattatatatatgcactatacaaaatgctatggtggggaaaagtaggaagaagccagaatcctgcgaaatagttgtgatgtctgccactcaggaaggcttgtaaagttgggggggaaggaagttaaggaaaatgagcttagagaagttgtaggtttaaaattcaaaagtggaagaagataaggaaatgataaaagccttagagttgtgcttttcaaactgttttaaaaagtacctctaggagtagagaagagcaaaggagaataaatacatacccctgtgtctgagaagctagttcctaaaaacttgatatttctttctttctttttttttttttttttgagatggagtttcgcccttgttgcccaggctggagtgcaatagggcgatctcggctccagctcctgggttcaagtgattctcctgcctcagcctcccgaggagctgggattacaggcatgcgccaccaccctggctaattttgtatttttagtagagactgggtttctccgtgttggtcaggctggtcttgaactcccgacctcaggtgatccgcccacctcggcctcccaaagtgctgggattacaggcgtgagccactgcgcccagcccaaagatgatattactttgaagccttttatttcatttaaaaagttaatataaattgaatttcatcatctgtttggaatatttgtttagaattgtttaccgttaagattgacacatatgaaggatggtagatttgtgcctgagatgctggcactactgtgtttctgtgagttttgtgtagtctagtcagagaagcccaggtattcctagggcaggtttcttgtgtaaagaggtccataatcggttatctgcaacccctgggagccagatgtgtttaggaattcagaatttttcatattttaggtatgttaccggccaaacatacggctggtttgaatttgaataatttactccaattgattagattacagagagttataatctttgagttcttcatggcctcttaacagtcccatcaagcaaaacaagcaaagcctgccagtgaattctgttattacctatctgagatcaaaaacaaactaagccctattgctttcctttaacgtctacaaaatttgtgctagactcctgtgctattaatagaaattgaaaaacaagatgttgatttagctctatgatgtaggttgctcacagattttttttctttccttatgcagactgtttgcaagtgatttttcattttacaattacaaatgcattttttaaataggtaataaatctcctaatggaataagtgactatccaaagatcagagtgacagttacccgagatcagccacgcagagtcctgccttcctttgggtaagtgttaaattctttctgtaaatggaaacttagcatttattaggtgctcactcttgctaggcagtctcacttttgttgtattatgtagtcctgctaagcgctctgaggttagtaacttgctgaatgtcatgcagccagtgagagacttgaacttaggggtgtgttatattttcttttcttgtcttttttttttttttttttttgcgatggagttttgctctgtttcccaggctggagtgcattggtgcgatcttggctcactgtgacctctgccttccaggttcaagcaattctcctgcctcagcctcctgagtagctgggattacaggcacccccacaccatgcccggctaatttttgtatttttagtagatatggggtttcgctatgttggccaggctggtctcgaactcctgacctcaggtaatccacccaccttggcctcccaaagtgctgggattacaggcatgagccaccgcacctggccttacattttctactgtattatatgcccatagcatctgattttgaaaattgttttagaaagaattgccacttactttattctcaacttaaaaatataattatgcatacagaaaagtgctgaaattataagtgtacgtggcctggttaattttcatacactggtcatatccatcagttgtaaaatgttattattaatagttttcttactttcctttgtagaatttttattgcttggacattagaccttctagattgatctaattttcccatacattctctccttttgttgttcttgctttttttttttttttttttgagatggggtcttgctctgtcacccaggcagtttggtggcacagtcttggctcactgcagcctccgcctcctgggttcaagcaattttcccacctcagcctcttgagtagctgggcttacaggggcgtgccaccatgcccagctattttttgcatttttagtagacacaaggtttcaccatgttggccaggccagtctcaaactcctgacctcaggtaatccacccacctcagcctctcaaagtgctgggattacaggcgtgagccactgcgtgcggccttcttgctctttttaaaaacattttttactaattcttttttgactgtcagtttttaagttagaaaagttctccccctgcctattcccagtgttttttttctttctctaagcatcttgttcttataaggatgcaaaatctttccttatctctctaaagctgtttattattttaaaatatgttttgagtgctcccttctggtttatgccgtctccctccatgtttgtttattttggtctgatctttgaagttagagtctttattcaagtacttggtactccttggctatccacttatatttaggaatgagaaactaaaaactagcgccctctggaattgaataaatggctgattgtagggctaggaaagaaagtataaagtgagtctgaacatcttgtgccagaaagtaaaggagtgttcaaaaactgggcatgccaccctgacagaggaggagatttcaaaggggctttcactggccagatgggataatttaaacatcaaaatgaataaagacagggactcagatgctaataaataaatatatagtgtcgaggagggaaagatctttatagtagaatgccaactagtaagtgtggaaggaatgataaaattagaaaatcaccattttgtaactgtcatggtaataactgatatgggcaggaatcatcaattgagccaaaactagtaaatacaagtttgcagcctggccaacatggcgagaaatcccgtttctactaaaaatagaaaaattagctaggtgtggtggcacacacctgtagtccctgctacttgggaggctgaggcagtagaattgcttgaacccggaagcagagggtgcagtgagctaagattacaccactgcactccagcctgggtgacagagtgagactctgtcttaaaaaaaaaaaaaaaaaaaaaaaaagtttgatgaggcactggtatttacataaactcaaaatatctccttacacgttactttttttttttttttttttgggatggagtcttgctctgtcacccaggctggagttcagtggcatgatctcggctcactgcaacctctgcctcctgggttcaagcgattctcctgccttagcctcctgagtagcagggactacagggacatgccaccacgcccagctaattttgtatttttggtagagatggggtttcactatgttggccaggctggtctcgaactcctgacctcaggtgatccaaccgcctcggcctcccaaagtgctggaattacaggcgtgagccaccacgcccagcccacattacttattacttacaaaaggaaaaataaagtggagaagcacgactgacaccaccttaaccaaaagatcaaagtgaagttgccagcagttggacaaactgacatcatggcattcaaatgtattgcactgagaaagacatcataactaaatgcagcattcctgcaaaaacgatagactctaatcatgagaaagctggttaaactgaaattaaggtccattctacaaaaccataggcctgtattcattaaaaagataaagaaaagctgaaaaattgtttcagactgaaggagatgaaagatacctggtaactaaatgcatgcaatgtgagatcctggattagattttagatgggacaaaattgctatgaaggttattttttaatagcttcagagatatttgaatacgggctacatattacattgtactattgcaaaagttcctgaatttggtgattatattgtggttatataagagatgcccttgttcttaggagatacacagttagtcaggggtgaacttattttctaagcatttaatgctgtttccctgtaagcactgcttaggtgcattgtccacattttgaaatgttggttttcattttcattcaatttaaaatattttctaggctgggtgtggtggctcacacctgtaatcccagcactttgggaggctgaggtgggcagatcacttgaggccaggagtttgagaccagcctggccaacatggtgaaaccccatctctactaaaatacaaaaattagctggccatggtggcacacacctgtaatcccagctacttgagaggctgagggaggagaatcgcttcaacccggaaggcggaggttgtaatgagctgagattgggccactgcgctccagcctgggcgacacagtgagacaccgtctcaaaaaaataaataaataaataagtaaataaatattttctaatttctattttacttcctctttgacctgtgatttagaaggatagaaatatgttgtttaatttccaaatatttgggactttgcagatatctgttattgatttctagtttaattctattatggttagagaatatgctttgtatgatttcgtttcttttaagttttttaatgtttgttttctggcctagagtatggtccagttggatgatgttccatgtacacttgaaaagaatgcatattctgctgttgttgggtagaatgacctaaatgtcaggtcaggttggttgataatattttacaggtgttagtgatttttctgtcaacttctttattgattgatgagtcaggaattgagttttctaccacaattgtggatttctctatttctccttcagctttgctagtctttgctccatgtttttttgtctccatatattttgaagctctattaggcaaataacctgacctagattcaccagttgtcattctgttacatttgctttctcattctctcatatatacatattgttttgaaccatttaagagtctttgattcatgtccctttaatcctaaatacttgagtctgtttattttttttcttttcttttttttttgagatggagccttgctctgtctcccaggctggagtgcagtgccgcaatctcggctccctgcaacctccgcctcctgggttcgagcaattctcctgcctcagtctctcgagtagctgggactacaggcatgcaccaccacgcccagctaatttttgtatttttggtagagttggggttccaccatgttggccaggctggtcttgaactcctgacctcgtgatccacccgcctcagcctcccaaagtactgggattacaggcgtgagccaccgcgcctggccgaatctgtttatttcttaagaataagggcattcaagactgggcgtggtggctcacgcctgtatcccagcactttgggaggctgaagcgcgtggatcacctgaggtcaggagtttgagaccagcctggccaacatggtgaaaccccatctctacttaaaatacaaaaaattagccgggcgtggtggcaggcgcctgtaaccccagctacacgggaggctgaggcaggagaattgcttgaacctgggaggtggaggttgcagtgagccgagatcgtgccattgcactcctgcctggaggacaagagtgaaacttcgtcgaaaaaaaaaagaataagggcattcacttacatgatcatggattaccaacatcaggaaattaacactgatataatactattatgtaatctacaggtcttatttaaatttttctcttatagctttttctttttcctaatacaggatccagtgcaggattgtgtattgcacatagttttcatgtctctttgatctactttattctgcaacaactccttgccctttctttgtgttcattggcattaatattgtaattttgtctgatatttactgatgatttgtttcagattatgcctttttttttttttttgaaacaccacataagtgatattcatttcaaaagcatcacccaaggaaggaggggcatgatgtcagtttgttgcattgttggtaatggcaggaaaggcagatttgtcaccagcagctgtgactgggtgggaattccaggcttcagttcctttagtgtttattaatttagcattcagcagatatttattgagggccttttggcttagaccctgtactaagataacagtggtgaaaggatgtaatctcttttcatggaatttaaagtttagtgtggaatatagacattaaacaaataatcataccagtaatgaatttcagtggttccaggtgactaaaggaaaaatgcagtatcagaaggggtatatgcaataggagagctaaatctagagttggggttggaaatgggcatgaagaggaaggcagagactctctttgtgtggcagctctagtttagaaacagacattccatagtggaatgctgcggtgccctgtgctctagggatagatctaacttttgcataattgtacttgtctgacttgccaggagtaagcttgacctaaagcaacttaatcacaggatggtctgggagcttagattccagcaatttaagcagcttggtgatactttttttctttttttttctgttgctcagttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggaggtaagccttttcagcttgatttctttaaaaaaaattttacagctcttcccaaggatgctgcctagagacactcagaatggttcaacgtttgacataccattgtaggttttcctacaatacagcctccaacaaaatgaggctgtcttaaacccagatgcaccaaaaatctgcatgcagcatgtgcccaggcagactttgaggggttcatgctatgagacctaaagttcttatgagattgtccagatcacattagcaaggcctatagcggccacgtgtgctcagtgagtctgtgacaggatcaagcatgttgcttatcgaggagcagaaaatcgttgtgaaagtattgaaggcacagacacagagtcagacagctaaatttaaaaatgaaacttttttcagaaataaaaattaaaagactaaaaagaatttttaatgaatatttttgggagcaaataatatatctactatgttatatatttcttttttccttttttttttttgagacagagtgagactcttgtcacccatgctggagtgcagtggtgccgtcttggctcactgcaacctctgtctcccacgttccagcatatgttacatatttcaaaaggtactaaagtatgtacggtaactaaatttctcagactcccttccatacctggcttccaccaccatgtttacttctaagcaagtaacctctgatacctatatgtattcttctatagatattctatatacatataatttagtcaatttttagatgtggttatttttattataaggaagaagaaagagtcatattaggaagagataagattagattcttttttttttttttttttttttttttgagacagagttttgctcttgttgcccaggctagagtgcaatggcgcgatcttggctcactgcagcctccacctgccaggttcaagtgattctcctgcctcagcctcccaagtagctgggattacaggcatgtgccaccacgcctggctaattttttgtatttttagtagagatgagttttcaccacgttggccagtctggtctcaaactcccgacctcaggtgatccacctacctcagcctcccaaagtgctgggattacaggcatgagccactgagcctggccaagattagattctttttgggtacctgaattagtctaacttgcttttttaaaaaaatttaccaagtttttttttatatatagagatgggatctcgctatgttgtccaggctagtttcaaactcgtgggctcaagcgatcctccagcgtcagcctcccagagtgctgggattacaggcgtgagccaccgcgtccagtcataacttgtttctttttataaactttagtaactgtgactaaggaagggaagtaaatggtgtgcatctctgctttttccttcacctttcagaacactcagcatgatgaagagtcaatctttttactttccttttgaggttttcttttattccaggaaaatttagaattattcctgtacctggcactcccgaggaccatctgctatttcacttgccaacagttttctgagccacttgtttaatttagttcatcaaagaaatatttattggggtcccaggtactgtgctagttgtactgtgctagcaattcaagattaaatgaaatgtggtttctgccctctacgagcttatacataaatagttgctatttgataaggaggcagagagtaatggaccatatccctgaaaggggttttaagatgaggtgttaaatatttcagtctcttagatgagaaatcagaaatgggactgagccagtatctacaggggaatatgcagaagatatactctagaaatattggtaggtagtattagcaaggacgttatctgttgattaagtgtgatctaaagtagatagaagggtctgagtcccagatttcagttttgggaatcactatgtgtcacttacaaagataaccctatgtttatggggaagatgatgactccagtcttggacattgtttaaactccctgtgaaacccacaagaaaacctctcctggaagctcgtggatatatgtgatggaaattttgaggagacacatttctgaatctttaacctgttggtgttatttaaatcaagggagctgatgagattattcagggaaggaatgtagtgcaagaagagatacgggcaaaccatcagtatgatgtaggcagaaggaataatctccagtggagacagagaaaaaagaatcagaagagcttattgtctaggaaagcaaggcaggtcagcagggtgaaatgctgaagagagatcaagtaacataaggactggaaaagtgtctattaaatgtagccatagaggttactggtgatgttggtgaggccaattcattttggaaactgtatattctcgttatgcaagcagatgatttctgctgagtttttttgtagttaacctaattctgttcaacccagttctgtcaaaaacctagatgccatcagaatttagcagataacatgaataaagtgggctggagagcagtggcccatctaaatgggatagccctacatatagattgtggattcagttgatcaaaggaggctagattatttttaaaaaatgtataaagttagtaattaattcaaagaaatattaaaaacatagtgctggcaaataaaacacacctatggtttacatttggccttttaattataaatttaatgtgctggtacttatctaacatgctttcttttatttagggtgttcaaaaagaggaaagagagaagtaccgaaagttattggaacgacttaaagaaagtggtcatggaaactctgtctgtcctgtaacttcaaattatcacaggtgacagtgagctaacagataatgctttgctaggcatcttttgtttgtttgtttttggagaaagtattggtgggaagggctttactgaaagaagaggttaaccctgagagaactagctctgtcatttgcctggatatttatctagtaatggataatatgtaacagtggttttgcaaagtaaaattttatgttacctttaggaccttttgttcaagtaaacttttacttgaaactcttatattaaaaaagtggatcactggttgaagtagggctcccaagaggcagagagtttcttcaacctccccagcatacatttcccacaatctctctctctacctcccttccccaccccactcctgcccctctctccatttctcccatctcccttccttccttcctttctccttcacctcctcctggtctttctttttgtcttttttccttccccctgcctcacccctaccccatgagacatacctagtccctgcggcatcatagagattgaatcttagcacatttggaaacccactagagacaagattaaagtctcccaggtcataacaattttccttataggacagcttgttaattaaataatgatttaagcaaatattaatagatgagagtggcagaaggaagtgatatttggccttgtatttgcctgtgaaaggaggacaaaaaatgtgtgagctcaggattgaggtacactaggtaattctaacaagtggtgtgagaaaacacagggatcccagaaattatataatagcaaatcgaagattaaaaagtcacagaatattatctagctttttttttttttttttttttttgagatggagtttcactattgttgcccaggctggagtgcagtgatgcaatctcagctcactgcaatctccgcttcctgggttcaagcgattatcctgcctcagcctcctgagtagctgggattacaggcgtccaccgccacgcccagctaattttttgtatttttggtagagatggggcttcaccatgttggccaggccggtctcgaacacctgatctcaggtagtccaccagcctcagcctcccagagtgctgggattacaggcgtgagccaccgcacccggcctactatctagcttttgaatgcagaaataacagattgtttgcgaataatcagttgtgaactttaaaaaaaaattcttttggtttagtcagaatgtcagtattttctccattttgaccagccatatgttggaaacagcagtatgtttaacgaactcttaactttgtcatgttggcgaaaccctcaaactatttttgctttttaaagttgctgctttggctgggcacagtggctcacacctgtaatcccagcactttgggaggccgaggtggacggatcacgaggtcaggagatcaagatcatcctggctaacacggtgaaaccccatctctactaaaaaatacaaaaaattagctgggcatggtggctggcacctgtagtcccacctactcgggaggctgaggcaggagaatggcgtgaacccgggaggcggagcttgcagtgagcagagattgtgccactgcactccagcctgagctacagatcgagactccgtctcaaaataaataaataaataattaaagttcctgcttctggctgggtgtggtggctcacacctgtaatcccagcgctttgggaggccgaggcaggtgggtcactggaggtcaggacttcgagaccagcctgaccaacatggcgaaaccccatgtctactaaaaatacaaaaattaaccaggtgtagtggcgtgtgccagtaatcccagctacttgggaggctgaggcaggagaaccacttgaacctgagaggtagagatttcagtgaggccatgatcacaccactgcactccagcctgggcgacagtgcgagactccgtctcaaaaaacaaaaagttcttgcttttaatgtattgtttcaggatccatttaaatacatagcttaaaaagttttttatcttttaatctgagttttatcacactgagatttttcagttagtgcatcactggggattcagaacctctgattttacaaacagagaaactggaggttaggtgacctggctgaaatattattagaatcatgattagactccttttatcctagtcccacatagttgcttcctttctgttgtaatttgatataatagtgtaatcaatcacccctatttggagaagcttgctggacagagataatgcatattaatggtagactttgcttttgtatctgatctccctcactttttgtgtttctaagttctcaaagaagtcagatggacacattaaagaccaaaggctggggggaagagcaaaatcacggagtcaaaacaactcagtttgttccaaaacaatgtgagttcccagatttagccttgtcttaatatattgaccttagttcatgctacagtgttcatatgaggtagaaaattgacattcaagtgtagatggtgtaccaaaatactgtcaaatctcacagcattgggccgggcgcggtggcttacgcctgcaatcccagcactttgggaggccaaggcagatggatcacctgaggtcaggagttcaagaccagcctggcgaacatggtaaaaccccatctctactaaaaatacaaaaattagccaggcatggtggcacttgcctgtaatcccagctactcaggaggctgaggaagtagaattgcctgaacctgggaggtggaggttgcagtgagccaagatcacgccactgcactccagcctgggtgacagtgagactctgtctcaaaaaaaaaaaaaaaacctcacagcattgactggggcttatctaggaatttagtagaaaagctgtttcagggtgaagtagattcataacatggctctggattattattcctaagctgctagatagtagcaactattttgtgagctgaaattttattatattccttatataacaatttccttatacttctccacttactgtccactaaatgacagcttaccagataagcagatatcactcagtttatagtaaagattatatttaaacagcaaagatatgtatgcatttttttaggcaacttagtatatagggaggctagtgtctttggaattcactgtagcatttcaatgtagaggaatgtcttgatgttgtggaaactctgtaagctgaaattctaactatattattcatcgatgaaggaaacatttaatcttttctttaccatcctcacagatagacttgttgaaacaaggggacctctatgttcattgagaagtgaaaagaggtacgtacattcagttcattctacactttcttttaatatatattttcttactttataagctgtatttatgagtaagcagttctgaggaattgtgaactctcttgagttctggtagttggtcagcatatagggtagataggtagctagctgttgtgtcagatgcccaccctagcctggtgggttgaggggggtgccccttatctcccaggcgtcaggggttgggagaaacacatgcttcttagatgggagtttggttggagtggggatgtctagtgtcagtgtctttaggataggaacagtaaaggcagctctgcatgctttaggattttgggatgatggtttatagcagagtttgtaaactatggcccatgggccaaatctggtctacttgcctatttttgtatagtaaatttctattggaacatgcgaattcatttacatactgtctggctgcttttaaattacagtggcagagttgccacgatgtgcccaagaccataaaacctgcaaagcctaaaatactgtctgttccttttcagaaaagttcgttgactcctggtttagagtattatgtaaactcaacacaatttttatgtacaaattacgaaatcttatttctaaaactaggatgtactaggtttgaatcatctagcagaagtctatcatctctcaatttttttccttaggtgttcaaaggggaaaattactgatacagagacgatggtcggaatcagatttgaaaatgaaagtgtaagtaaaaatcctagttacatttgatacctgtttacttatgtaacttatgttttggtgcccatgaaaagcaagaaaaagtatatatatataactttgattgttaattctgttgtttttctttaaaaaagcagcaagccagccagtcacagtggctcatgcctgtaatcccagaactttaggaggccaaggcagaaggatcacttgagcccaggagtttgagaccagcctgggcaacatagtgagactgtctccacaaaaaaatttaaaagttagccaggcatggtggcatgtctgtagtcccagctacttgggaagctaaggtgggaggattgcttgagcccaggaggtcaaggctgcagtgagctgtgatcacaccatagcactccagcctaggtgacagaatgagactctgtctcaaaaaaaaaaaaaaaaaaaaaggcaggaagcattgaaaatacacaacttttttcttccttctgagttgttggagttttgcctctgtacagtagccacctttgtttatgagagaccaatctgcctccataccaacatgttacctacattttatggcttcttagggagaatttcttaaaaatcatacatctctggaaagagatgatatgttctgggttgctggcagaattctatttgtttactacaattgtggttatataggtgttcattcaaattaagtggtacattaatgttttgtgcattttctgtaatatcaaatgacttttttcaaggataaactagaaccaagttgagttactataaagatagtagggatttattctgagtgatgggattgtgggtcatattttttgctgtttaaaactttcataatatcttttaaacatactaattttaattgtgataggagaactgaaaatacttttcttgctacttccagggaaggtggtgagtgttctgtttgatggttcataactgagggtcctgtgaggcctaggtctggagctttttttgctcccccttgcagggacagacagatagggtaaatctactcacttgggggatttgctaattctcttttctttcacattagtggcagttttatatttcatgtgtaatctgtgtttatatttgcaagtatcaaacatgtcagtagaatttagataattttttgatcagaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggtattgttctttgtattgatcctaaaaagaggcatgtctttaaataacctcagttattctaacttgaatgttttgttttgaggactttctccaggctaggggtgaatatatgaaaacatgtcaggtccatggtctgttgattcactttgactacattgatctttagtgaggcatgatcattagtggcctaagggatcagattgatattcagcaaatggggagtcgacacagtcatctcatatcttggaatacaacagattctttgtaaattctaaccttcaaatatgttgagttatatagtatgggtttggcattaagaataagttcattgcattttttttttgaaagttattatagtttactaaaatgccccctttgttgattattgcatttgaaaatagtaaaaacttacagaacataaagaatgaaggtagttaaaattcttattttaaagatgtgcccacatcttggcttcctccacaatgttgccctagtaggcaaatctcttgaatacttactgttatattgggcatgtaggtggagagagagatccataaaatggtgaagctgtgtgcagtgggaagcagcatatatttagaagaaaataatttcttttttttgagacagagtttcgctcttgttgcccaggctggagtgcaatggcgcgatcttggctcactgcaacctctgcatcctgggttcaagtgattctcctggctcagcctccctagtagctgggattacaggcacctgccaccatgcccagctaatttttgtatttttagtagagaccgggtttcaccatgttggctaggctggtctcgaactcctgaccttagatgatctacccacctcggcctcccaaagtgctgggattataggcgcaagccactgcccccggcctagaggaaaataatttctattgggtttatagatttagttttgtatcttaaataatgcatttatctgcataattctttagtatgatgaagccatttattccataaggagtcaattgctagactgctgggtggtttccaagtttctgcctgtttgcttattctcttcatgtcaaaaaggatggtgtgaccccttagatgtcctaatcttattttgatgttttatttatttatttatttttgagatagagtctcgctctgttggcaggctggagtgcagtggcacaatctcagcttactgcaacctctgcctcccaggttcaagtgattcttctgcctcagcctcctgcgtagctgggactacaggcgcgtgccaccacgcccagctaatttttgtatttttagtagagatggggtttcaccatgctggccaggctggtctcgaactcctgacctcatgatccgcccgtcttggcttcccaaagtgctgggattacaggcgtgagccaccacacccagccttttttgatgttttaaaagtttaaaggcgagaatgggcgtggtggctcacgcctgtaatcccagcactttgggaagccaagatgggcggatcatgaagtcaggagttcgagaccagcctggccagcatggtgaaaccccgtctctaccaaaaatacaaaaaaatagctggcatggtggtgtgcacctgtaattccagctaatcaggagactgaggcatgaaaattgcttgaacctgggaggcagaggttgcagtgaactgagatcatgcagctgcatgcactccagcctgggtgacaaagtgagaatctgtctcaaaaaaaaaaaaaaaagaagggccaggctggtggctcacacctgtaatcccagcactttgggaggccgagatgggcagatcacgaggtcaggagatcgagaccatcctggctaacacagtgaaaccccgtctctactaaaaatacaaaaaattagccgggcgtggtggcgggcgcctgtcatcccagctactcgggaggctgaggcaggagaatggcgtgaccccgggaggcggagcttgcagtaagccgagatggcgccactgcactccggcctgggagactgagcgagactccgtctccaaaaaaaaaaaaaaacgtttaaagtggaaatcaggagtttactattatgaagggagcaaagtccaggaaattagatgcacctgggttcaaatcttcttctaccttttaataattatatgactttgaatatgtaaaataaattctctgggtttcaattttcttctctataaaatgataataatgtcttcctcactaatatggatcaatgatgtgcttcaagcatctaacaccatgtttgactcatagtggttaatacgtagtagtaggaaaattgagactatactttagatgtaaatattattattaaattattgtttccacaagctaataagtgaaccaggatttgttgtaagtattacttacaacaattaagtaaggctgctttgtagttataagttaaaatattttcagggctggtgcagtggctcatgcctataatctcagcactttgggaggccaaggcaggtattgcttgagcccaggagtttgcaaccaacttgggcaatataatgaggccccatctctatcactaaaaataagaaaaaaatgttttcctactgtagtttagtaggtctttgatagtatatttttctcaagagtcaggtgttgccgagatgaaaaacttttttcagtctcggagttttcaataactgataatgaatggttctatattaaaatagcaacttctgaactttctaattcaggacatggaaaaggaaatcagtaatgccctaggccatggcccacaggatgaaatcctaagtagtgctttcaaattgcgaattactcgaggagatattcagacattaaagaactatcactggctcaatgatgaagtaagttgtattccctcccccttttggctatcattaagtttatttatttattatctataatcaaagtgactcctacccagttataatgggttggtaatgcaactcttagttataattaaaacaaaaacattttaaatcttaaaaagatggttagttctgattttctgcctttgattagcgatgtttcccttttctgcgtctgtattttattgcatccaccacttcatttactggtcttcaataaaccctgggtacagctgataaacgggaggaagcagcaagtgatactgtattttaggtgaattcttatagtagctatttttttgtttttgttttttggttttgtttttgagacagagttttgctcttgttgtccaggctggagtgcaatggcgcaatcttggctcagcgcaacctccacctcctgggttcaagcaattctcctacctcagcctcccaagtagctgggattacaggcatgcgccaccatgcccggctaattttgtatttttagtagagacagggtttctccatgttggtcaggttggtctcaaactctggacctcaggtgatccgcccgccttggcctcccaaagtgctgggattacaggcgtgagccaccgtgcctggcctgttttattttttgagtaataaagggatatattgatcactatatactatgtgtatttttctttgagtgatagctgaaaaattttgcctaacttgtcatcttgtatccttaatacatttagcaaaagctaactcttaagttctttgacaattttctggtgggttcttccccgaactgcttagcccctgcatgttctctctttgagggaagtcccctatgactagttacttataaacacattctttgaaaacaggaatgttttgttttacattataaatgtaatttgtttatcgtagaatatttggaaaatacaggaaaagtaaaaaatattactgttcaaaagtaccaccactcggccgggcgcggtggctcacgcctgtaatcccagcactttggaaggctgaggcgggcggatcacgaggtcaggagaccgagaccaccctgactaacacggtgaaaccccgtctctactaaaaatacaaaaaaattagccaggcatggtggcgggtacctgtagtcccagctactcgggaggctgaggcaggagaatggtgtgaacccgggaggcagagcttgcagtgagccgagatcacgccagtggactccagcctgggcgacagggcaagactccgtctcaaaaaaaaagtatcaccactcagagataaataaaatattattttggtgtatgtccttcaagttaatattttaaaattgaagtctaatttatatgtagtaaaattcacttactgttaatatttctgcgtatttttggtgtgatacagttatgtagatctttccattattgcacagactttcttcctggattccttcttctggctgttaagtgttactcacatgccttaaaagtacagtttcatttcattttcatgtgtcccattttgcactgatcacttttttccctgtcttctactatagacagtctttttatcctcttctttagtaccttaccttcgaattcatccttattcaggtagaaatttagttttgataatatgtttgccatgttccagcttttgctcccttggtattttgtaggtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgagtagagagggttaatggttaattgttggacttggataaaggccattttttaaaaataatgctgcctttttctgccctgtgtatagaggccaatagtatatattataagcatactctgcagagtctctttttagttttttttttaatgtcccatccttcacccaacccttttagttctttttatttatttattctttaaaaaattttatgtttattttattttactattttttaaaattacagaccaggtctcgctctgttgcccaggctggagtgaactggtgtgatcatagctcattgcagcctggaagtcctggactcaggtgatcctcctgcctcagcctcctgagtgactaggactacaggcatggtccaccatgcttgcctaattttatttatttatatatttggaaagatggagtcttgctatgttgccctggttggtatccaacgcctggcctcaagtggttctcctgcctcagtttttcaaagtgttggtattacaggtgtgagccaccatgcctggcctttttttctttttctttttcttttttttttttaaatttttatttttagagacagggtctcattctgccacccaagctggcatgcagtggcacaaccatagctcactgtaacctccacctcctgggcacaagtgatcctttcactttagcctcccaggtagctgggactacagacatgcaccactatgcctggctaattttttttaatttattttaatttttttgtagagacaagagtcttgtttttttgcccaagctagtcttgagctcctggctttaagcagtcctcccacctcagcctctcagaatgatgggtgagatgccgcacctggcctcctttttagttcttgagttgaacaacttttagaaggctacaggacgaagtccttgtacttgaggagcttttttttgtttgtttgtatgtttttgagatggagtcttgctctgtttcccaggctggagtgcaatggcacgatctcggctcactgcagcctccgcctcctgggttcaagcaattctcctgcatcagcctcctgagtagctgggattacaggcacgtgccaccaccatacctggctaatttttgtattttcagtagaaatggggttttaccatgttggtcaggctcgtcttgaactcctgacctcgtgatccgccacctcagcctcccaaagtgctgggattataggcgggagccaccgcacctggccgaggagctttcatttttaacaggaaagagtcttagtatgcataagggttatttatatttatttagttttgtttacaagatagtacaggtttattgcagaaaaatgcatttataaggccaggtgtggtggctcatgcctataatcccagactttgggaggctgaggcaggaggggttgcttgagcccaagagtttgagaccagcctgggcaacatggaaagaccctgtctatacaaatttaaaaatttgctgggcgtggtggtgcacacctgtggtcccagctttgtgggcatggtggtgcacacctgtgagaggctgaggtggaagattccctgagcccaggaggtcgaggctgcagtgagccgtgatcacaccactgcactccagcctgggtcacagagtgagatcttgtctcaaaaaaaaaaaaaaaaaaaaagagagagagaaagaaagaaaagaaggaaagaaagatacagatataaagaaagcaaaaaaaaaaaaaaaagtctcatcactctgagaggaccactaattttttaacttaaaaacacactttttttactaaagatacgtaagacacatttttaactaaaaaaaaaaaaatacatgtaccaatataagtggatatcgtttttcttttttttctttttttttttttttttttttttgagacagagtctcgctatcacccaggctagagtgcagtgacacaatctcggctcactgcaacctctgcctcccgggttcaagtgattcttctgcctcagcctcctgagcagctaggattacaggcgcgtgccatcatgcccgactaatttttgtatttttagtagagacggggtttcgccatgttggtcaggctggtctcgaactcctgacctcatgatccgcccgcctcagcctcccaaagtgctgggattacaggtgtgagccaccatgcatggcccataaatggatttctaagatacataaaaaatttatattggtacatgtattttttaaaagatgcttttatttttggaagtaaaattctcactcctcttacatttaagatgtttctggatgttatctttttccattataggtgattgacctaagaaaaaagtgtcttaaatatctggattctatgggacaaaagggccacaggatctgtgagattctcctgtaagtaaaggttgaaaacctcactaccccctgttgaggtgatctctcttttatctcatcctaggaagctgtgtggatggtagtctaatgtgtagttaaggctatttcaggacttagcatgcattttatttttaaaataatagctgatttcaactgagaaaacgtgtttagtagcatcactggaaacaagtttgtcatgtattatgatgtaaaatagatcttattagaatcctgtgacttgcattagatttctttggcatcgatacgttattctgaatgttcttaggaactgttagttggggagtgctagtcctctcaattcttaagcccatttgtatctttatgctttccatgagagttgggtttatctcagaacccaggggcagtgtttaaagtgtgtggtttgaggagactgtttcaaatagtaattgctataatagaaaccaatctttaaagcatacctacttcttagctaggtaaagtagtgacatgagttgagtgagaaaacgcatcagtaagatgggtccatttttccttttctgctcactagaagcaatgaagttccttcttttaactttactaaggacaaatgaatcttgtgaagaaaagttgttgctaacaataatattgttttagtataaaatattatttttatttatggttgtttatcttgaataaaaagcatagagaagaaaattctaaaaatcataagatacaccaattgtttataaaatggttctcttctagtcttttctttgtaagatgtgtataaattgtgcgcacatacatttgcattcatatgtatacatatattatcccatgtatagaaatgttcttactgggatcatacagtatagtttgatgtgctgcttataccaggatttgaaaattcatactttattacattcatgcttttttttttttttttttttttttgagatggagtctcattgtgtcaccccatgcagtggtgcagtctcagctcactgcaacctctgcctcctgggttcaagtgatgctcgttcctcggcctcccaagaagctgggagtacaggcttccgtcactatgcccggctaatttttgaatttttagtagagacagggtttctccatgttgatcatgctggtcttgaactcccaacctcaggtgatccgcccgccccagcctcccaaagtgctgggattacaggcgtgagccaccgtgcccggtggtctttggctttttatgttatttatttatttgtttgttttttgagatggagtttcactcttgctgcccaggctggagtgcaatggcgtgatctcggctcaccgcaacctctgtctcccgggttcaagagattctcctgcctcagctcccaagtagctggtattaaaggcttgtgccaccacgcccggctaattttgtatttttagtagagatgaggtttctccattttggtcaggctggtcgcaaactcccgacctcaggtgatccatccgccttggcctcccaaagtgttgatatacaggcgtgagccaccgcacccggcctatgttattttttgtatcttaattttggtgggggcatctaatgcttatcaacctgatatatatttcaacttttaaaaacaagcatgtacaatttttataagcagacctccccaaattaaataaaaaatccagaaagccactttgggaggctgaggcaggcgggatcacaggctcaggagatcgagaccatcctggctaacacggtgaaaccccatctctactaagaaaaatacaaaaaattagcagggcgtggtggcgtgctcctgtggtcccagctacttgggaggctaagtcaggagaatggcgtgaacccgggaggcagaggttgcagtgagccgagatcgcgccactgcactccagcctgggcgacagagcgagactctgtctcaaaaaaaaaaaaaaaaaaaaaaaatccagaaagcagtcacgtttttaaaaagctaatgaatatggatttgagaatggcatatctgtttaacatcagaaagccctatgtaaccataatggttaatttctttagggatttattgatgtattccttctttgttttgctttttagtcagtatttacaggatgaaagtaagaccaaaagaaatagtgatctgaatcttttagagtggacccatcacagcatgaaaccacacgtgagtgacgatcatctacatgtgacatacttggttgcatttactaatagtatattatctagatttggctcccttcctgcccttcctccctccctgcatgcttttaaagtacacatctttttttttctttctttcttttttgtagagatgggatcttgctttgttgcccaggctagtctcgggcctcccaaaacaaagtgctgggattacaggtgtgagccaccatgcctggccagagtctacatcttaagaatgatctgcttctaaatctctagcaattaatctaactaaaatgggtgcttagctttcatcttcttgtctaaatgtaaatattaacatatgcttgcatgtctctcacagaattgggaagaaacccaatacattgaagttggctaatttcccggttggtgctaatgaaagtttacatttcttttccaaaatttgggagtttgtttaagtcttaggatcccatgccaaaaaaagcattttaatttctaaactgaaaagtttgggccaggcgcggtggctcacacttgtaatcccagcactttgggaggccgaggtgggcagatcacctgaggtcaggaatttgagaccagcctggccaacatgacaaaaccttgtcaccactaaaaattaactgggtctggtggcacgtgcttataatcctagctattcaggaggctgaagcaggagaatcacttgaacccggtaggcagaggttgcagtgagccgagatcgcaccactgcactccagcctgggcaacagagcgagactgtctcaaaaaaaaaaaaaagaaaaagaaaaatttgaaggataagctttgaaatttcctaaggagagcacagatacaaggaagagtctgttaggatgaatactgtgttctggtatgggaaatggaataaagaaaacaaactgcctttctttgtatattgtagtctctagttttgtccattctgtgagagatgctaggcttgagagaaaagtgtgaggtatatgcgtatgtatgggtggtatgtatttaagcaaattttttttttttttttgagacggagtctcgctctgtcgcctaggctggagtgcagtggcgcaatcttggctcactgcaagctccgcctcccgggttcataccattctcctgcctcagcctcccgagtagctgggaccacaggcgcctgccaccacgcctggctaattttttgtatttttagtagagacggagtttcaccatgttagccaggatggtcttgatctcctgacctcgtgatccgcccgcctctgcctcccaaagtgctgggattacaggcgtgagccaccgtacccggccactaggcaaactttaaaaatcataatcaacttcatttctttgagtaaaaattgagctattgtcatctagtgtgttttccagcaataacttgcgctaattgtgactgacagccagagtgtgtcagggactgccaagattagggcaacacaggcctggagaaggtgtgagctcagtggggttagaatccaccacctttggcttattatgctcttagtgctgcttgtaccaagtgtttttgccttacggcagaactgatccatcaaggcaagatcctaattggttaaagcctatccagaacttctctctgtccaccttgaagctgtagggtccaaagcagtagtcttattttcttagctagagaagttacatttccgattgaccacacttggccctttttaaaattgataaatgcttctgaaataattctgactagcatccctggtagtaaacctcctttcagtttggtttcttggaatgggagctgagagatgcaactctcactttgtgtttttctcttctgaaaagcatttcctgtggggtcgggtcatgcactccatctcatagttagggtttccaatcaaatgcagagccatggagaattaaacagaagaacagaacagaaaggaaaagcagtattcacaagttacatcttagacctgtggcttcagttctcacaaggcctgtttttcccttgctatgatctatgttttataccacatagagtaagaataattgtgttttttgtatatgactgtgtgtttaggtaatacctgatttaatatttacctttataatattgtttacagcaatatttagaaaaagtccaaggaatttgtatttaatgatgttttaccctttcctctcttcttttttctttgtaattttaggagattcctcaacagctgaatgggagtgattgtggaatgtttacttgtaaatatgcagattatatttctagggacaaacctatcacatttactcaggtgagtgaagaccctcttcatccatttacttgttactaagcaagataaggcacttggccagtgcctggcacacattcagctctcaatagtagtagctggccaggcgtggtggctcacacctgtaatcccagcactttgggaggccgaggcgggtggaccacctgaggtcaggagttcaagaccagcctggccaacatggtgaaaccccatctctactaaaaatacaaaaattagccaggcgtggtggtgcatgcctataatcccagctactcaggagactgaggcaggagaatcacttgaacccaggaggtggaggttgcagtgagccgaggtcgcaccagtgcactccagcctgggtgacagagcgagactctgtctcaaaaataaataaataaaataaatagtagtagctgggctcatgcctgtaatcccagcactttgggaggccgaggcaggtggatcacctgaggtcaggagttcgagaccagcctgaccaacatggagaaaccatgtctctactaaaaatacaaaaaattagccacgtggtggtgcatgcctgtaatcccagctactagggaggcaggctgaggcaggagaattgcttgaacccgggaggtggaggttgtggtgagccgagatcgtgccattgcacttcagccgcctggggcaacaggagagaaaccctgtctcaaaaaaaaaaaaaaaaaaaaaaaatagtagtagctgtgctattcttattgctgtaaatcttggttttagccctactcctgccagaatcagggttattttatctgctctcaggtttatcctagtctttggtgacacaatgggcacaatttgcaaatctctgaactgtggcattcattggttcctgtgtattattatttctagccaaagaaagaggtatgtcagtgtttaatagcaagggaaaaatcggcctgtgagaactgaagccacaggtctaagatgtaacttgtgaatactgcttttcctttctgttctgctcttttgtgtttgttttgttttgttttgtttttgagatggagtctcgctttgttgcccaggctggagtgcagtggcacgatctcagctcactacaacctctgccttctgggttcaagcaatactcctgcctcagcctccccagtagctgggactacaggcatgcgccaccatgcccagctaatttttgtatttttagcagagatggggtttcaccgtgttggccaggctggtctcgaactcctgacctcgtgatccacctgcctcagcctcccaaagtgctgggattacaggcgtgagccaccgcgcctggcctgttctgctcttttgtttaattctccatggctttgcatttgattggaaactcaagtatgttgggaattcttgagaatttgtaacagtggattctcaacctttttacaactgaggacaacctcattaaagaatatttttcatccacagaccttattttgatagatgttgtctaccaagcaaactgtatgtattccatgaatacaaactgtaatacaaactctattacgtgaagtaactaggactcccgtgctgaattaatataattccagtaaaaaataaaggcatttattgcttagtctcagcagttttactaagagcaaatgtgcagtttttactagatgttttgaactatttaaaataatttaagaatcatgtgttaagactttttagcccccacccctagggaggacatcactagtttattattattattattattattttgagatggagtcttgctctgttgcccaggctggagtgcagtgtggtgtgatcttggctcactgcaacctccctctcaggttcaagcgattcttctgcctcagcctccccagtagctgggactacaggcatgtaccaccatgcctggctaatttttgtatttttagtagagacagggtttcaccatattggccaggctggtcttgaactcctgacctcaggtgatccacctgccttggccttccaaagtgctgggattacaggcatgtgccaccacgcccggtgacatcactagtttatagtaagggacatccaactatttataatgatacatcaggagtgcctcaataatgtgaacttctttttttgtttgagacggagtttcgttcttgttgcccaggctggagtgcaatggcgcaatctcagctcactgcaacctccgcctcccgggttcaagcaagtcttccgcttcagcctcccaagtaaccgtgattacaggaatgcgccaccacccctggctaattttgtatttttagtagagacggggtttctccatgttggtcaggctggtttcgaactcctggcctcaggtgatatgcccaccttggcctcccaaagtgctgggattacaggcgtgagccaccgcgcctggccaagaatgtgaacttccgtatacactagaaggactagttgtactacgggtaattttggagttgctttttgtgttgctgctttgcaaattgcccatgtagtgattctcagttaaagcagaatcatttattaagcaaaacatctcattgtttcatgttgccaaatagcaaagcagttggctgttctctgaacctaataagatgagattttaaagggagaagttgctgtttgaacagaattggcaatgtacaacgcctggtagagcagaaagaaacttgtagattttgttgttttttatttaaataaatacgtttttctcataaaaaaacagaatatgttcattttagaatgttttgaaaattcatataagtagaaaagttgcctattgtgccaccacgtggatatttgcaggactgtgaagttgtactatactgtataattctacatcctgctttggttttccttaacatataaaaatgcttatggtaggccgcctgtggtggcttttgcctataaataatctcagcactttgggatgctgaggcgggcggatcacctgcagttaggaggtcaagaccagcctggccaacatggtgaaaccctgtctctactaaaaatataaaaaataagccgggtgtgctggcacatacctgtagtcccagctacgctggagactgagggacaagaatcgctcgaacccaggaggcagaggttgcagtgagcagatcgcgccactgcactccagcctgggtgacacagcaagactccatctcaaaaaaaaaaaaaaagtgcttatggtacatatcatgtaattatgaactgttaaaaatggttttataagtatgttccatgatgtaaaaatgtcaacacttagaaaaagcacatggacatcctgctttattacatgattacacctgaaggttgtgctgccatgcacattaatatgtaatgcgggcgttgtttatggggttctttgcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatgaatctacacgcctgccatttgcagtgctccggctgctggtcccagaggtatactggttacagctattgcagccagttccctgagacttgtaaaactcctggtttaggacatggggcctgtggtgtggatggaaaatgctgggcctactggatggtcagccagaggccatgtggtgggtgatgactgaagcgggagcaggttgtaccacacctctcccccccccctcccactccccctccctccctctcccctccccctccctccctcccccctccctccctcccccccctccccctccctccccctccctctctccctaacacccaccctccccctttcccccaccctccccccttctcccctttccccaccctccctccccccttccccctcccccccccccccccgcagcccctgctcctttctctgggctcctggcattgtgccagtgagtgctgggaccaggtaatgagcacagccaaaaaggccagaggttcactaggtcagcatcataccaaacgcctggctttcaccaggcatcagtgtgcttcacttgagagtttggtaccatggttaagatcgagtccatgctaggtaagtcctgttaggaatgtcagtttgtattccgcccacgtgaatgatgctgagcttaatgtattattttgaggggcttcttcagagcagttctcactgagctttccattaacctacactcttccggacggctcttaaaacttgcaggacataatgaaattgggaagagcagagtgttgaagtctatagcatggccttctgcttgaccctgagttcctgaattgaatgtgggagaccacaggccatacttctctaggcactcacatgtctcccttggcataaggaaacatgttagtaatatagttttttagatccaaacagtttatttggatctaaaagtttaagtgttcagttgaaaaacagctattgattttattagtagcaaattatcaccattaaagccagtggttttttttttgttttttttttttgttttttttttttttttttgcgacagagtctcttgtcgcccaggctggagtacaatggtgtgatctcagctcactgcaacctccgcctcccaggttcaagcgattctcctgcctcagcctcctgcgtagctgggattacaggtgcccaccaccacaccctgctaatttttgtacttttagtagagatggggtttcgccatgttggccaggctggtcttgaactgctgacctcaggtgatccacccgcctcggcctcccaaagtgctggtattacagtcatgagccacctcacccagcctgtttttgagacggagtttcacttttgtcgcccaggctggagtgcaatggcgctatctcagctcactgcaacccccacctcccaggttcaagcgattctcctgcctcagcctcccgagtagctgggattacaggcatgtgccaccacccctggctaattttgtatttttagtggagacggggtttctccatgttggtcaggctggtcttaaactcccgacctcaagtgatctgcccgcctcggcctcccaaagtgctgggattacaggcgtgagccattgcacctgtccctgccagtgtgtttttaaaatagtttagggggttgagaaaagatgcagtgagccattattctcctttagcaggtagtctcttaaaaattgatgtggattttaaaaatataccattgagaacacgtatctttctcaaacttgaccttgaacagagctggatgggggtgggagggaaacagatttggggcatatggaagatattcttgggagccccatattctacctcagttaccgaaggctattagaacctctgaatttttcctcctctgaaatcctaagcacaacttcagaaaaccatgtctgatagcggatgtcttcctgctgtgaggagctgcttgatgtggggaccaaggtgtgggtgtgggcggaatgtatcctagtagaaacagtgaacctcagatatgaataaataagcaagagaccgaaagttaagtgtgtgacaacctcagtactgtagttaagctacattctttaaattagcttttgtgaactgattgggaacctaatctcttttgtaactgtttgagaaaaactctgaagcacctgatattcaaacaaacttatggtacttactaactcatttgtaaattggcgatgtagctggctgtagtattgctttgataatttttttcttttaatttacctaatatatataaggaaggggtttggatatattaaaataggtgttaattttatctatttaccaataaattcatctctttaattca

SEQ ID NO: 642 - DNA, 31692 bp, Homo sapiens
agccctgctctagctgcctccggtgacaggcacttccaacagcaaaccccacccccaccccgacatgtgctggggaaccgggagttcctgcccctgagaggctgatgttgttggagaaaatatgacctggagaaacacatgggaagaaagttggtaattttcagccggcgctgtaatccctgtaatcccagcactgtgggagaccgaggcaggcagatcactcgaggtcaggagttcgagaccagcctggccaacatggtgaaaccccatctccactaaacatacaaaactagccaggagtggtggtgcacgcctgtagtcccagctactcagaaggctgaggcaggagaatcacttgaacctggaaggtggacgttgcagcgagccaagatcgcgccattgcactccaacctgggtggcagagtaaactccatctcaaaaaaaaaaaaaaaaaaagaaagaaagttgctgggtttttttgttggtttgttttgtttgtttgtttgtttttgagatagtttcgctcttgttgcccaggctggagtgtaatggcgcaatctcggctcactgcaacctctgcctcctgggttcaagcggttctcctgcctcagcctcccaagtagctgggattacaggcatgcatcaccatgcccggctcattttgtattttgtagtagagacggggtttagtcatgttggccaggctggtctcgaactcctgaccacaggtgatccacccacctcagcctcctaaagtgctgggattacaagcatgagccatattaaacttcctttataaaaggcctcaaaaagaagaaactgaggcagaaatttaaaaataaatatgcattcattcactccaagacaagtaacaagcaaggcaaaagttaaaaagaaaagaacaagttttcctctgcccagcaagctcacttcaaggacagttataagataacgctgtttaagaggccaaggccaaaagaataagctccagacacccctcgcctccagagcaaagttgaagaaaaaaaagaaagacaaattctttgactgttactcctttcccaggtttcttaagcatgattatgttttacaaatgtctgtatttagccagttcttgtttttctttcaatgcagctacaaagtcaccagctatgcaaggccacaagttatgctatagatgatgtgacctgtcatatgattaactacttttatttattggaagtctgcttataaaaaccccgctctgtctttgttcgatgctcagctttttagatgacagtccactaagccagtgcgtacctgaaataaacagtcctctcgttctctgtctcagtcttgccagtcctcagtttcctgcaacatctctactaaaaatacaaaaattagccaggtgtggtggtgcgcacctgtaatcccagctactcgggagcctgaggcacgagaatcgcttgaacctgggaggcggaggttgcagtgagccgagatctcaccattgcactccagcctgggaaacaagagtgaaactatgtctcaaaaacacagaataaaagaaaagaaaagattatgcaaaatggaagaaactaggcacaaaaagccacatattgtatggttccacttacatgaaatatccagagtagccaaatccatagagatcaaaagcagattcacagttgccagggtgtgggaggagggggactggaagagatgaggtttgttgttgttgttttgagactgagtctcactctgtcgcccgggctggagtgcaatggcaccatctcagctcactgcaatctctgcctcccgggttcaagcaattctcttgcctcagcctcccaagtagctaggattataggcacctgccaccatgcccagctaattttttttttgtagttttagtagagacggagtttcaccatgttggccagcctggtctcgaactcctgacctcaggtgatccacccacctcagcctcccaaagtacgggcattacaggagtgagccactgcactcggcctaatttttgtatttttaagagatggggtttcaccatgttggtcaggctggtctcgaattcctgacctcaagtgagccacctgcctcggcctcacaaagtgctgggattacaggtgtgagccacggcgcccagcctcttttttgatttttcaaaactgactctcatattaaggaagccaaaacttaagtgataactgaaatgatcgtgttactgaccacaggttctttaggctccgataaaaattgacacgaggccaagcaaatttcccagacaaggctttattaggggcttccgttccaccacgggggagacagcaccgcagggagaggtctccggctggctccccaggggactgcgttgtggcgtctcgaggagggcgacacgcgtaattcatgaggtaggtgagcgtccctgcaggagtgacagaacgcacagggatagttaggaatcgcggtaacacatacatcgcaggatcagaacacgacgagaaagcctctccctggcagaggcttttgttttgtttctgtctgtcacccagtctggagtgcagtgacaagatctcggctccctgcaacctccgcctcccaggttcaagcgattctcgtgcctcagcctcccgagtagctgggattacaccaccacacctggctaatttttgtatttttagtagagacggggtttcaccttgttggccaggctggtctcaaactcctgacacctcaggtgatccgtccgcttcggcctcccaaagtgctgggattccaggtgagagctgccgcgccgaggcagaggtcttggtcttgtaatgaggccgagggtaaagagtggtcgtgcttccggcttcctgcacacaaaggcaatggagttcattccctgaagtacaagattggaagtgcgacgctgcctatcttcatttttcaaggtcgtgtgatcagtggatgtggcattttgtgtaagatttacagtggaatgctgcttatcttaatgctttcactgtccttcaatgagcaggtaagaaaaaaaaaggaagaaagaaaaatgttgggggggggaatgcattagcgaatgcattagtggagttggcagccgagtcccatccctcctctgtctcaataagtgtcagatgatgctatcatataattttgtgggaaaaaataggccaaagaaatgaaattcagaaggacttattctttttggttctaaaatcagtttctgagagctggcaggccccaactgccaagaggagaccctggcggccacagctcatcctctctgaccaagccttagctggggatgggccggcctccaggcagggcctcccgctggctggatcccgggccacactgtacagaagacaaccccgtagagaccttgggtggggcagaagcccccttccctcactgacaccctgccggtctctcctggggtctcccagtctctgctgcccagtggggaagcacccgtctcagcccaaccgcagccccccccggctccctcctgccctttcacctttcctgccattccccactgtgtcctgaagtttctaagaacatccccagcgccctgttgtcagctctgggaagtctaaagttcagggctttgggtaattaaacccaaggcctctcagtgggctgggggtgaatgacctggcgaacgtgcctgcggagatgctgggaggaagctgagtcagtctgcgtctttgtcagggtgggctgaggccagtgaccctctgggggtcagggcccttgcaggcctcttccttccctgacctccaccttaggaggcagctggcccctgagacgcctgcctcacgacattgtcctgtcccaggaactggactttaggaggaggggaagctggagggggatgcagcttgactcttgggagagactttgaggtgtctgggcacaggagtggggagtcctccgggtaccccatcagggactgcttccactgcttgtatggcctcaccagcccagcgcaggaagccccctctcccttcccagaattgaccctctgcaccctctcctgggccctcttctcactacctccatctccaccatgccccaacagagcccctcccccaggcccctttggccgctctccacaccccacagctttctgtctgacctggtttcttagcctctctggacctcagcctccttatctgtaaaatgggaataaggatactacttcccttgtaacgcggtggtaaagtttaaataagctaaggaacacactgcatgtcctgcgggccctggcacaccagacatgctgacagacgctggctgctttcatcagctatgcaaccaaattctaaggggcccttcgtatgtgtcaggctgcgtgccaggaacctagaggtaccaccgtaccacagtacaagatgctgtgtctggcttcgaagagatttcagtctatgtggagagagagaaaagggaagctatcagccaataaaatcgtttgcaagcctgtaattcagcaggttttcaagacctgtcaaatgcccagcaatctcactctgcaactctgcctcttaaatacagcatcttccggcccagcgtgggggtggctaagcccatcatccagatgtgatgaactggggtctgggaaacccacaccggcctcatctggcttttccagcctgtcctcccttccacacatcaggctgacagcaccaaacacggccgaggcctcagccctgagtctccccgctgcagagtgcccaagcctgagttccagcaggttcttcaggggccgctgaccagggaacactgcggtgaggagcgaggacttcgtccccaccccggcccagggcaggggcttcgtggtgagcccaccccaccccagaaggctcctggaagggcagggcagactggcagcaaaatcctataggatgggccgggccagaggcaaggggtggccaaaggcacctgtccaagaggtgggagggaccacacctgggggcagggacgagtcaggcacagggaactccgccagcctagaggatcaaattcctccggggtgaactctgagatagaaagttggcccgggaagctcaaggagggagagcggcagaggggaagactctgcaattctgcttgccccccaccccggcccaggcaagccaccctgcccccggcccccacctgcccgccccgcctgcccttcctcaccccggtgcctgcgggattgctggagagaacgcggcgatggagccgggcaggacccagataaagcttgaccccaggtaagtgagggcggcgggccctgggccagtcgctgggcagcggtggcccctatcccgcggcctgtcctctctccctcccagagccctttggcggccgcactcagaatgagacaggactggaaatgctctagctgttcctaggtcctcagggacaacgtgggtttgggccagggtgtgacactccagggcctcggccttgccccccagcgtggggagagaaaggtcgcagagcgggggctgtggaaggcattcgcagaggaaatggcagcatccctcagcagcagggggcccgtccgtctgtaaggactcacccttcctctgggatcctgctcttcctctctggtcagtccctgggctgctgcccgacccgcatggagagaatccacggtgggctcttcaggcacggcagccaggcacagcctggctaggtggcagcttgtcttactcccccacctgggccagttctccactccctctaagaaaagggccctgaggccgggcgcctgtaatcccagcactttgggaggctgaggcgggagtccaggagtttaagcccagttccagtttgagtcctggagttcgagaccagtgtctgagcaacatggcgaaatcctgtctctaccaaaaatataaaaaattagccgggcctggtggcgtgcacctgtagtcccagcttactcatggggatgggggttgagtagatcacttgagcccaggaggtcaaggctgcctgtatgagccaagacagaccactgcactccagcctggacaacagagcaagaccctgtctcaaaaagaaaaaaaaagaaagaaaaaggaaggaaggaaggaaggaaagagaaggggaaggaagagagaaagagaaagagagagcagaaggaaggaaggaaggagaaggggaaggggaagggagagagaaagagaaagagagagtgaaaggaaggaaggaaggaaagaaagaaagagagagaaagaggccctgaggggaaatggacaaagtcctgcactcaggagtggttgagggtccagtgtgcaaccctcccccttcccccagcccccatggttctgagcacaggctggtgtctcgccaggtacacagcagatcttctggaggtgctgaagaccaattacggcatcccctccgcctgcttctctcagcctcccacagcagcccaactcctgagaggtgagtggggaccctcctcagagggaactgagaggagggaaaccaggatagctgagtggagctggggagaggcggccctgagctggtgcacctgggcagccggggagaataactggcccggtgtctgtcatcgtggttaaggctctggagaagggcaatgcctcaaggagtcagtgggtcaaaagggtagcatgagagcctggctccggagagcaaccgtcatgttgggcctccacaaaactggcctcaaagctcattcaaactgcggacactgcgacctggggcgctttttcagaccccagagccatctggggacccaagatggtgcccaagtggtccaagccccatcgggtctcctggagggctgcacggcatccgccctggacccatgtcactctagagggtggttacggtgagtgacgtgcttcacacaggtgaaccagttgtatttgttttacgatccagcctttctgaaaaacctttgtcctcactggagcattctgttgtcgggtttttgtgtgtgtgtttgtgggtatttgcctcattccacccctgagctctcaggtggacagatgggattcaaaaacctgttctacagtgtttattgtagtggagtaatttgtttgcaataataagtcataattgtccactgaaggggagggtgtggggatccccgaggccagctcaagttcagctgttggaagaattccttgactggaaattttacctttgcgttttgtcgctctgtttcctgaagataacttggggtgctcctggtcgtccatctactgctttgattccttggatcccacccattctttcactttaagaaaaaacaagtaattgttgcagaggtctctgttttgcagcttcccttttgcaagaagcactttttccaaataaaacagtaattaaaaaaaaaaaaacataggtgaacctgcaaaagtcctcgcagtgttggccaacaagattctattactgaattacttttgaaagtgaaaggcattggctgggagcggtggctcacgcctgtaatccctgcactttgggaggccgaggcaggtggatcacttgaagccagaagttggagaccagcctggccaacatggtgaaaccccgtctctactgaaaatacaaaaattagccaggcgtggtggcgggcacctgtaatcccagctactcgggaggctgaggcaggagagttgcttgaactcgggaggcggaggttgcagtgagccgagatcacgccactgcactgcagcctgggcaacagagtgagtgagactccgtctcaaaaataaaagaaaaaaaaggaaaagaaaaagaaagtgaaaggcataggatggggctcagcttattccccggacaccaaaaacattgagaatcacggcccgagcatgcttagagaaaatgtgactcacgcctgcgttttattttgttttcctgctgcatactgactacctctgaaatgttggatacaagtctgtgtctctgtagcacatttaacacgtttcccaggcaacaggaagctctcagtgtgcgttctgttgcagacgtgggcgtgtccttgggctgtgtagggcttcatttcagatgatctgaaccagagcggttgccaactgccagtgtccggagatgcctggtggccactctgtggttagtggcagtaggtggctgctacatctagttccagtgaacctcctgttgagagagtgcagctggtggtacaagccttcccttacacagcagctgtccccccagggaatatttggcagtgtcgggagacttccggttgccacactggaaggtgctactggcatctcgtggtcagaggccaggaaagctgctaaacttcctacagggcacgggaagagcccccacagaaaagattattcaggccaaagtgtcaatagtgctcaggttgagaaaccttgcctcacgcaatgaaaacggttctcacattgctttgcttcagaatgtgcaaacggaaaccccaaggctgttcagaacaggccattctgagtctgctagtccagcaagcctcgccgcaggcagagtggggaggatttggccagcgggccctcctgggacagggaagctgcgaggatgagttcggggacgccccaggcccaggggagcgaggtctggcaggattcaaggatcctggtggaagagcaggggacaattgagagggccgggcaggagaggtgaggcccgctgcgcgccgggctggcggaggagctgtgctttatcccgcagcgagaaggagctcgtgaaggctctgaggctgggagtggctggatgaaagtcgtgcttctcggccattcgttagtaatcaggatggactgcagaggaagaggcttaagaagcagggatgcggccggacaccgtggctcatgcctgtaatcccagcactttgggaggccgaggcaggcggatcatctgcggtcaagagttcaagatcagcctggccaatgtggtgaaatcctgtctctactgaaaatacaaaaattagccaggtgtggtggcgcgtgcctgtaatcccagctactcaggaggctgaggcaggagaatcgcttgaacccgggaggcagaggttgcagtgagccgagatctcaccattgcactccagcctgggtgacagaacaagactccgtctcaacaacagcaaaaaataggcagggatgtaaatgagaggtcgttgccccggcctgccatgcgggaaaagagtctgaggcagggcagtggcagggaaagaagaggaagggttgggaaacaggcagttcaaagaaagagcaggcaatctaggaaagacctaggcgtgtaagtgctggttctgggcaatggtgacggcacagccagaaataggagaagcaggaagaagtgcctctgggaggctgtggcgaaactccttcctcgcttcatttgtaaactttgttgttccttaatttttctttttttttttttttttgagacagggtctcactgtgtcactcaggctggagtgcagtggtgcgatctcggcttaccccaaccctccacctgctgggctcaggtgatcctcccacctcagcctccctagtagctggggaccacaggcacatgccaccaagcccagctaatttttgtatttttttgtagaggtggagtttctccatgttgcccaggctggtctcgaacttaaaattaaatgctaagaaaactatttcaggccagtcacggtggcccatgctgcaaccccaggaggtcgaggttgcagtgagctatgattgcaccaccagcctcagcctgggcaacagaccgaaaccctgtctcaatttaaaaaaaagagagagagaaaaaaaagctattattctagaagaatgattgaatcaattttttttttttaattttaaaatcacggctcacggcagctcgagctctgggctcaagtgatcctcccacctcatcctctcgagtagctgggactgcaggcacacaccaccatgcctgggctaactttcaatttttgtagagacagagtctgacttcgttgcccaggctgatctcaaacgctccagctcaagcgatcctcctgcctcggcctcctgaagggctgggattacaggcgtgaatcactgcgcccggccttaaagctactttttattgaacaaatactacacgccaggtgctttgctaagaagcttaaggagaggataagtaacctgtctatggccatagagctattagtaagtggcattttactttgtttttgtttgtttgtttgtttggtttggttttttgttttttttttttaagagacagagtctcgctctgtcccccaggctggagtgcagtggtgtgatctcagctcactacaagctccgcctcccaggttcacgccattctcctgcctcagcctcccgagtagctgggactacaggcgcccgccaccacacccggctaattttttgtatattttttagtagagacggggtttcaccgtgttagtcaggatggtctcgatctcctgacctcgtgatccgcccgcctcggcctcccaatgtgctgggatgacaggcgtgagcccccccgcccggcctggcattttgctttgaactcaagtgtctgactccagtgctctacactgtgctcctaagctactggaagcaaatatgcaagcatggaaataatttttggttagaaagctgggattatgggtgattactcttttttcaaattcttatttaatgttcctgttttcattattttaaaaagtagtctttgctattccagagacagtgggaaatttaatagttgctataagtatgattatattcaaaatggtcaactagacaagcatttcccaaagtctcagactcttaatcccaaggagtccttcatggaaacagagttctgtaggaagttaagttttgtgaccaggcacggtggctcacacctgtaatcccagcactttgggaggccgaggcgggtggatcacttgaggtcaggagtttgagaccagcctgcccaacatggtgaaaccctatctctacttaaaatacaaaaattagctgggcatggtggtgggtacctgtaatcccagctacctgggaggcggaggcagaagaattgcttggatccacgaggcggagcttgcagtaagccgagatcgcgccactgcaccccagcctggcgacagagtaaggctccatctcaaaaaaaaaaaaaaagttaagttttgtaaaaggtgcgttctagaccctccttttggaaatttacaatgtaaattagcagattaaaaatgtcagtatgctctgcaggaatcatcacatttaaccttaatgcatttccaaaaattcttcagctgtggaatacttttgtcccatagtgtctatttagatgcccttttggggaaattgagtttaaccagcaaagaagaggccatctcctaagaagatagtttgatggacagacccagtatcgggctatggatgctaaggaacttttcctttcctaattagagtaccaaaggcaacagttagaagacactgcaaaaccatttgtgttgaacagtcagaatctgccccaccctcaccttcataaatggaacggccctcccagggttgcctttgatgatctctcccatatccacgagtacacacacctggagtcactgtgtgtcatggttaataagagtgtgggcttagtcacgaatacctgcgtttaaatctctgctccttcacttccaggctgtgtgaccctgggagatgtgcttccttctctgagcctcgtttcctgaaaaagtctatgaaatgcagatgatgataggaattctcataggttatttctttcattcaacaaatagttacagagccgttactcctccgggcgtttgagaacagagcacaagcttgacaaggtccctgcctccgtggagtgtgcaccacaaggtggagagccgagaataagcgagtaaacagctgtgtaaatacaaatagccctgatgtgggcggaaggaggacataacgttacccggaatggagattttcacggagcagggagcagttagggaaatgaagactgggaaggactgggttggtggcgtgtgaaagggcagtttttacgctctccaagggctgatgagcacacggggctgggggtaagagaggctctagcaatggcccccgcttcccaaccacagaacattggttttggaaaaccacctgcattaatgttggctttttcctatctggactttgcctattgtctgagtttttttaattaaacatttctattataaaaatcattcaggtttagttaaaaaaaaaaaaagaaagaaagaaaatacagaacagtaaaaagagaaaaaaatcatctacagtcccacccagagacaggcacggcaaatatcttagtgtaatttccttttttttaatgccttttttttttttttttttttcagacagagtctggctctgtggcccaggctggagtgcagtggtgtgatctcagctcaatgcaacctccacctcccagttcaagcaattctcctgcctcagcctctccagtaggtgggattacaggtactcgccaccatgcctggctaatttttgtatttttggtagagatggggttccaccatgttggccaggctggtctcaaattcctgacctcaagtgatccacccgcctcggcctcccaaagtgctgggattacaggcatgagccactgtgcctagccctttctctatgtttttatttaacatttgtagaaatcatactattcctaaaattttatgttctgtttttgtaagcatgatacaaaataaatttttcacatcattgtatatttggaaaaatatgttcttttctaaaaaaaggtttatttttgttataaatacatattcattatagaataattggaaaagaaagacactagggattttcacacaccgagaaaaggccatgtggggacacagtagaaacgcggttgtcggctggacccggtggctcacgcctgtaatcccagcactttgggaggccgaggtgggcgggtcagttgaggtcagttcaagaccagcctggccaacatggcgaaaaccgtctctactagctgggcgtggtggcaggtgcctgtaatcccagctacttgggaggctgaggcaggagaatcacttaaacctgggaggtggaggctgcagtaagctaagatcagaccagtgcactccagcctgtgcgacaagagtgaaacttcgttgaaagaagagaagggggcggggcgggggggggaggagatgggaggggaggagaggggaggagaggggagaggggagggaatgggagaggggaggggaggggaggggaggagaggagagttgtctgcaagtggaggagagaggcctcaggagaaatcaaacctgctgacaccttgatcttgaactagcctccaaaactatgagaaaataaatttaagttgtttaatttttaaaaaagtgactactcagaaaagatagaaaaaagtaagtagaaaagaagacacaaatcatccatagtcccatcacccaaacataagcattgctaacttttttcagtattataggtattttcctttttttttttttttcacccaggctggagtgcagcggtgtgatcctggctcactacagccttcacctctcccggagtagctgggaccacaggcaggcgccaccacacccggctaatttctgtatttttagtagaggtggggtttcactatgttggccaggctggtcttggactcctggcctcaagtgatccgcccacctcagcttcccaaagtgctgggactaccagtgtgagccaccgtgcccagccgagggtcagcgtattttttgacaaattcacccatagtcctggttggtcctgtggtgccaccaggtgcgactgaccgagacaagagctccagctcaagtctgtaccgtggccacctttctccctgttttggtttcagcagtcatattgctcccactgagctgccctcatgttccttagtcaccaaaacacagagcagactagctaatcccttcctcgtgctcaccccgcaaggcaacaggacaatgactggagtgtggcagttttctccctttcttcctcttatctagtcaggtagcaggtgcaaaggagggtccaataactagaaaagacacttagataaatgaccacaggttcactaaggacctagaaccctttctttaaaactaacggctgcattaatgaatcacgtttgttcggaaacacatattgtgactatattcatttttttctgttagcaacggtgaggccagatgaggtctaccagtatttgtcaaagtgtctgctatcctccgaccactatcaggtgagcttgttaaaaatgcagatgactgggcccatctcagatctatggacgcacatgtctgaacgtagggcctgggcagctagctgctttttaacaactcccaaaatgactgcaatatccacgaaagtttgaaaaccttggactatagttcatgtaagaccaagcatgaggccagcgtgcgtcaggtgtccttggggtttttatttgatccgtttctcttttgttgaagttctcccctggccgagtgtggtggctcacgtctgtaatcccagcactttgggagaccagggtggaaggactgcttaagcctaggagtttgagaccagtctgggcaacgtagtgagaccccgtctctacagaaaatgttaaaaattagccggccgtggtgggggtgcacacctgtagtcccaggctacttgggaggctgaggttggaggatggtttgaacccggaaggtcaaggttgcagtgagccatgatcacaccactgccctccagcctgggcgacagagtgagaacctgtcctcctccccacaaaaaagttctctgctaatgtcctggtttcaccatataattttggtgaaatcaacttaaacagatccagaatgtcccataaattatattcggcttcaattatgttaattgatctacattcgctagtgcagcacctggcactggagatagaaaagtgaagtggggttgggcacgggggctgaggcctataatcccagcactttgcagggccaaggcgagtggatcacttgaggtgaggagttcgagaccatcctggccaacatggagaaaactatctctactaaaaatataaaaattagccgggcatagtggtgggtgtctgtaatcccagctacttgggaggctgaggcaggagaatcacttaaacccaggagatggaggttgcagtgacccaagttcacaccactgcactccagcctgggcaacagagtgaggctccgtcttaaaaaaaaaaaaaaaagaaaaagaaaaaaaaaagactatttcttaggttgaatactctaggtctaaaaaatcctcattcctgtgcacgggtgggagcctagatccagtaaggcaatttcgatccgaggaacaagcccaggccttctcccgctcagtcccggtcgtcagctctctgccttctcctcctctagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtgaggcccccggggctgccctgtggggggaactgaaaagaaggcagagaccaaggtgagaattcctctaaactcagcacgtcacttcggcaaagagtgtcctgccacgacccgcggagggccgaggtttgcaggccgacctccccttgcagttaggatcctctgcttggaaggctgtgcagtgtttgcattctaagggctgcggagacagctggagatctgctcagcccaccagccgcctcatccttgctccccgctacagtgttgccacttgaagagcttccttcagtggttcctcagagtgtgggggaaagtctcattccacagggtcacactcagctccacccttacgctgaggcttttgaaacaccctcccacaggtccttggtttgcttgacttaattagtgctttttccagctggcaacgtttaaggaacgctgcctcgaatgtgtaggttttgcctcctgtgtccttgccgcaaaaggcttccggagcctcagggtctccctcccgccctcacctgctcctgccccttctgagcaggtggtgtctgtgctgtgctgctttggtctctggatccctcgttccctggtgctggtggaaatgaccatcacctcgtgagtgccctgcctcgccccacctccaagggcccctctgctcccgctcaccaggactcgagtccgtgtccttgatcccagctgaccatgtatctggcccttcccagcttgtgctagttccgggctcttgcgctcctggctctgctcagggaatgcctcattttggcatctggcacattcctcagccagccctctgttcccacagtctgaaattccccttctcccagtcctgtgggccgtctcctctccctcgcccctcttgggtcacacacccagaacgcccagccctagctctgctcctcagtaagccccacctctccctgctgtctttctctctggcagcagacctcgtaggccctcttctctccccaccccaggttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggtgaggcggggccaaggtgccttccccaggagccggggagcctctcctggacccctggtccccttcaaggctctgggaattaggcgtgaataggccaaagccagtgacggaagggtgggcatcccacggccaggacccacgggcgccaccctcaggggacaggggagcagaggaaggagagctcctcaattgtcatcactgaacttcactgcaccctgcaagccttagccacacagagaaaactggacttggggccattcgcttgccccttctgcccactttggtgaatgaggttgaggtcacactcccagacctcgctccaaagacggaattcttgtctggaggtgagtgggagaccaagagggttcccagcactctcaacattctgcttttttcctctgtccccatccacttaacctggttggtgtttatgacagcagccgagcctcagcccaggagccctgtgaggagccggggcgtcttcctggggcagggggtttgtgggcccatgttcctaaccctcttccccactcaggaagaagcttcagctgctgatgttgggccctttccaatacgccttcttgaagataacgctgaccctggtgggcctgtttctcgtccccgacggcatctatgacccagcagacgtaagccgggagtaagggacagcacagtccaagactcatttagtacctttgtgttctaaaaggaatcaccagagccaacaccccttgacagagggccccagaaaagggtggctgtgggaaaacagaggctcagggactgccagggagagaaccgcaataggccaggcccccgggctttttcattaccgttcctgccgtgggagaggagagctcaaaggaagcaccaggtgccatgatgcatggctcacgaggccgaggtgggaggattgctcaagagtgggagttcaagaccagcctggacaatatagcgagatgccatttctaaaaatgtttttaaaattaggctggacatggtggctcacacctgtaatcccagcactttgggaggctgaggtgggaggatcacttgaagccaggagtttgcgaccagcttgggcaacatagtgagataccatctctttttttttttttttttgagacggagtttctcttttgtcgcccaggctggagtgcagtagcgcatctcggctcactgcaacctccgcctcccgggtttaagtgattctcctacctcagcctcctgagtagctgggattacaggcatgcaccaccacccccggctaattttgtatttttcatagagatggggtttctccatgttggtcaggctggtcttgaacacctgacctcaggtgatccgcccgcctctgcctcccaaagtgctgggattataggcgtgagccaccacgcctggcccatctctattattaaaaaaaaaaaaaagttagctgggaatggtggtgtgcacctgtagtcccagctactcagaagcctgaggcgaggggatcactggagccaggagtgtgatgctgcagtgagctatcattgcacctctgcactttcagctgggtgacagagtgacaccatctcttgaaagagagagagagagagagagagcttgcctgcctcactgactactttctgttgccaccagatttctgaggggagcacagctctatggatcaacactttccttggcgtgtccacactgctggctctctggaccctgggcatcatttcccgtcaagccaggctacacctgggtgagcagaacatgggagccaaatttgctctgttccaggtaactataccctgggagagaaaagatgtttcataaccgagctacagatagttggggttagtaagtgaggccaataaaggctaaagtgggccgggaatctttttcataagcctcacgtctctcatgagatttggaaaatgattcctgtgcttcccgcttttgtctttctgtgctggaattgtttcccagggctgccatgacaaaataccacaaatcagatggcttaaaacaacagacatgtcttgtctcattgtgctggaggctagaagtccacagcgaaggagccagcagggccctgctccctttgagccctgcagggggtcccagcctctccctagtttcctagttgccagcagtcctggaccatccttgaccagcatttgcgtcactcccatttctgcctccattatctcgttatattctccccttgtgtttctgtgtgtcttctatttttttttttttttttgagacagagtcttggtctgttgcccaggctggagtgcagtggtgccatctcaggttaagcaattctcttgcctcagcctcccaagtagctgggattacaggcatgtaccaccacgcccggctaattttgcatttttagtagagacggggtttcgctatgttggccaggctggtctcaaactcctgacctcaggtgatccacccgcctcagcctcccaaagtattgggattataggcgtgagccactgtgcccctccatctcatctatttttaggacaccagtcaaattggattaagggcccaccctattccattatgacctcatcttaactaattacatttgtaacaaactgttcttaaataaggtcacgagtaccggggggcaggacttcaacatagctttttggggacacaatttaacctgtaacacgtgtgttagttaacaaaccttacatttgtctccttgcttcttcctttccttttctacctatgacttcctaaaatcctataacccatcaacaccagcagaagcattagcattagctacaggacctacctacaccatgtgccgggcactttcacacattacacttcaattttcacaaccccaggagtcatttttcccattttacaaaggaagaaacagacccagagatgttcttgctcaaaggcacataaggaacggggctagaatttatacccaggtatgtcttgactcctccacacatctgtcttctccttaccctgcccttcatcttcacaacgcttctgaaaattctctcaaaggcatgttggcccaccttctacgtgctgccttctctaacctcaaagatgacttttccaccaaatgcaatgacttctaacccagtcttgttctccttctctctccatcctgtctccttgctggtcttctactcccaaggcataatgactgccctacagtttaacagagtgagttcacgtacattctcatttgatctacgtacatgcctcccaaatgtgaacttccaggcacataggaggtagaatgaaaggggctatgggaatagagagagaagtccccggaatgagtcagggactgaaggggcagaaaggttctgggtcccagaagtacttgagaccaggccgaaagataaaagccgtgtgatggccgagcctgcccatggttaatgtgggggagcctgggtgagccacgccagccttgaagaagctgaggtttccacacaatgtactcagggagggcaatactaagataaatggtgcttccagggcttctggacagtgatcttcttcttctccccttttgccttctttatttggtgaaatattgataaaatttgccattaatgattttgaagtgtcaggttctgtggcattaagtacattcccatagttgcactaccattaccaccgtccatctccaggcacccattaaacacattccccattgccctctccctgcagtctctgggatggcagagcttccaaagggcattttaatggttaattgtccattattctaggagcagggacctcaggcacttgagctagatggaatgactcttctctaatcacccatctctttatccattgagtgctcattggtagccatggctgagaaagggaattaaaaatgaaccctttaatcagttcttatatcttgtcagaaactctaataaactactgggtagaaaataagaatgtcatttgcctaaagatgaaaatcccacagatttttaatgaagtgagagcctcaaccctctgtgactgcacagatctgacggtgggtggaacctgcccagcggaagggcaaggcccggcagtgggctggctgcgttctgtgccgtgagggcaggcccagtccacccttgcctctcttttatgttccgcaggttctcctcatcctgactgccctacagccctccatcttctcagtcttggccaacggtgggcagattgcttgttcgcctccctattcctctaaaaccaggtctcaaggtgagcacgttaagcctcctgtcccatcgtgggatggatgagacggggagagtcaggaaagaaggggccccagaacagacattaggccagcctgacttctgctcagagtgttcagaagggatcttcgggaaatcccaacagaggctttaaggaaactatgacctctctgatcacacagaagagaagtgaaaccccacagcttgaggccagccctgagggccaacccaggaagccatgggttcagtcctcagctcctgggagaggaatgggaatggttaaaaaacagaagcccatgttgattgaacacacataagaaatggactgtatgccagcctcagagcacagaagtagacagccaacttccggttctggctctaccattaacccgctgtgttatttatgacaatttcgtatccctaagtcctgatttggggataaactggagaaagtgttgctcaactcccgtgcccgggctgctagtaaaataccacctctgtaactcagcataacctacgctgtatttcaccctacactgcagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttagaataaaattgctttggatcttgcctggaaggtgttttaagttttgtaataaacaagatgatgtctgaaaatgtgtaactgggcaccttgcctctgtccatgtcactattaacccttcaaggttgtatattgctggctaggtgcgacagctcatgcctgctatcccagcactttgggagcctgaggcgggaggatcacttgagcccaggaggttgaggctgcagtgagcaatggttgtgccatacactccagcctgggtgatacagccagaccctgcctctggaaaaaaaagaaagcttactgagctttcctaaagcagatgaaaagaagagtatatagtattgtgtctggcataagaaaaggagaacttggtgaggtgaaatagcaccagcccagagtcttgaagaagccaggggccctggagaacagatggaaggtgacctttccctgacaggtgtgctactacggcaccaaccacgcggggccctggtggtctgggtcagcctcactttgtgggacaatggcttttgagtcttcagtgacaagctagaaaaggaatctcctgacactgtggtcatggagcttgatttctaaggagagagtcagcacgtggaagcaaaggcaccgagagtccaagtaaaagtcccaaatccataaaatgcaccacacaggtcaaaacacaggacacggccgggcgcgggggctcacgcctgtaatcccagcactttgggaggccgaggcaggtggctcacctgaggtcaggaattcgagaccagcctgctcaacatggagaaaccccatctctactaaaaacactaattagccaggcgtggtggcgcatgcctgtaatcccagctacttggcaggctgaagcaggagaatcgcttgaacctgggaggcggaggctgcagtgagccgagattgcgccactgcactccagcctgggcaagaagagcaaaactccgtctcaaaaaaaataaaaataaaaaataaaaacaccactggacatggaacatcaggtaaaaccacactgcctttatttggctaaagaacaaaatccaaaataactcagaacaaactaagaacagacaggaaaattacagactgaaccccacttgaggaagacttccccacggactcacactggtgatggggcgaacgttcaagacgaagccagcagtcctttccaagactcttttgtcttttagggatcctcaatacaaaacaacccaactaatccaggatatgtgttcaaaacagtcagttttccccctcaaaaggcgggaaggcccacttcaaacctccaggaacacaacccaagtcatcccagtgttaaacctggtgcttccgttttctgcctcaatccgagcgctaacataaaatcttggcagacaacaatctttcttcttcaagaaaattaacatttaatggtataatcccaagaacatgttctacttatttacttggaaaaatagaagctagggaccactctttatccgatggcagtctattctatgagagaaaacaagaacaatcattgttatgactttgaaaaatagaacctttaaaaatacttatattggtaagcttaaaaaaatatcatcagttaaaaacattaagggggctttctttttctacctgtattggttcaacttctggtgagaatgtgtgctgatagaaaatctagaagctatggcttttagggaattaaagaaaagcagcaaaatataattgatttggaaagattttggataagtgatctggaacaggattaaaaaggcaaagagctcttgaaaataagctacccatagtcaaaataatccaggaagggggaatgacgccctatgaaccactgtggaaagaacatctagagatggtctgaccagctgtgcagcctccaaaaaaaaatcactatcgctcaggtgcagccccccaaaaaccaccatcactcaggtacagcctccaaaaacaccaccatcactcaggtgcagcctaaggagtcatcagtgatcagaaagtggctaagtttccttagcctccctcatattttttctcttcttcaggattttcaacctcctcacatccctaactttcttacccaagcctcagcaatataatggtctttggctctagctatcagcaatagctgcaagagcacaaatgatcccttcctagtcctctaaagtgtcaacctccattcttcagtgcttctgaatctagcataagaccaagctttccgtccggcccaccggaaggcagtggctgcgccggcacctccccggctctggccttctaatgtctcacacacagaggctctgctctaaggccaacacttctggctctctcatcttggccacatttggcccacccatgttgactgctttctcgtgtgtgattcagggaaacagctccatagcctcaaacgttaatatctgaagatttagatcccaggcattgtggtggtgtgcacacctctaacctcatttaattaggcacagatgaccacattatgcaacttcccaacagctttctccatctacccgtgctagtccagcacctcagaccacatttaccccaaagtatctaacaggccacactataaaagattttagctttcagtcagacaaatagctttcagtcaaaacgattagactgaggtggtagaagctcaccaaaaggggaaagggagtttcccaataacatgtacgtttgctggccctagcagtctcagaggcctgtcagcctgcaggtcccgttccaagcacagggcatgccaagagcagcccactgagagcagaggaagagggctcaaacatttgggacccagacaatatatttaggaggtatggctccaatagggagggaggaggaaaaccacgttccgggcatctccctgtctatccaaatacacttgcataatgtgcacttggaggaaccaagcagatgggcttcagcacagacttcactgccacaccacaccagggagaataagttagacagaaacaggcagcattcccaaagagagaaggctgacgcagaaaagttcaaagatgagactatgtaacactgggtaacacaggaaaacactaacttcagctgtttcaaagacagacaggattccaagccaaagcttgtatgaccagatttaagagtaagaactgcgcttcaaagaagagttagaaatgtcgttgtcataggcgatcaggataacaagaggcttcattctccctcgcctctgtgacgctctttctgggtgatccaagttttgttttttttctagttgattatttctctttatttctgtatgtgtgtgtggtttttgttttgttttggagacagagtctcgctctgtcacccaggctggactgcagcggcaccatctctgctcactgcaacctccgcctcctgggttcaagggattctcctgcctcagcctcccaagtagctgggattacaggtgcccaccaccacgcctggctaatttttgtatttttagtagagatggggtttcaccacgttggtcaggctggtctcaaactcgtggcctcaagtgatccaccagcctcagtctcccaaagtgctgagatgacaggcgtgagccaccacgccttgcctgggtgatccaagttttaagaaccaaggtagtcctgctgtgcaggcaatgattctagcctctgaccctcaggcggaaaactaggtgttaccagaaagtgtttagggagtggactatgagatgctcacagtcctagcagaggcaaggaaagagaaaatgtggttttcttagctgaaaacactaaaattccacccccacaaggggtatttatgagtgacaggggtggggcctggacataagcaattttcccctggatctagccacaggattactgatgggtgatgatctgctaggccgcgtagctaagcagctaaggagacaggaggccagggctttaaaagttagagcatgctcaacagcaagtgctaagcattagcattctttgatttgaaagtcaagtgttgaatccccccgggcaagccaacaaggcagatggaaccacaaccaccaggcgtgtgtgaaaagtggggagaaaacctaccacactcttgtcacgtgagggtatgctctgtggcttgctggaggagcagcagagggaggtccctgccagctgcagctctcagaggaaaagaaagatgtggagcactggttccagggaagaatgttctgaagagggacagaggtcaaggtgataaggctgttgctttagaaaggaaggtgtttcctatgcttttgcctttacattctgtgcaaatctctctaatatggctatgaccaaaatggattaacatcaagttccaacagcagacatttacaaagtatcctttgtaaaaggctaggtaatattaatagcattcaaataggagtagcagggccaggcacttactcccagtaggaaactaatctcaatcgacttggtataggattgagtattgtcccgctcctctcctcatcattgtaactctaaaagtgttccttccttcgaaggtagatggcacgaaagagactgacaaaagctcccaaagaactgggtcacagagttttctgagaagatgaacacagcagaaacactgcagttgatgccatgggtctgcttccatccccatcagtgtcttcatggaccccattgggtccaacaagaaactcctcagggagtaagaaaagttaggttcagatctccttcccgcagccacaatgacactggtgacagcagtacgttcaggggatttgtgactgtaactctgcttttcgcttttccttaaggaaatcaaaattaagatatttctccacaaattacccatcagcgtggctcatttcgtgaaggacttggcaagccacatagcttcagaacggaaggcaaatgctatagtataccgggaagaaaaggcctctgcgtattacactacctccttcttctgcccactcctcaggggcaaaaaattagttctacatttgaaagacgaattttttaaaaaattaatgaaaatgacaatttccctgttgagatcacgtgaacataaacagtgaaacaaagcccttgggggggggtaaatggatgcagagcaggcttctaaggtgcagtccccctccttcgtgtgggtgagtgatgtcacttgcaggacaggctgtttgggttcccccagtcctaggtcttctttccccagttgtctttcctttgtagctgtccttaggtttagtgttggggtcacaatttggaattcaacagagagcttctgaaggtaatgggacagaaagggaggacaggaaaggagggaggaaacattagtcttcttcatcctcactgatatcataggctgcagccttgtgcctggagagatttgctggggagcaaggtggggaagtcttgccggagaagggccatcggaaagagggggagggggagcgctcgcgagtagggctgctgctggggctctgcttcgggctgatggcctgcagcatccggcccttcccctctttcagcatatgtttctgcagaaaccgaaaggaagagtcagaaaaacaccgtggatcctacttaatcatcactgaagcatctaggactgggatagtctatgctgtactatttatttaagggttctcccctgctgtcatcacccgggaaattccccattcttcctcaataatctagtctaggattattctaatttatccaaacaccttcacagacagatccttcctgatatctaacctaggactcacttgctcaatcttttatttggttgaaaagactgctactcctcaaagacagaattcccaccttacctggggttcctgctgcagctacttgtagtggaggctgctttctttttattgttctttattctttcctttccttctatctaaaatcataccacagataaaagctgggcaaggcgacttgcttatcttgtcaccagactttaaggttgagagagagctggcaaaattatctaggagaatgtgtaacgtctttctgtaaaggtttcaaaaaccttgctggggacagttgaaagatagttctgcccagataaggggatagactagataacttctcagtgtcgatgccccttcctgctcaatgattctgtcattctttccacaacatggaactccctacattgtccagtgggaaagaacataccagtgctccttccggaccaaacatttccagaaaacttccaatgaattctcgggacttctcctcccacttctgaatgaggtcaatgcttttttcctccaccttctgaacaaattcttttgacttttcctccacatctttcactttcttctttactttgtcaaccctctcctgcaagtggtatttcttctcctagataaagaaataactcttctgagaaataatgctcatcctaaacttctctaccataagagaacgaaaaaacatggctcaagcactcaattgacactgttttcagtctagaattttgctttgctttaatctaccccactctcagcataataacagataagatatgctgtggatgcacacacaagaagtggtaattctaatattgtgggcatttgggaataaactaaaaatataggctatacccagtaacaggcacgtagccaaataaagtcagagttttaaagataaaacataaacttggaacataaacatgcgcagcatggcccgaacctcattccagacggagatacagaggcagctaaaagatcactgcacaatactgccaagaataaactaattacaatagattgaaagagaaaatactagatcttttacttaattaatctgcttattgtactggatttttcccctctatcactggcttattctattattttaaatgaattgtgttttttgctttttgttcctttagtattttaaggtccatttactcatttgcaaaatgatgatactcgttggtcttaccaactttgctaaagataaggaaaatggtataaaccctccggtggaagggaagggagtatttagtcaaatgagaagtatccttggccaggcacagtggctcatgcctgtaataccagcactttgggaagccgaagtgggaggactgcttgaggccaggaactcgagagcagcctggacaacatagcaagacctcatctctactaaaaataaaaatataaaaaataagctgggtatggtggcctgtgcctgtagtcccagctactcaggaggctgagatgggaggagcacttgagcccggaggtcaaggctgcagtaagccaagattgcgccactgtactctggcctggatgactgagtgtgactctatctcaaaaaaagaaaaagaaaagtactctcaaaatttccagatcataaagagaaaagggattatgtttagaatttttaaacacctgatttttatgggaaaaataaagctatagtaagtaaattaacaagagctagggtttatctgcctagataaatcatatttagatgtaatcattttatccattcttatagcacaatttacagagatgggagtaggtcagggagcatggtaaactggttatgtagaagacattaaagttagcagctttcttctttttaaatcgattttattgaggtctaatttacatacaaaatgtatagtgttggctggatacggtggctcatgcctgtaatcccagcactttgcgaggccaagggggtccgatcgcttgaggccaggagtttgagaccagcctggcaaacatggcaaaaccccatctctgctaaaaaaaaaaaaaaaaaaaaaaaaaaaaaaaattagccaggcctggtggcacatgcctgtaatcacagctattcaggaggctaaggcaccaggagacagaggctgcagtgagccgagatcacgccactgcactccagcctcggtgacagagcgagaccctgtctcaaaaagaaagaaacactacatatatatatatttgcatgaatttttttagtttttttgtttgtctgtttgtttagagatggggtctcgctatgttgcccccagactggtctcaaactcctggcctcaagcagtcctcccgcctcagcctcccaaagtacaggcatgaactaccatgcccagaaaaatatatagagtttctaaaaggcaatattaagctaagataaacttaactttcgtcaatccaaatttaaaactcaggtctgtgtgggaagtggtgtgtcgggtgtcactatccacacgaggagggctcatagcctttcgcaggttcccaagacatcatccaaccgaagaagagagaggaagtttaagagacaccgttttccatttattgacagaaatactgcactatataaattactcatttatttagttggctgtatggctttatacgaatgtgttggtaccagaccgtaacggcagaaactgtctgtttcattctttttgtgaacagttaacatagtggtaattcattcactgaacttttgggagtgatcatcaaagccaactgcaaagccagttcagctgagatggagtgggaggtgatatgtctcctacagagtcagggaactctggggtaaggctggaactcacgttgataaagctgacattgagctcctttgctgtgtagcccctctgcaggttccgcctcgcatacacatcataatcccgcacaattcgggtgatgatgtctgatgtggagataccttctgtcctctgtgttggagcaaacatgcctaactcagaaacacatacagacaaacactgtgaggttctggttagctcaggtattaagactaaatggaaattgggggcaacattcctttcctttcctcaaaaagcagaatctgttattactaaatgaaactgaaagatactgatatacagaaggtagaccgaatcaaaggccagaggtaaggcaaagaagagttacatagccctaatattaagaaaaatatgagaaagggtttcctgaaattaagagagatatccaaagtagatgtttagaccaagaattgatggatgtcatgaactgacgacaaagaattgatgggtgctatgctcatctttaccttttatccaaaatgtggcctgaaagaggatgttgaatttctaatgtacacattttcctctgtaaagcagcaacatggctgaacatctgcagctgccctgagatcccctacagtgaggaagcacagctcactcacctgcctccttgatgtgcttataaacatcatcactgccagcagatgaataaggaatatcatcatgggctacaaaatcaatctgaaaataaggaaacatcattaaaacccatgataactgccattcagaaagacccagtcaatgttctcaggcccagaaaaaggacaataggcagaggccaggcctcagtggacttcatatctctctttgctttgctcataaattctacaatctattcacaaaccacccaacctaatgatttatggagtatacatatgaagttagccagctgcttttgtagctatttctcctagtctgctagaactgttaccctcactctgtataccagtcatcttgctgtggtcaatagggccagagggtttgctggtgaaccggttagtgggtggagcctaggaaagaaggaaatctccctgtcctgggtctggaaggatttggtcaaataagggtttctaaaagtatgagaaaggccaggcacggtggctcatgcctgtaatcccagcactttgggaggccaaggcgggcagatcacgaggtcaggagttcaagactaacgtggctaacatggtgaaaccccgtctctactaaaaatacaaaaaaa

SEQ ID NO: 643 - DNA, 34986 bp, Homo sapiens
gcttgtccggtggctgctgcgctgccgcaacgaatagggtttctggctgcgtaggagggacgggggcgcggagctctgggaaactgcgccaggcgcccgaaaggtgaacacgggagtcgcgcgtctcccccgcagcagcggtaaagcggaagttatgctgcagccggagcccgggcttcctcccggagccgcgtcccggggcccggctgccccgagctgagcggagcatcctttccgggtgaggggaggagaggacttggcgcgttcccctcgctgccccgggagccgcagccgcggtgttcatgccgcggagcagccaggctcctccgacgaaaacctgcatttatttgctggcgggacgtttgccttgaaaatggacaaagacgccgccctccggggtattcctgtttgcctgaccctgagagcgcctttttgcttcaagacgtgttggatgctcctgttctccgaattctgatacgcttctgggcataatactgaaacacaaaactgcttttgctctctctgtggttggccgaaaataggattctttttcgtgcaggtgtcgttgtttagtcggctttactaacatattgaaatggctctacccaaagacgccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtgggtgagtaaaccatggcgtgtttgttggccaaaagccgcaagtctttgaaaaggtgaatcatcacttttccatttaaaaagtaaaaacaaaccaaaaaacccgactagtatttgtctaaatagttctcagaggttagggggtttatgggtccccaaatgtcgatggattataaagtcaagggcaagattttgtccattgtcaaaatgcccgcgctgtgttcgatgggtgtttgttgtgttaaaaattaaagaattgcccgtctggagccttcttttttttttttttgagacaggatctcgctccgtcctccaggctggagtgcagtggcgcgatctcggctccctgcaacctccgcctcccggtttcaagcgattctcctgcctcagcctcccgagtagctggggttacacgcgtgcaccatcacgcccggggaatttttctgttttttagtagagacgggatttcaccatgttggccaggctgatctcaaactcctgacctcaagggatccgcccgcctcggcctgccaaaatgctgggattacaggcttgagccaccgcgcccggcctctgatttacttatctatacatctccattcatttaattcttgattctcctaatcatgcgacgaggctaaagtcgcttttttatcactcaaccctgcacccggtagactcaggagccccaaactgaacccttgactctttcctccactaatgtgagcaataagccgggcggtggttcctgtctgggcttaggatatggtgtctccgttctctcgtggacaggtctttttttttttttttttttttttttttctaattttttttggtcacagttatatgtgtacctgccttttaaacatacgtttattttattgtaaaaaaatgccattttaaacatttttaaacaatagttaaaagaaaaagctttattcaaatgctcgcagaccatacaattcacctactaaaagtgtgcggttggccgggagcgatggctcacagctgtaatcccagcgctttgggaggcggaggtgggaggatctcttgaacccaggagttgaggccggtctgggtaacataaattcagtaaaatgtttaaaagtgtgcaatttaatggtttttggtatattgcgttatttttaaaatattgtccaaaatgtatataacaaactgacattttaaccatttttaagtacaattcaatagcattaattacattcacaatgtaaccatcaccactgtttccagaacttttcatcaccccagataaactctaaccgtgaggcactgactccccatttcacctttccccccagcctcggcaccttctattccactttctgtctctatgaatctggccattctaggtatttcatagaagggactcatgcaatataggatcttgtgtgtctagcttatttcacttagcgtgtttctgaggttcatgtacagtgtggcatggatcagtacttcatttttcgggctgaataataatttgttttacggatatacttgttacattttgtttatccattggctggacattggtttttttcaccttttcgttatttgaatactggcgatacgaacatttatgtaccagtatgtgtttgaatacctgtgttcagttcttttgtctatatatctacgagtggaattgctggatcctatggtaattctgtgtttagctttttgaggaactgccacattgatttctacagtggctgtaccattttacatttccattagcagagtacgaagtttccagtttcttcacttcctcaccaacacttgttattttccgtgccatgctagtacatgtgaactggtatcttaactctgtgtgtcaaaaaattgcggggccgggcgcggcggctcacgcctgtaatcccagcactttgggaggccgaggcgggcggatcacgaggtcaggagatcgagaccatcctggctaacacggtgaaaccccctctctactaaaaatacaaaaaattagccgggcatgttggcacgcgcctgtagtcccagctactcgggaggctgaggccggagaatggcgtgaacccgggaggcggagcttgcagtgagccgagatcacgccaccgcactccagcctgggagacagagcgagactccgtttcaaaaaaaaaaaattgtggtaaaatatagcaagattaccattttaaccacttaaaaatgtttttgactagaaagaagggaggaaaattttaaccgtttgtaattgtatggttcagtggcatcgcctccgttcacactgctgtgcatccgtcaccaccgtccatctccagaactttttaatcctcccaaactgaatttccacacccttgaggctcaccgttcctccctcctactatcccctggcaaccaccgttctcctttccatttctgtgaacccgactgcttctaggtacctcctgtaagtggaattttcataggttttgtccttttgtgtctggcctgttttacctagcgtaatgttttccaggttcatccatactgcatgtgacagcattcccttcttttccaggctgaataatgttccagtgtatgtatatgctacattaaaagaaatctgttcctctgtcagtggacacttggcttgcttccacttctcggctattagaaataatgctggtgtgaacttgggtgtacaaatgtctgttcaggggcctgttttctattcttttgggtgtatacctggaagtggaatttctagatcctatggtaattctatgtgtgattggttttggaaaccgccatactgttttccacagtgactgtaccgttttacattcccaccaacagtgcgtgggtgtccagtttctctgcaccctcgccaacacttgctattttctgggttttgatagtagccatcctggtgagtatgaggtggtatcccattgtggtttttatttgcatgtccccaatgactaaggatggcgagcatctttgcatgcatttattggccatttgtatatcatcttcggaaaaatatgaaatatctattcaaatcctgtgctcattcattctttttgtttctgtttttctcccaaaacccagaaaaagccacaactttgcctgtcatttaatcaggttgtttttttgagttgtgggcattctcctgcctcagcctcctgagtagctgggattacaggcatgcgacaccacacccaactaatttttgtattgttagtagagatggggttttgctgtgttggtcaggatggtctcaatctcttgacctcgtgatccacctgtcttggcctccaaaagtgctgggattacaagcgtgagccaccgcgtccgggctgttttagtttttatccaccatagatgagttttttctgttctggaacttcatataaatggaattctttttatttcctagggctactgtaacaaagtaccacgaacttagcagaaatttattctccctcagttctgaagagtagaactccaaacccaagatgctagcagggagcagggacatgtacattgaaggctctgggagagaatctgttccgtgcccttctccttagcttctggtgtggctggaatccatggtgttcctggtttgcagctgagtcactccagtctctgcctccattggcacgtagagtttcccggtgtgtctgtctttacatggccgtctcctctgtgtctctctcttttttttttaccaggacactagttatattggattaaaggctctgtactctttgtatgaactccattatatctgtaacaacctgtttccagttaagaccacattcttagttactgggagttaggacttaagcatatcttttggggggttattcagcataaggttcaagatttattctttttttttttttgagacagtcttgttctgtcacccagtctggaatgcagtgacaggatctcggctcactgcaacctccgtctcctgggttcaagtgattctcctgcctcagcctcctaagtagctgggattacaggcacgcaccaccatgcctggctaatttttgtatttttagtagagatggggtttcaccatgttgcccagcctggtgtcgaactcctgacctcaggtgatccacccgcctcggcctcccaaagtgctgggattacaggcatgagccaccgcgcctggcctcaagatttattcttgtgtagatattcgttttttaagtattattccaccattgactatgctgtatatgattggccattctccactgatacagtgcttcagttgcttgcagttttggatattatgaataaagttgctgagaaggttcttgtgcaagtttttgtgtctctgtgtgtgtatgtgtggccttatgttttcagggtttttttggttaaatacttaggagctggaattacgcaacgtagaataggtacatatttttataagaaactacctgccaggcatggtggctcacgcactttgggaggccgaggcgggtggatcacaaggtcaggagttcaagaccagcctggccaagatgctgaaaccccatctactaaaaatacaaaaattagccgggtgtggtggcgggcacctgtaataccagccactcgggaggctgaggcagagaattgcttgaacccaggaggcagaggttgcagtgagcctagatcgcgccactgcactctagcctcggtgacagagtgagactccatctcaaaaaaagaaagaagaaactaccagatctttttcgaaagtggttgtgtcattttgtaatcccaccaacagcatacaggttctggttgccgtacatcttaccaacttttgatgttatctgtctttttagatttaaccattccagttgatttgtattgatagtagtatcttgttttaatttcaatttccaggtaactaatgatagtgttctttttcatgtgcttattgacagttttgccctcttccattgtaaagtgtctgtttaattctttttcccctaaattgtttatattcagttgtagacattatttatgtattttgaatactggtactttgccagatattcttaattgttttgacgagctgaaattcttaattttcatgaagtctcataaatttttccttttatagtttattgctttttatggtctaagaaacctttagctaccttcaggctaagatattgctatttttttttctaaaagatttatagttttaccttttttttttggagactgaatttcgttgtgtcgcccaggctggagtgcagtggcgtgatggctcactgcaacctccacctcccaggttcaagcgattctcctccctcagcctcctgagtagctgggactacaggcacgcaccaccatgcctggctaatttttgtattttttgtagagatggggcttcaccatgttggccaggctggtcttgaagtcctgacctcgtgatccgcctgccttggcctcccaaagtgcgaggattacaggtgtgagccactgtgtctggccagttttaacttttatgtttaggtctttgatccatttcaaattaattttgaatattgtataagttagggggttgaggttaactttttcccatatgggtatcagttatttctgtaccttttgttgaaaagactttttaaaaaaaataatgtgggtctattctatttcattgatccgttgattctaatattagtgtcacactgtcttgattactgtgactttagagtaaatctttttttttctttttgagacagagtcttgctctgttgcctaggctggagtgcagtggcgtgatctcagctcactacatcctctgcctcccaggttcaagcagttctccttcctcagcctcctgagtagctgcgattacaggcatgtaccaccatgcctggctaatttttgtatttttaatagagacgggagtttcaccacattggccaggctggtctcgaactcttgacctcagatgatactcctgcctcgaccttccaaagtgctgggattacaggcgtgagccatcgtgcccgtcctccgtatatttattctttgtatgtagagacggggttttgctatgctgcccaggctggtcttgaacagctcacctcaagcagtcctcccgtctcagcctcctgaagtgctggaattacaggcctgaaccgccacacccagcctatttaaatttttcaatcaacttaccagtttctactaacagcctgttaggagtttgattggggttgcattgaacttaatagaacaatttggggagaattgacatccaaacagcaacagagtccttgtatccatgaaaatagtatatttctctgtttgtgtaggtcaccttcaatttttttcagtaatgaagttaaaataaggtcattagaatgggccctaatccattatgactggtttccttataaaaaggagaaatttggacacagagacagacacgcacagaaggaagatgatgtaaagacacagagtaccacgtgaggctggaggactggagtgatgtatttacaacccaaggaacgtctaaggttatcagcatactgtcagaagcaaggaagaggcaaggaaggatcccctacaagtttgaaaagtgtcatggccctgctgacacatttattttggacttttagccagaactgtgagaaaataaattgctgtattttcaagtcacgcaatttgtggtacttttctatggtggccctaagaaactaatatttatccctaattatattatggcttttgagactgttttaagtaaattttaaaaaattttcagtattgttcattgataatttataaaaatataattggtgtttctgtgttaactttgttaacacataatacataaagtgaatctactcatttactttatgtatttttaatttatggaaggaaggttgtaagaaagcacatatgagatagctttaaaaaatgaagtatttgaaagtgaattagtgtgacggagacaggtgtgttttacatttggatttctcaaaaaagaatcctatagtagggaagaatcagccttagaatgtctaaatttcctttctgtttgcgactgtcactgtaaaaattgatgcaggcaagaattacaaacggatgccaaaatccctgcttgaaaatttgccggagaacggaggactcatatagtctgaaaatatcatcttacagattgcttattaattacaaagggtgaaggatacagtcgagaagcctgttaccacagtaatgaagtgatcacagttaacgttatccatggaacaaacaaacattgcggtcctcctgataggacgagtataaggcataacctgaatctaactgtgagaaaacaaaaacccaaattgaaattctacaaaacgtagttgttagtacctcaaaaatgtcagtgtcatgaaggcaaagccttaggaatcattctagttgaaagggagattaaaagagaatgacagctaaatgcagtgcatgaccctggattagaacatggattaggacaaaggttgttattaaagacatggggatagttggtgaaatttttatcattgatatgatgggtaatatatcaatgttaattttcttgaacttgatcattgtatatcaaatcaagagataaggacagcatctcttatgaggtggacacgtaaggatttggtgaagggttatgatcatgcaactttcaaatggttcagaaaatacacacacacacacacgaaaggcaatgtggcagtttaaaaacttcatgaatctaaatgcaggttaaacgggggtttatcatactatttttgcaatttctgtagatttgaaaattttcaaaataaatattgaggcagaaagtgcaaatttagtttatgttattttattttcgagacagggtctcacttagtcgcccaggctggaatgccagggagcgatcttggctcactgtaccctccaccgcccgggctcaagcaatcctcccacctcaacctcctgagtagctgggaccacaggcacacaccactacgccaggctaatttttttattttttgtagagatagggtctcactatgttaccgaggctggtcttgaactcctgagctcaagtgatactcctgcctcatcctcgcaaagtgctgggatcacaggtgtgagcactttgcccctgattgccatttatagccacactacttggtgatgatccagccacactgatgtacatactgcttcacaaatcatatgcttattttccagagcaactttgggctttttattttttaactatctctttattttgtaccctgtgcccagcccaggaatgcacatttaattgggagaaggaaactgccatttacatggagctgcagtctagttcagtgatgggagggcagttttatgaacagctcaactgttcaagttaaggcttattatttatttttatttttcatccagtattatacattcaggtctttaactaacttgaatttttccttcaaaataaaataaaaagcatggggacatatttccttaaatgagtcctggccgcctaggaagaccacttgctgcgaagaagcaaaatatcgagtagagtaggaatgtttaaccgaagtgggtttcagcagaaattttagagttaaccagaactgaagagtgtcgagagttgtttccaacagatggcaaaaattgtatagtcactttaagactataaaactgagatattcaaatttcttataaaattagagttgtttaagaaatagcaaacaggccaggtgcgggggctcacacctgtaatctcagtacttgagagttcaaggcaggcaaatcgcttgagcctgagagtgtgagaccagcctggccaatagggcaaaaccgtctacaaaaaatacaaaaattagccgggtgtggtggtgggcgcctgtagtctcagctacatgggaggctcaggcagtagcattgcttgagcctgggaggtggacactgcagtgagctgagattgcaccactgcactgcagcctgagtgacaaagtgagactctgtctcaaaaaaaaaaaaaaataaatttaaaaaaagaaagaaatagcaaatggaaggctgggcacggtggctcacacctgtaatcctggcactttggaaggcaggtggatcacctgaggtcaggagttcaagaccagcctggccaacatggtaaaacccccgtctctactaaaattacaaaaaattagctgggcgtggtgggacatgcctgtaatcccagctactcaggaggctgaggcaggagaattgcttgaacccgggaggtggaggctgcagttacctgagattgcgccattgtactccagcctgggcaacaagagcgaaactccgtcaaagaagaaaaagaaatagcaaatggactggatgcagtggctcacacctgttatcccagtgcttcaggaggctagggcaggagaatcgcttcagccaaggggttggaggctgcagtgagctatgatcccgccactgaactccagcctgggcaagagtgagatcttgtttccaaaaacaaaagaaaaaggcaaatgaagacaattttaacttgtgtctgcagttgaataactcactgatcttaatttagattcagtttatgtagaaataagtaaactttaaaaatctgtcattccacggtttaacaaaagttcagctctctgcttgctgtagttgggcatcttctgtaaatcgcacgtgcctttcctttgcctgttgtggtttttaattgatctgtggaagttctagttatattctggacactaattctctggtgatttatgtatttgcaaataacttctagtttgtttttaactttgtgatgtctttcatcacatggaagttttaattgttttggaatttatctcatatgttcttcttagtcgtttatagttttgtttttttccattttttaatccaccttgaattcgagtattgtatgaggtaggcatcttaactccccctgcccttgattgccacttaatagccacactacttggtagtaatacagccacattgatatacgtactatttcactaatcatatgcttattttccagagcaatttggggctatttatttattttatttatttatttatttatttatttgagatggagtctctctctgtcacccaggctggagtgcaatggtgcgatcttggctcactgcaacctctgcctctcgggttcaagcgattctcctgtctcagcctcttgagtagctgggattacaggcgtgcaccaccacacgtggctaatttttgtatttttagtagacatagggttatttgccttgttggccaggctggttttgaactcctgacctcaagtgatccgcctgcctccacctcccaaagtgccgggattacaggcatgagccatggcaccttgcctgggctttttattttttaactatctctttatcagtagctgtgtcagtaccacacatgcttagtttaattctgcttaatgatatgttttgctttctagtataatacatctgtcttattattgttttcctaaattagctacttaaaaaaaatttttttgaacaaagatggggtcttgctatgttgcccaggctggtcttgatagcctgagctcaagtggtcctcctgcctcagccttccaaagtgctgggattacaggcatgagccactgtgcccagcctcttagctactattttattgtatctaatgtgtaaagtgatttactttttttccagttttattgtaaaagatacataacataaaatccgccatgttaaccatttttaaatggacagttgcgtgacatgaagtacattcatgtttttgtgcagccgtcaccaccattcatctctgaactttctcatcttccacgcttgaaactgcccattaaacaataattaattccccattcacccctcccctggctgctggcgacctccattctttctgcctctacgggtttaattgctctaggtgtctcgtacgagtggaaccccacacagtgtctgtcctttggtgactggctgtttcacgcagcgtagtgtcttgaaggtccatcgtgttctagcacgtgtccattccatttccttttttggccgcatactccattatgtgtgtgtatatatcttaatggatgactattataaaaaaaaaaccaagtgttggctgtcctctgaagcggtatctccgtactcaggatttgcacttccctaatgactagtaatgttgaacatgtgtttttgtttgtttgtgagacggagcctccctctgtcgcccaggctggagtgcagtggcgtgatctcggctcactgcaagctccgcctcccgggttcaagcaattcttctgtgtcagcctctcgagtagttggaattacaggtgcctgccaccactcccggctttttgtattttttggtagagacgggtttcaccgtgttggtcaggctggtctcaaactcttgacctcaagtgatccacctgcctcggcctcccaaaatgctgtgattacaggcatgagccactgtgcccggcctactgtcagttgttttatttgggttttttgtttgtttctttgtttgtttgttttgagacggaatctccctctgtcgtccaggctggagtgtagtggtgcaatgtcggctcactgcagcctccgcctcccgggttcaagctattctactgcctcagcctcccgagtagctgagactacaggtgcgtgccaccacgcctggctaatttttgtattcttagtatagacggggtttcaccatattggccaggctggtctcgaactcctgacctcatgatccgcctgcctcagcctcccaaagtgctgggattacaggcgtgagccaccgctcccagcttactttaattttttaaatgaaaatagtttgactctgcagtttccctgaaaaaaagtctcagatacctccagggtttcgtagattctactttaagacttgctgatctaggtctcagtttaagccagctgattatccttctactttttaaggagccttatatatgtctctcctgtgtataccattgtattgtcttgaatagatcctccttagtgactaaaataaatgagaattcagcatactgcatccctaattgttttggagttacatcactgttttttagtctctctgttgcagatttttcaaactgctggcctgcaggccataggaatcctgtgtgcatgttttttgtgacccatccaatgccactatttaagttggaagatttcatattaacatcttgattgctggattttctttttttttttctttttacttggataaatttatggggtgcaagggtaattttgttacatgtatagattgcacagtggcgaagtcagggctctttagggtatctgctacccaaataatgtacattgtacccatgaagtcatctctcaccatccacccctgccgcctctggattttcttgagaaagcaaaaaatatggcacggacaggcctgagtttcctggtagtcgtagtcagctggagttgagtagcagctgccccttgaaacagacagatgcgttctcttttttggatgttccctttttacactttataaaacagtgtcttgttttatagaataaaattctcatcagatttgttgaggatacatacccacatttaggttattttctgacccagaattatctttcaactccagggtgatgattttttctctttgtatagcttactgtttccctagtcctgcagatgtatttcaaatgtctgacgatccttggattagcttttaggtttgagaatgaggcccaggagaaaagctctgtgtatgtggaagggtattggtgatgggcagacgttgagttcaagccgatggaaacctggcctttgtgctttgccatccctaactgcccgatcgcagaggactttgctctgggtcaccacctattacattagctgctctggctctctctagatctgtttctttaaagaaatatgcgtgtgtgcacctgcacccatatccagggagaaatgccggtaagtcgaggattctgatttaacagcttataaatctcgagttctgttttcagtcccacggttactcactctggactctatgagcctctctctaggcaaataggaggcagattcccttctaattctacctcagctgtagtcttccctttcaaggatttcttttccttcatttctgctgtatcaattatctctatttcattgccttcccattttctagaaatttgttaaaaattttttaactggagccgggcacggtggctcacgcctgtagtcccagcactttgggaggctgaggtgagcagattgcccgacattaggagttcgaaaccagcctggccaacatggcaaaaaccggtctgtattaaaaatacaaaaattagctgggcatggttgggcatgcctgtgatcccagctactcaggacactgaggcacaataattgtttgaacccgggaggcggaggttgcagtgagctgagattgcaccactgcactccagcctgggtgacagagcaagactctgtctcaaaaaaaaaaaacatttttttttaatcagttaacctcctctgctaatttctgctgttgtaggattacagtttttaaaaattcctttactgttattttaatggagtttagaggaagggttaagtatatgcattcatatgccatttcaaacccaaaaccctaaacctctggcctcacaaaatggaattccaggccgggcgtggtggctcacacctgtaatcgcagcactttgggaggccaaggcgggtggatcacttgaggtcaggagctcgagaccagcctggccaatgtggtgaaaccctgactctaccaaaaatataaaaaattagctgggtgtggtggcgcatgcctgtaatcccagctgctcaggagaaggctgaggcaggagaatcgcttgaacctgggaggtggaggttgcagtgagccgagactgtgccactgcactccagcctgggcagcagagcaaggctctgtctcaaaaaaaataaataaaataaatctaaaataaataaataaaataaatgttaaaaatggaattccaaaaggagatattgctgcagttattaatagttgtatattttaatttttcgttttaatggaagaccaaagttaccataaaattgtgttgcctataatgttattttcttttttgatatgaaatagctgatgactatcagccagttcgtctgctcagtaaacctggggaactgagaagagaatatgaagaggaaataagcaaggtaggtgctaaatagtttttttttttggaatatttctctgctgtgtttttagtttcagattttaatttagttttttgtgcttatataactagtatatcttgaaatatggataattttttttttttgagatggagtctcactctgtcacccaggctggagtgcagtggcgcaatctcggctcactgcaacctccacctcccgggttcatgccattctcctgcctcagcctcccgagtagctgggactacaggcgcccgccactacgcctggctaatttttttgtatttttagtagagatggggtttcacagtgttcaccaggatggtctcgatctcctgaccttgtgatccgcccgcctcggcctcccaaagtgctgggattataggtgtgagccactgtgcctggccaaaatatggataattttaatgtactttataagggctttgttttttgctgtaatttacttctacataattaatgctcttatgtgatagtgttccctaagcatttacatatgaagaaaattttttaattcttctttttcctaatttaatccataccaggatatatttttatttccccaaagttttgagcttaaagtaaaagggtggtagagtgtgagtttagatgaggaaaggttaaagggctagctgtgaagttcctaaataggaaaagtacctaaaaagcagtgtttatagtgaagcattatgttttaattacatatgaagttatacataaatagagatttttctctttttttgttagtcttcaaaattttgtgtataattttcacttgtaatacatctcaggctaggtgtggaggctcacacctataatttcagtgctttgggaggctgagatgggacagctatcttgcaggaatctacttctccagatttgtacttcatttgagatcatttaaatttctgccaatttgttctttttctacttttctattcttgttatgaaatattgcaagtataccaaaacgttcagagaaggattgctctttattaatcacttttaaggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattgtaagttttaggagggaacgctaaggtatggtcatcccttggtatgcgctgctgcagaacccgctcatgggaagagtcagctccttgtatttccaggttctgcatcccacaaatattgtcttttccaccccaggctggttggatttgagtgtttggaacctgctgatacggaaagctaactattaacattccgattgctttgactgtggttttcaaagaacagaagagatggcgttgccataattagaagctattgataacatttttgctttacttaaagtaaaattgttttgcatattgttacatatttgctctaatccaggtttttggggttttttgttttttgagacaggtcttactctgtcatgcaggttggagtgcagtggcacaatcacgactcactgcagcctcgacggccgggctccggtgatccttccaacctcccgagtagctgggactacaggctggcactaccatgcctggctacttttttgtggagacagggctttgccatgtttcctgaactggtgtcgagctcctgggctcaagccgtccatctgcctcggcgtctcaaagtgctgggtttgtggcgtgagccaccgcaagttgtttaacaacttttttatatgtaggaaagctattcagtgaagaatgaaagcttcctttttccttcttccacctctccactcccgttccttttccatttatatcagtctctatccccaaaggtaaccactattaacagtttcttacaacttttttcttgccagggtgcgatggctcgggcctgtaatcccagtacattgggaagctgaggcgagaggatcgcttgagcccaggagtttgagaccagcctgggcaacaaagtgagaccctgtttcttcagaaaaattaataatgagccgagtgtgatggtgcgtgcctggagctccacctgctgggaggggctgaggcaggaggatcccttgagcccaggagtttgaggttacagtgagctgatctcgccactgcacttcaacctggaagaccatctcaaaaaaaaaagctttttttctttattgacctaaaaaggattatataaagcaatcacactgttttgctgcttacattttttccacttgataacatcgtagagatttttcatattactacatgtagtcaatctaattcttttaaagagtggaataatattccattttatggatgtaaatcacattttgaaagtaaggcacattaaatttttagataatgtattaaacttggatgttctgcttcctgtagttaaattgctgcctgtaagaaaatgaattaaatggtgtgtgataaaacacatactttaagatcagagggtactgtggggcccagtggtttgaacgagcctggcagagtaacctgggaatgctgttgaaatacaaactctcatatttactccaaatctattaagtcagagtctctagggatgggacctagggaatacaatcttcagaggcatgtagggaagtgtgaaacattcaggtttgagagcctgtgaaaacaattcttcagctttcaaacaacgaatatcttaacatacacttaccattgaatcatgggaagttcaatagaataaaaaaatatatatgtatatacacttagcaaaatgagtatacgcagaattgggaatttttttcttttttgagaggcctaccattaataataatgtacccaaattttgggttatatgcccctttttatgtgtcttttttaagtagaatcgctttagaaatacacaatcaggaaactaaataaaagtcattgaccaatggaataataaatggaatagggaagaagtatatctagttttcccatggtattataagagtagatttattgatactgtagaataatttttttaactttttttttttttgagacaagagtctcactctgtcacccaggctggagtgcagtagtgcaacctcaactcccggttcaagcgatgctcctgcctcagcctccagagtatctgggattacaggtgccgccaccacatcctgttaatttttgtatttttagtgccgatggggtttcaccatgttggccaggctggtcttgaactcctggcctcatgtgatccacccacctcagcctcccaaagtgctgggattacaggcatgaaccaccatgcccaacctagaataattttctatttatttatgaaagtttggtggtttaaggccaaatattcaccatcaccatatatgaacttttccattagggtagtaagaaacttacgagactggtacagcaagtaaatatttgtgatttttattaatacgcccttaaagtccagaactaaaatattattacataaaactattcttttgggtatatccacagctctctgaatatgtccatatagataaaagtaattatataaaagtatttattagaaaaatcaacaggctgggcacagtggcacagacctataatccgaacactttggaaggctgtggtgggggaatcacttgattccaatagttggagaccagcctgggcaacatagtgagacctcatctttacaaagcatttaaaaaaaagtagctgggcatggtggcacatgcctgtgtcctagctactcgagaagctaagatgggaggattgcctgagcccaggaggttgaggctacagtgagctatgatcactccactgcagtccagcctggatgacagagcaagactctgtctcaaaataaaacaaaaacaacccacctaaccaagcctggtggctcatgcctgtagtcctagctacttgggaggtgaaggtgggaggatcacttgaacctgggaggtcaaggttgcaaggagccatgattgctacactgcactccagcctcggcgacagagtgagaccctgtcttaaaaaaaaaaaaaaaaaaaaaaaaaaggccgggcgcggtgcctcatgcctgtaatcccagcactttgggaggccgaggcaggcagatcatgaggtcaggaaatcgagaccatcctggctaacacagtgaaaccccatctctactaaaaaaaatacaaaaaattagccgggcatggtggagggcgccggtagtcccagctactcaggaggctgaggcaggagaatggcatgaacctgcgggggtggagcttgcagtgagccgagatcgcgccactgcactccagcctgggcaacagagcgagactgcgtctcaaaaaaaaaaaaaaaaaggaaagaaagatcaacaggaattatcagctaatgaggttagtattatgccttattttgtgcttgatgtacagtaaaaatgtaattaatttagaccaacttggatgaacatagtttattctgatttttgcatggtcaatattcttcaagagatgtacagaatttaaatataactataatttctgaaaaatgctatggatttctgaattagtcaaattaatagcttattttatcataaagttctctctcataatgtctgttatgctttttctattgttgaagaacaatttctgtgagggaagtatctcggcttctcccttgaattccagaaaatctgatccagttacacccaagtctgaaaagaaaagtaagaacaaacaaagaaacactggagatattcagaagtaagtgaacatgactatgaattatttgttgacctcctactgtatgccagtgttttctgttcatatagactactactgattctcaaagtttggtccgtgaactttgtatgaaaatagtctgaggttgaggtaaattgaaaaggagagagctactcacacagcttcctcttggcttctcactcagccacttactgtggcagattcatacttttatcttactgcctcaggatttccagttttctcaaagtgaaccattggattcctctttctcttggtttaaattcagatgaaaaaaatgggtcccagataggcttatcttcactgaaagagtttacaatttgtcatttcttctctattacacaaaatgcatgagtcaggtagacaaaggtggcgtgattgagtttcaccacaacacccctccagggtcaggtgccaggtggagttggtggctttacgcaaacatcagctttcccatggtaactcacagttggaaaagtttaaaaaccacagtctagacttgaaaaatacataaggacttctggttcaactgaggaaatatgtgcaggtaactcatctccttccaagatttgttgaaattttgtatttgaggtgggaggaagcttaggagaagagaatgttaaatgagggaggtactattaaaaaaaaaaaaagatgtgacaatatcagtgtcgccagtactcataatgtgcaaagtaaaaatgagaaaaccgctaaaatgcagaagtatttcatattgatacaatatgctgtttaaggctataactcatgaatctttatatatctaaatatatactttgaaatacataaaaataaaaaattaccagagatacaagaaaaactaaggatttaaaagcaaaaattgagaaactgatggattaaagttgtaacaatattaaaaacagataaagtctgttttctagaatatatgaaaactcttataactcaacaacagaagacaaataattaaaaactggacaaagggacttgagtagacatttttcccatgatgtacaagtggccaataagtacacgaaaatatgtttaacatcattagttattagggaaatgcatatcaaaaccacagtgatatagcatttcatacccattaggatggctataatccacaaaaagggaaaataataagtgttgacaaagatgtggagaaattggaatccttgcgcattgcttggtaggaatgtaaagtggtatcgtggctgcagaaaacagttggtgattccttgaaaagttaaacggaattagcatatgacccagcaattccactcctaggtatgtacccaaaagaattgaaagcaggtattcaaacaaatacttgtacatgaatatttgtgtcaacattattcaaataaccgaaaggtagaaacaacccaaatgtccattaacaaatgaatgggtaaacaaaatgtggcattccattttatgtgaattacacctcaattcaaaagtttaaaaatgaataacaggattatatagttttaaaattaagaaaaatttctaaacaacttgttgattaaagagtaaattttgttggaaatacagaactgaaaatatgcatgaaaactggtatgtggctaaagtggtatttagaaggctttacgtgccgtatcagaaaagaagaaagggcagccaggtgttgtggcacgtacctgtaatcccagctacatgggaggctgaggcaggaggattgcttaagcccagggagtttgagtttgggaccagcttggacagcatagcaagatcctgtctctaaaaaaaaaaaaaaaaaaaagccagggacagtggctcatgcctataatcccagcactttgggaggctgaggtctgaggtggtaggattgcttgaggccaggaggagttcaagaccagcctgggcaacatagtaagaccctgtctctacacaaaataaaaaaattagccaaatgcagtggcacatgcctgtaaccccagccacttgggaggctgaggtgggagaattgcttgagcccaagaggtcgaagctgcagtgagctatgatcatatctcaaaaaaaaaaaaaaaaaaaaaaaaaaacgcagctgaaaacgtatttaaaaagacaattccaggaatacattgctggtttaatggtagaaaatgaatcactgtaagttattcaattagctgtataaatatgaaatacacgagatgataattcttaatgaagtggtaacagaaagaaactttcttaacctgttgaaggatatctaccaaaatcttacatcacatatcatacttcatagtggaacatcgaaattatttcctttttttttttttccagacagtctttcttgccctgtcacccaggctagagcgcagtggtgcgatcatggcccactgcaacctcaaactcctgggtacaagtgatcctcccgcctgggcctcccaaggtgcctggattacaggagtgagccgccacgccccgccattccccttgtaaggtcaggaatacgcaagggtggcctgctactctccacctgcattcagactcatgctggagagtttagtctgcacagtaacacaataaaaggagataaaacatatcagcctggaaaggaaggaaaaagcagctatcattcttcagaggcggtataattatctatgtagaaaacccaaaaagtcagaggtacatttttagaatgaagagtttagcaaggttgccagatataaaatctgtacaaaaagtcaattgtaaaatgtaactttaaaaatactctgtcgatagtagtatcagaaaataaaagtacttaaaaataaatgtgttaaaatctgaggcaagcatggtggctcatgcctataatcccagcacttcgggagactgaggcgagaggattgcttgagcccaggagttcaagacgagcccgagctgcacagggagaccctatctcttaaaaaaaaattaaaaaattaaccaggcatgatgatgcacacctgtagtcccagctgctcaggtggctgaggcaggaggatcacttgagcctgggaggttacggctgcagtgagctgtgattttaccactgcactccagcctgggcaacagacaagaccatgtctcagaaaaataaaaatctgtacgacccgtggagaaaattgtattatattaaatatacaatattcatgggttagaagatgcctaatactacaaaatggtcagatctcctcagactgatctatagagtcagtgcaattcgaatcagaattccaacttttcaaatttttcttttgagacggagtctcgctcagaatcacacaatactaatcaataaagtgtttagagatgcaaaagtgtggcaaatctgttttaaaaagtaagatataagaaactcaggatagtatgaggtgggagatgacgaggccccataggagactttcaaaccaatgatttcttttcccttcaaccaagtaataagcatatgggctttcatggtaatacagatttttaaactttttagaagaataacacatttttttgttttgtttttaatggaccacagagcagcaaacatatattttaaagtgcaccagtcttcggcaccataagacagggtaaaaaagaaaaagtaaaaaatttaaaaagacggtgcaccaatcctaagtatactttctggtgaatttttgtgtgtgtataaaccacccaccagatgaagacggaatatttacaaaggtttgcttgtgccctttccctttccagtcagtgtccccctccccgtgaccgtgctgtactgtgattcttacatgtattgtatgactgttctctcataaactttgttttcatgaggcagacttggaaagatcttaagacattagtgaaaaaagcaaatcacaagccgggcgcagtagcttatgcgtgtaatcctagcactttgggagggtgaggcaggcagatcacttgaggtcaggagttcaaaaccagcctggccaacatggtgaaaccccgtttctactaaaaatacaaaaaaattagccaggcgtggtggcggacgcctgtaatcccgctactggggaggctgagccaggagaattgcttgaacctgggaggcggaggttgcagtgagccgaggtcacaccactgcactccagcctgggcgatagtccgtctcaaaaaaaaaagcgtgaggctgggtgtgttggctcatacctgcaatcccagcactttgggaggccaaggcaggtggatcacttgagcctaggagtttgagaccagcctgggcaacatgcggaaaccctgtctctacaaaaaataacaaaaattagccgggcgtggtgtgcctgtggtctcagatgtttgggaggctgaggtggcaggatcacgtgaacctgggaggtcaaggctgccgtgagctatgatggtgctactgcacttcagccttggtgacagcaagaccctgccttaaaaaataatgaagccaggcacggtggctcacacctgtaatcccagcactttgggaggccgaggcgggtggatcacctgaggtcaggagttcaagaccagcctggccaacatggcgaaaccccatctctactaaaaatacaaaaattagccgggtgtggtggcgagcacctgtaatcccagctactcgggaggctgaggcagagagaattgcttaaaactcaggaggtggaggttgcagtgagctgagactgcaccactgcactccaacctgggcaatagagtgagacgccgtctcaaaaaaaaataaataaaataatggccaggtgcggtggctcacacctgtaatcctaacactttgggaagccgaggtgggtggatcacctgaggtcaggagttcaagaccagcctggctgtcctgtctctaccaaaaatacaatacttctgaggtcaggcattcgagatcagcctgtctctaccaaaaatacaaaaattcgctgggcatggtggtgcatgcctgtaatcccagctacttgggaggctgaggcaggagagttgcttaaacccgggaggcagaggttgcagtgagcagagattgtgccattgtacttcagtctgggcgatagagtgagactctgtcccccaaaaaataaaataactaaaataaacaaaatcaaaaagagtgtgtatttcatagaaatcatatttttaaaaaattggttacatatgttaaaaggagaaccttagacaaattaacagagtttaattgagcaaaggacaattcacaaattgggcagcctctcgagccagagtaggccgagagcgactcccgtggagccacatgtcggaagaagattaacagacagaaaagggaacgtgatgtatggaaagcagaaatgaggggcagagacagccagagtggttacagtttggcatttgccttatttgaacatgatttgaacagttggccccctttggccaaagcttggtgactggcacaagagtagtttacaggctgttcacacctccctttaggctgtagttcactatatacagagaaatctttgggctgaacttaaaatacgtaaggaggcagctttaggctaaacttaatttaaaacataaaaggaagcaaatgggaatggatcccaaaaattcagactcaaggaaaaaagaaaaaaaaaagttcttaaaacatgggaagggaaagggttgatgacatatatttcctgtatttctgttttgtttaagagacagggtctcactgttacccaggccacagtggcaagaaaatagctcactgcagcctcaaactcttgggctcaagcgatcctcccacctcagccttcagagtagctgggactataggcacacaccattatgtccagctaatttttctttttaattttttgtagagatgggtcttgctgtgttgtccagttttcggactcctggcctcaaacgatcctcccacctcagcctcccaaagtgttagaattacaggcatgaaccaccacggccagttctgcttattttcagaatgagcatgtattcatatattacttggttattataaataaggaatatccaagagagttaatgaatcttcagtgattgtgttggataagtaataacattctgttctctgcttatgaacgtcaaaacaactgttataacagtgatactttggtactggtatgcttcgtaagtagtggtcccgcatcagcattgacagaaagaattcttcagcctaaagaaactaaatgagactaagcttcttttcaactgaaaatttggttcttgttcttcaaagttaacagagtaaatatatagattgatataactaaatatatgggttaggtactcttgtttgcccataaggaatattcattagttctttatatgagatctttgtttaggtttgattgttccatatgctacttgttggtgcttttgacacagtgtaacttatggatttgtctgttatttatagtcactttttttctctaattctaaaagccatggctagctgctctttgaaaatcacccaaagtttccaccatttggagacaaccaacattttgggaaatttctgccatttgtaaacatagttatatgcatgtttggatattttacaatttttaaactatacctaccatcttgtagcctgccttttctattccccgttcttttataacattttccattctattaaaaccgtagtgttttcagtggcaaacagcctgttatattgaagattcttagaaatgtaaagatatgaccaggtgcagtggctcacgcctgtaatcccaacacttagggaggccgaggcaggcggatcacctgaggtcaagagattgagaccatccaggccaacgtggtgaaaccctgtctctattaaaaatacaaaaattagcagggcatggtggcgtgtgcctgtagtcccagctactcaggaggctgaggcaggagaatcacttgaacccgggaggcggaggttgcagtgagccaagatcatgtcacggcactccagcctggcgacagagtgagactctgtctcaaaaaaaaagaaagaaatgtaaagatatgtgtttctaagaagagagttgagggccaggcacggtggctcacgcatgttatcccagcactttgggaggccgaagcaggcggatcacctgaggtcaggacttcgagaccagcctggccaacatggtgaaaccccgtctctactaaaaatacaaaaattagctggacgtggtggcacatgcctgtaatcccaactactcaggaggctgaggcaggagaatcacttgaacctgggaggcggggttgcagtgagccgagattgcaccaatgcactccagcctgggtgacagagcaagactccgtctcagaaaaaaaaaaaaaagaagagagttgatataaaagtatgtatgataacatctctataccagaatagtaaggaatttaatcatggactttttcccaatagtagagatttaaaatgtcgtgaacagccaacatttccagcataaagaagaaactaacatatcctttctcctagtttaaagcatcattttcattacttttgggaagactatagagtcttgcattgttttgatgctatctgcttttttaagcttttttcaagaattaagaaatatttacgctgggcgcagtggctcacggctgtaatcccagcactttgggaggctgagacaggcggatcacctgagcgtcaggagttcgagaccagcctgaccaacatggtgaaacccgtctctactaaaaatacaaaaattagccgggcgtggtggcgggcgcctgtaatcccagctactcaggaggctaaggcagaaaaatcgcttaaacccgggaggcggaggttgcagtgagctgagatcgcgccactgcactccagcctgggcgacagagggagactccgtctcaaaaaaaagaaaagaaaaaaaaatatttagccgggctcagtggctcacgcctgtaatcccagcactttgggaggccaaggcaggcggatcacgaggtcaggagatcgagaccatcctggctaacacggtgaaacctcgtctctactaaaaatacaaaatattagccgggcgtggtggtgggcgcctgtagtcccagctacttgggaggctgaggcaggagaatggcgtgaactcgggaggcggagcttgcagtgagcggagatcacaccactgcactccagcctgggtgacagagcgagactctatctcaaaaaaaaaaaaaaaagaaaaaatatttagatttgacttttacttccttttctgtttttcactaaaatatcaatactcaatcatttaagttttgtcctggaattgaccaaaatatctgaagcacggaaatgagatacactctgataaaacagccaagcagcaaaccagacaaccttcggtataaatagctttattatgttgggtacataccatctgtctttgaaagcattgaaactttggtaaacttttcttttaggtatttgacaccgaaatctcagtttgggtcagcctcacactctgaagctgtacaagaagtcaggaaagactccgtatctaaggtatgttgatactgaagatgttctgagttttgctggttcattaatgctgtagattagtgctatccatagttttctaccttttaacaaaagcccctatagttaatcaaacaccctgtctgagtcctcttaggctcacctagagaaaaagcactttttctccaaaggaaactacaattttttaaataaacatactacaaaaagcaaagtttttctctaagagagtgaatattttcgcctttgcagttagtgtgatctgtgtcacagcttctcagctacgctggtgtagtgtgaaagcatctatagataatatgtaaacacatcagcttgaatgcattccagtaaaactttgtttacaaaaacaggcaggaggctggatttggtccatgagccatagattactgatccttgacctatgtaatccaaactcacaaaactgaataggttatacctggcaccagcttcacttagaatgttacaagatggagctgaatgcggtggctcacgcctgtaatcccagcactttgggagactgaggcaggtggattatctgaggtcaggggttcgagatcagcctgaccaacatggagaaaccccatctctacaaaaaaatacaaaattagccgggtgtggtggcgcatgcctgtaatcccagctacttgggaggctgaggcaggagaattgcttgaacccgggaggtagaggttgcggtgagctgagatcgtgccgttgccctccagcctggacaacaagagtgaaactctgtttcaaaaaaaaaaaaaaaaagaatattacaagatgggaggccaagcacggtggctcaggcctgtaatcctagcactttgagaggctgaggcaggcagaaagttgggagttcgagaccagcctggccaatgtggtgaaaccccatctctactaaaaataccaaaaaaaaaaaaaaaattagccaggtgtggcacatacctgtagtccctgctactcaggaggctgaggcaggagtattgcttgaacccggaaggcggaggttgcagtgagctgagatgtcgccattgcactccagcctggatgacagagtgagactccacctcaaaaaaaaaaaaaaaaaaaaattgcaagatgagaaaaagtatgctagtaaggcagcatcaggcatgtgtgttcagcaggagtcctcagcagcagagctccaaggtgatagcctggaaaaaggccacacaagtgagtgtattaactactttgagaccacatgccctgtaagggtcaattatttcttataacaaacaatgggtctagcttccaggggtcttggtgagaaatacacccagtcaagttacttatagaagtaacttatagaagtcccaagctttatcttccaaacactaggtattttttttttgcttgtttgttttgttttgtttattttttgagagagaatccatcgtccaggctggagtacagtggatgctcggtgcatcctcagcttccctggtagctgggactacaggcttatacccccacgcccggctaatttttgtatttttagtagagatggggtttcatcatgttggccaggctggtctcaaactcctgacctcaggtgagctgtccgcctcagcctccggaagtgctgtgattacaggcatgagccaccgtgcccagccatgttacagatatctttaaatatcatttatacttatctctacattggtattagactgcagttgtgccttgtggcaaaacagagagtgggtgtactacatcaggggtgacacagataattgggtattatgagttattagactggctggtagatcctattatttactgtattatagatgcacattattacctcacatttttttgaaccttttaatgattgtgtttacaacataaattgttccttttgtaaagctactgtatatcttaattttttagttaaaaacattattctcagaagtggtctgtaagcttcacctaaatgccaaaaggagggtccacggtagagaaaagagttaaaaacccctatgctggcagacctttgtaaggtgaaagaaggtcaggtcctgataccagctattggccatatttggaatctagtctgtgggttttaatctgtaggttttcatgggagtgaaaatgaagtaatagcttaatctaaatttgcccatgaaataaaaatactattaagaataaatatacacctatttgggaggctgaggcaggagaatcacttgaacctgggaggtgaaggttgcagtgagctgagaccgcgccactgcactccagcctgggcgacagagcaagactctgaaaaaaaaagaaaagaaagaaagaaatatataccttattagtaataataatgtatagtgacagtccagctgtagtatcagtgtaattagacttacatcttatgatttgatattttcccctggttcactcagtctttttctgttttctacaggacattgacagtagtgataggaaaagcccaacagggcaagacacagaaatagaagatatgccgacactttctccacagatatcccttggagttggagaacaaggtgcagattcttcaatagagtcccctatgccatggttatgtgcctgtggtgccgaatggtaccatgaaggaaacgtcaaaacaagaccaagcaatcatgggaaagagttatgtgtcttaagtcacgagcgacctaaaaccagagttccctactcgaaagaaactgcagttatgccttgtggcagaacagaaagtgggtgcgcccccacatcaggggtgacacagacaaatggaaacaacacaggtgagacagaaaatgaagagtcgtgcctactgatcagtaaggagatttccaaaagaaaaaaccaagaatcttcctttgaagcagtcaaggatccatgcttttctgcaaaaagaagaaaagtgtcccccgaatcttccccagatcaagaggaaacagaaataaactttacccaaaaactgatagatttggagcatctactgtttgagagacataaacaagaagaacaggacaggttattggcattacaacttcagaaggaggtggataaagagcaaatggtgccaaaccggcaaaaaggatccccagatgagtatcacttacgcgctacatcctcccctccagacaaagtgctaaatggacagaggaagaatcccaaagatgggaacttcaaaaggcaaactcacacaaagcatccaacaccagagagaggctcaagggacaaaaataggcaagtgtctttaaagatgcagttgaagcagtcagttaatagaagaaagatgccaaattctactagagatcactgtaaggtatccaaaagtgctcactccctacagcctagcatttcacagaaaagtgtttttcagatgtttcagagatgcacaaagtaaggcctggtaaagggagtgctttgtgatctagtaaagctggaatgtgaagctctttcctatcatggaatcttcatccatgtgtcattcatgctgctctctaggcacactcattgtccttaatgaaggtctgtgtgattgtaaggactgcatagacacatgagcttctgcacagctcagcggtaagcaggggtcccctgtcgtttcccttcttaataacagatgtgtattaagctttacaattcttagagatatcttaagctttggccaactccaggaaatcttcaagtgccattgtctttccaaaaactgcatgttttatggcctttgctcacctttttgtcgtgactggtaatcaaagcaagattatactattctgagtgattaaggaacccatgcagggtttaaaatccattttcttgctattgtccaatgtttacagagtactcaaaaggttttcctaaagtaatctaatttccatctccaatttaattcaattttcagcattgtagcatttcctttggtgtttgttttttttttttagacggagtttcaaaatttggattcatattcatatgtgggaaatcccagatttttttttttttttttttttttttttttttttggagacagagtcttgctctgtcacgcaggctggtgtgcaatggcgcgatctcagctcactgcaacctccgcctcccgagttcaagcgattcttctgcctcagcctcccgagtagctgggatcataggcatgtgccactacacccagctacccagctaatttttttttttttttgtacttttagtagagatgggatttcaccatgttggccaggctggtcttgaactcctgtcctcaggtgatccacctgcttcggcctcccagagtgctgggattataggcgtgagccaccacgcccggcctgtttcctttggtttaaagtggattcgaatcagtgttaaatcagaaaatcagggttttctaggaaattgggaattagttgccagaaaggaaactgaactatgcagaaggagttaagagctgggatgaggctggatggggtgactgacagtccagatcattgaaacagattgggtcgtcggaaactggtccagatgaggctggatggggtgactgacagtctggatcattgaaactgattaggtcgtcagaaacgggtccagacgaggatgaggctgaggctggatggggtgactgacagtctggatcattgaaactgattgggtggttggtcagaaacgggtccagatgaggatgaggctgaggctggatggggtgactgacagtctggatcattgaaactgattgggtggttggtcagaaacgggtccagatgaggatgaggctggatggggtgactgacagtctggatcattgaaactgattgggtcgtcagaaactggtccagatgaggctgggtggggtgactgacagtttggatcattgaaactgattgggtggtcagaaactggtccagatgaggatgtggctggatggggtgactgacagtctggatcattgaaactgattgggtggtcagaaactggtccagatgaggatgtggctggatggggtgactgacagtctggatcattgaaactgattgggtggtgagaaatgggtccagatgaggatgaggctggatggggtgactgacagtctggatcattgaaactgattgggtggtgagaaatgggtccagatgaggatgaggctggatggggtgactgacagtctggatcattgaaactggtccactatgacgcagcaggggcagtttggcagagcatcctcttcccttgtccttgtgaaagaacacaggaaacatttgggttttacagcttttcacaccctactatcaggcatcagaatcaaaattagttactaaattgggtgaatttttggaaacctgcatttctatgcatctgctattccagaaaaaaatgggaatgtattacaggagagttacctcacagtgtcttatgttgtggaacctgaaacataaccacgtgttttcttatatgatcatttgtgttgatactgcttttatttgagtttatgaacagaaatagaaagtatggtgcttgggttttgccctttcttactcctgaaagttaaatcagaagacactgatttcattttgtgaaatttagctcagagactattgatcttttgtttcattaatatgaacaactattagtaaaaaatagctttaacagcatttctgctgatatctagtaatctattcttttaatgtgaaaataagataaaatgtcctggagctaattctagcttaaatttgccagtatttctgtatgtcattaagtttttttcctctaaggttggtaatagaattttgttaatctttgcatacctgatggcatctatgtcaatgctgattgggtaattataaattctgtgctaatttaaaacttaatttgcctcttaaggtgattgtcctctgagtaatgattgtagttaaatgaagtatagcttgcaactatactatcacatgggtcgttaagtaaaaataaataaaccaaatttgtctgagacaggctaagatcaatcttctcatcaaaccaatttttctctaagagcaatttcactttcagttttagggtggacattcttgaatgcctcaaattaaacgttatctatttaatcttcctggaatagtctgtgaccaaaaaggagggtgtgatatatttaggtgtaaatatatcacatatatggtgtgatatatttgggatttatatattcagctcattctctgtgaagaagtcttcctgactaaaattggtttcaagataaactaatttctgttagtatttctactctgcctaccatgtatgcctttttgttagaaactaataaatgtatcagtcactagcaggtactggtcctttttcctctcatttttgtggaaaggatatgcaaacactgaatttctcagggagtactaaggctgtgcagaggctgagaatctgaaaaataaaatactaaaaataaaaa

SEQ ID NO: 644 - DNA, 16558 bp, Homo sapiens
agggggcggggctgggggctcggcccgccttgccctgaggcgctgggtgccttccagttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcaggtaaaggtaaggagagccacggagccgcggcaggattggggtggcccgtgtggagggcgactgtggcgcccggggcgtcctgccaggtgcgtcttctggacctgctccagaccatggatctggggagctcgcggtggacgttggggatggcgggccccggcgtccgggcgggagaggacctcacagatgaaagagaaacctgagcccctgggaggggaagcggcgagctggaaggatcccagggcttgcaactcgcccctgcgcgccgctcacctatttaagtacttggaatccattagacctcagtgtcctcagctgttaaatgggagaggggcggtggtaatcccgcttgatttgggacagtcctgttctttggaggtcaccgcgcttcctggttcttaggaggtgcacagacagcgcaggggcagccgcgtcccaccaggcttcgcggaggtgatgccaaagacaagagacaaagttttcccagggcttactgccttccaaggtccctgctaaatgtattaactcaaataatttctcaccaaatcagtgtcattgttttcccgaatttacacttgagaaagattaccttagatttttaggttcagcagccaggacaaaacttgacaaatatttggtgggcccaggttttttatatgaagtcttttccagcctgtgatcagcttccacagttttacaagagagagctttaggctctgaagtcagacgccctgggttggaattctggctccatcacttatgaactgtgtgatcttggacaagtgactcaaccttcctgttgctattttccctttctgtaaaacagggaaaatgtatagacattaagctactattctcacttatggaagacctcaagatatctaaagtatgcccatttacaccaatcctagagcttctgaataactaaaattcctttaccataatgaaacacattttctcaaggaggactattactgttgtgaggattaaataaaataaatgcaatgtaaagcagccagaaggactgaccatgtagtaagtgatcaataaatgttattgttattttttaaaatcaagtacagagcattaggttttttttttaatcaagtattagagcattaggggtttgaacagtaagttggctcactattcatattgtagaaatatacttccatgttgcatttctttaaatagtgagctcctgccagagccagtctcaaaaaatgagaagctgctgtacttgtctgagttagaaaacttaacagttcaacattgattggaaatcaagcatatgctgaaatttttatgttagttagaaaatataatttaatttacaaagctttggtttgtatgacattggggaaagtccatggcatgttaaactgaagctgttgacggaagtgaaaaccatattaatcaagtaatgcaaggttagaccgttctgatacctgcatttctttaacaagtgaattctgacctagtcgtactacaaaagtccaaacagatttttatggcattcactttacattacaggttaaatgttttattatgttccatatttaaaatagaacctatgccatctcactgtgacagatatttgagaataattggagttggattggtcaagactatggtgctgatagatggcctcaagaaaagtaacttgagacagctgccctccctatgatggcagccactatcaccactagtgatagcttcaaaagcatgggcatagaaaacatgaacaaaaagattaaaggaaaaacatggaggtggacattactcagcatttggccatgggactgacaagagtataaaatcttttatatgaacctattatattctgataaggttaagtggtgcctgttctctctgacgtgtaaatgttagagttggataatttcctgatataaggtcaagataagggaataaaagactgaattagtaaaaggaagttcagaatgggttcagaatggcatttaaaacatttacctgacattctccacagttggagattgcaggagggcaaattaggtgttttcctctcaattaatgtcagtaccctgttatattaggagagagagccaagaccttgataacccatctcccccaaccctcttggttctagaatatattaatattttgagaaatgctcaattatgcctgtttacacagaggtagcagttttgatggcaatgattatttcattatggacttaatcttgatgaaaataatccatgcaagacttaactgtttggttaaatacattgctggacatatttaatcagagagagctttctgattttgtacttctttctcttcctttcctacctcccactgcaccactcttaaaaaggctattaatagaattttttaatgttttagtttttgttgttgttatttctgttaaagcttaagggtggaataagtcaatttgagagtaaaatctgaattccatctgtttctgtagttctaggacctggtatataatagatgcttgataaatatttaatagtagtccttcttgagaaatggtgtttcattatggtaaaggaagttttagttattcagaagctctaggattggcgtaaatgggcatactttagatatcttgaggtcttccataagtgagaatggtagcttattgtctatacatttttccattttttattcactgtgttcctactgagtgctagacgtaaggagaattaatattgaacaagccagatttcctaccccccaaagattttacagttaaacgggagaagataacaagtgaataattacagtacagagttgctgtcagaaaatattggagggggaactaacccaggttcaggggaatccaggaaagataagtggaaattaggtaatgaaaatatgccacattataaaagggcctgtaagctatagtaaggagcttgaactttatactgatcagtatgaattactaagtcaagtaccttaaagttgcagattctcatctcttctaggtagctagctttctaggtaactttccgtgcactggatttgcccagtgataatgtttgcttatgataataataactttctgtttcacctttgatttctatcaaaaagttttgcataaatactcttatctgccaaccacaggaacctagcaggtgacctttgggtttaaagaatatgtttaatcatagtgatccctgtaatagataaattaaatctcttttacaagccttctgcaagaacttctgcttgtttgtggcatactcttgaataaagttattgaactggctatcaagttgacagcctcttgaatggaaattaggtatattcttgactgagagactttttgaatgagctcatcaacttttcatccgtggattggatctatacttattatatattttgcatcacttacatagatcctaaaagttatattgaattttctttgtatactttcccatgtttctacataattttagtatttataaattttaatggcttatatgctctaattagtggtatttaaatattggctacaaccttaatttatttctgtcactttaatttttagatcagttagttctgatctctggctagacaacagaataattagtgagactattttaaaggacctacatttctgaggcccattccagaacaaagccactgaattagactatttggcactgggccctaaaatctaacacctaaaagcagcgacaactagtacaaagcataaaaaggtgattctgatgtgtgcatccatagttgacaactgcagccttattcccatagagggtgatttcatttagattaggagatttcatttagatgttttcttgacctcctttccagcaatttgatggttctgtaatgggcaactttacccctaaaactcttttcttctttagccttttactgaagatgggaggaatagagatagaatagtgaaaagtaggaattatgctaagaaattggtgccctggcaccaaaagaagacaaagaccaagtaattcttgttttgagacaataacatatcaacaaaataagggcctactatgtgccaggcagtgttctaggtggtggagttatagtggtgaataagaaaaggacctctatgctattagttaggaatgaggtggtcaaagagtagaatcatacacctataaataagttattatattgtcagataatgataagcactatgaagaaaataacgatgtaatagtaacttaagaaggctttatgaaggataggaggtttaaactgaaattggcattacattgttattagtgatgctaagatttgggatctagccgtatcaaagaccacaagtcagcgataagctagcctgtttgagggacagaaagaaaaccagtgtagaatactgtagacaatgaggtatgatggtgttaaaaggaacctattcttattaagggcaattccaagccttttgacttgagaacttgggctcaattgccattttaatagtaaattgttaaaatgaggaatactgtgacaaattgagggaagccaggggaggcaagagattccctttaggcttgaagctttaagtaggcttctggatctgggatttttgagctcattgaaacaaagaggactggaggtaaatgtttgagagttaacagcatatctatatatgagatacaattgcttccccttcctcctgtcttctcttctactttctgtatgagtgattttaattgtaaaaaatatgtaattctcacctctggctatgggttattcatcttgggagcaattagaaaaaaactatgcccgggtcctactctcagagattatgattagttgatttggggtgagggtagctatcttttatagctctggtaggttattatattgtgaaaccagattcgagacccactggcctattgcctcaaactgtggtatttgctgatgctaatcttggtctccataacagagagaagtaatggaaggcctgtctgatgttgcttcttttgcaactaaacttaaaaacactctcatccagtaccatagcattgaagaagataagtggcgagttgctaagaaaacggtaaattagttcaattacttatatttggggtatatcttctatctaatgaattggttgatgacttttaaaattaaatggaacaatatggacaaagaccatactttggatggatatgcaagaaaaataattgagctaataaagttgatagtctaatgtcacacagaggaagaaatgcatcagtggtaatcctatactgctttcattagctctttggatattagacaagagaataggctcatggcaactagaacctaaagaatggcctcttaagtcagcaaataaaatgtatcattattaatttaagaaagtgtagtacttgagagtttggaatagtttcaggtatatcaaaaagcctatgaaggtagctagttagtattcctttttactaatgtgacttgcccaaactattacataggtgacttgagtgttgctagaactaattctagaacccaggacacttctagttaagtgctctagctattctgatattcagaattacttgggaaatgatgaggaaaaaatgtagggacaaattcatgttaacactgtcgtaataaatgtgaattgtttaattttttaaaagttatgaacaatgtcagaatgaaatagtgttcctagtgttagagtctgaatgcatcagtaatggtaaatagataagattggactaagatagtgccatcattgaatcttacagtgtttggatatcattaaatactactgaaaatattctttggaggtctgtaatttaagtacaatgtgaagaactttaggatacagaagaaattcaaatacaaatccttttatggtatagatgacttttatgtattctgaaaatgtactggttttattttaatgcaaagacaaattctatagacttataaaattatcagttttgtgtctagggttccacctatgcaattattaccatataatgtttttatttttctagaaagatgtaactgtttggagaaaaccctcagaagaatttaatggatatctgtaagtaactttttatagacttacacagctcttaagacatttcaaaacttatatccattgtcactaagtagtcattgctagtaagatttagctttttaagagttctttaactttttttttttttttttttttttttgagacagagtctcactctgtcacccaggctggagtgcggtggcacaatctcggctcgctgcaacctctgcctcccgggttcaagcgattcttctgcctcagcctcccgagtagctcggattacaggcacctgccactgtgcctggctaactttttttgtagtttttagtacagatggggtttcaccatcttggctaggctggtcttgagctcctgacatcccgccttggtttcccaaattgctgggattgcaggcatgagccaccacacctggcgatttttttttaactttccggaaagcaaattgggcttatgaattcagagccttaaaaatgtccgtgtcctttgtagactgagttggtggtgaggaggtcataaataatgatataaaatgactgctaaaatctgaatttcttagcattgtatacatgacccttctaatattctacatttactcagtgctgtagaacattttatcttaggaacttatcttgaagaatttatcagaaagataacagtgatttaagtacttgctcttctatcacagcattatttataatattaaaaattataaacctgaataatcaataggaggagacaattcagtaggaaacatttgtgatagaatatgctatagcctttaaaaaccacatttttgaagattatttaataacataagaaaataatatattgttttttaaagcttgtagagacaactgccttgcatacttggagtagaatgttcacatccttaagactcagccatttttcaaaataaaactgctggaccctgttagtatatacagaatgttctgaagtgtaatgccaaagataacatttccagaaagatgaattttacaatatttatgatgaggacagggaaattggagttggattaagcattgtaagcaagtatggaagttaattctttaaattagtaattcccagtgagggttgaaaatatcacgagtgtcaagggagctttatgcttggagatctgaaaagacttcatagagaactaatgtttgagctaacacttaagggaagaataagtatttcttaaggaatgaaagagttcatgttctaggcagaaggaattgcatatctactgcataaacacatatgagaaacactggttttttttttttcagagtcttaaagggatatgtgatcaaaagaggtaggacctgatgtgttgagttggacacaaagtgctgtaactgaggccgcagcacagaagtcaaaaagggcaaatgcatgtgaaagatttaatgatagcgatggtggtggcaatgataaccaacgtttattgagagccaaatattgttctaagtactttacatttaggaaatcgtcctgataaaaccatagtgactgataagttctgactatggaaatggggttaagagaagaagaagagccatagttgaatctaagattttctaatttgactagattaatttgttttacctccttctaccccaagttaaagaatacaagatgagagagcagatttatggtgggggagataatataagtttggcttgagttataaaatgattaaatagcttcacatgcttttttaaaaaaaaggtactgatagagctgaagctagtttcttatttcatctcctttctttcatctccagaagtaactgctgtcctgaagttatgtgtgttgttcctgtttcatactttgaccatatatttatatatccataaacaatgaaaagcattatttggtgtgttttttatattcatgtgtatgtctttgtatgtacatattttatttagtaatttgcctttttttattaaatattatgttctcaggatttagccatgttgtcatatgtaaatccattattttccctctatgtgaatataccacaatgtttttatctatgtttgtagattcacctattgatagatttttaggctgttgtcaatttttctctataaagtacaatgcgatagtaaacctcttggtatatatctctttgtgcacacgtgtaattttctttgggtcttagggatgtatatcttccaaccttactagacattaccaacttgctctctaaagtagcagtttcaggattctcatccccctccattcactacttacgagtttttaatctctgtcagtctgagaggtattaatcagattgttcttgttagtatttacttgattactagtgaagttgaaatcttttgtatatttcttgacatttcaggtcagtcttaccatgtcctttgcacatcttttctttggattttctttttctcattggtttataggagttattcatatatcctgtataataattctctgtttatatgtgttatactaccttctcccagtgtgtggctagttttaaaaaatgacttattttttcttgtgtggtatgcatgtttttaattttaattgatcttttgtattatttgtgtttttctgtgttttacatattcaagaaatccccctgtactctgaggtcacaaaaatggtatcttgtatatttttctcaaaattttaaagtttttccttttatgtgtttttttgtttgtttgtttgagacggagtttcgctgtgtcgccaggctggagtgcagtgacgcaatctcagctcactgcagcttccgactacctggttcaagctattctcctgcctcagcctccgaagcagctgggactataggcatgcgccaccacacccagctaatttttgtatttttagtagagacggggtttcaccatgttggccaggatggtctcaatctcctgacctcgtggtccgcccacctcggcctcccaaagtgctgggattacaggcatgagccaccgcgcctggcccattttacatgttttacacagatatttaatttatctggaattaattattatgagtggtagaaataggaatctaagttttattttctccataaggataactattgaatctaggcacaccatttatggaattgtacatttttccccactgataagtgatgctgcctttgaaatatgtcaagttctgacatatttatgagtcagttccttggtgttctgttctattggcctatttctctgttcctaataaaaagttttaaaaagtcagggtaaaaatattcatgtactagtatgtcagaggataactgaggaaagaatataaaaataagtggaaaccttatggcattctataaactgtttttggctatgttattacatgaagggactttattatcttcattatgacacgtagtatagccctcagttctcttattagatttgaggacgaagggtacatgctgataacagtaaccggtagaatgtaatttatcagaaaagttattgggatttattccctttagaaaaaaaaaaacccttcattattattattttttttttgagatggaatttcactcttgttgcccaggctggagtgcaatggcgtgatctcggctcacctcaacctccgcctcccaggttcaagcgattctcctgcctcagcctcccaagtagctgggattactggcaggagccaccatgcctggatagttttgtatttttagtacagactgggtttctgcatgttggtcaggctggtctgaaactccctacctcaggtgatctgcccaccttggcctcccaaagtgctgggattacaggcatgagccaccatgcctggcccacccttcactaatttttattcttttatttttattttttttttgagatggaatctcactccgtcacctaggctggagtgcagtggcatgatcttggctcactgcaacctccacctccggggttcaagtgattctcctgcctcagcctcccaactagctgggactacaggcgcatgccaccatgcctggctaatttttgtaattttagtagagacaggtttttgccacgttggccaggctggtcttgaactcctgacgtcaagtgatccactcacctcagcctcccagaatgctgggattacagacatgagccaccctacccggcctaatttttttccttactttcaaagttagctatgcactataagggtatgctgaaatttttttattgtaacagcggttgacttaaactttttttctccagctacaaagcccaaggtgttatagatgaccttgtctatagtataatagaccatatacgcccagggccttgtcgtttggattgggacagcttgatgacttctttggatattctggagaactttgaagaggtatctatttagaaacattactttagactgtgtgtatgtgcatgagggagggcatgagtgagccagagcatgtgagcatgagcatttgtacacacttatattcattgctttgagaatagcagtcacgacaaagatatcacaggggagtcccatgctgcctcttaaaaagtttgtgtttcctcatactaattaatgagtgttagactgagtttcttttccacagtacctatacccttgctgcttaaaactatattcagcatccttcattgtaaaactttagttaagattctgaaatctaaaattctgaaaacaccaccatcatatttaggtttctaggtgaatgtgtgcagcttttccattaatactaagccaacatcaatgaccaaagataaaaatgccaccttagatattctaaaattatatagccaaaatgacctgccctgtttctatttttattaattcattgcttaatgtttgaattttttacttaaaatgtttgatgttgcagtcaaagtatttgtggatttgatcttaaacactgaaacagtctacatccctaattccatttggaatgttatgtagaataagacaactgcatttaattagatatttggatactggataacttgtacctctgtattttgattatatatcttcttcatggccatccaatagcagtgagatttagaatagagatctagacctgtcagaatcagtgtaagaattattataattatgaaacattttaaataaatattagtttctttccagagataagtttatgatatatgaagctatgtatgtttcctatagtagtaacacttgtcttatctcttctttttcagaattgctgtgtgatgcgttacactactgctggtcagctttggaatataatttccccaagagaatttgttgatttctcctatactgtgggctataaagaagggcttttatcttgtggtaataatctcaacatgttatgctttttttcagtatggtttaaatatttgtgttttcttggctggatgtctctttccttgtgagatatattttcaactctgactctgtaatcactaacattttttgcaagtgctaaactctagggagtaaaatagcaatatcaaaagagttttgaaacccttctgataagtttttgttcccagttacacagtatcctctaggtcagaggtagcaaatgtggatcacatgactgcctctaagaaagggttctagtaaatggattttcttctaagccactctcagaaaacagtttcttggtcatacacagagaagtactagatttggtgtgtcttagaatattcttccttccttgagctgtgttgtatttttcttttcaagattaaaaatactgccattggaaggctcctgttttctaaaacgtacctataggtaaattaatattattttgtatatagtgtatacttaagttagcagttgtaagtaaacatctacttgtttattcttaactagccagtaccaaactataatatggtagtcgctgtggggaatagttacggtaccatggatttgatttttggcacctcaaggcctggatactacaaccaagatttgtagcttccaaggagtactaagatgatatgatgtcatgtattctgaaaggattaaaagtttccccattacctatctgccaacctcttgtcagaattctccttggtaagtctctttttcactctgccatggtcactttgggatttaattttcatctatatggataataataaatatttaaataagaattctggtaatattttaaaatgagagttttatgtcagttattgctattaatagtgctattttaaaaattgccttataggaataagtcttgactgggatgaaaagagaccagaatttgttcgaggatataaccatccctgtggttggttttgtgttccacttaaagacaacccaaaccagagtcttttgacaggatatattcagacagatctgcgtgggatgattcctcagtctgcggtagatacagccatggcaagcactttaaccaacttctatggtgatttacgaaaagctttatgagaggcaaaatacattcaaacttgtagtactacagatcaactctctcagctacatggcctgtaaaaatcattgattccacttttctgcatagccggtagaaaaatttgaaatgtttttggttcactagtacaatgtttggttttattcctaaagtaaatagctatctaagagagggcattttcacttttttttttttaaattttgagacaggctctcactctgttgcccatgctggagggcagtggtatgatcacagctcactgcagctttgatctgaccgctcaaggggttattctacctcagcctcctgaatagctgggaatacaggtgcacgccactatgcatggctaatttttgtttaattttttgtagagatgtggtcacactgtgttgcccaggctggtcttgaactcctggcctcaagtcattccccaccttagcctcccaaagtgttgggattataagcgtgagccaccatgcctggccccaatttaaaatgtggaattcagttggtgtccaagacttatcttgagactcttaaaagcatcagtctgtaactagaacaaatacagtcttagatttacccaagtgcctagatatcattttataatgattagaattgagtattgtgggtcccctaattctgtgggtgccttaagtgagaatttctaaatgattttcacattctaaatgactttgggttttgaactctccatctagtttacttctaaaatgggaacttgaggcaattcaggtatccaggcaaatctttgtatatatttttttgtgtacatgcacacatctcgaaatccatttccgtgtttaatgttagttgtttatgtgttagtattcctgtgtctactgttttgttgttgttaatatgggtaaagtgagccctgaaatacatgctaaacaagacatgaaatgcagaaaggtacatagtgtttcaagtgcatggtagtttgatctgtgttttactttattgtgttttcttgagtgtaaagaaagaataaatcaaagttcttcatacccattttgacaaagtggaacagtggagctgttttttgcttttgtttttatttattttttgccactggtgatgatagatttcaaaaaacaaaaggtggcagcagcacaatgttcatggtgaattatctcatagtatctagattgatcaagatctgacagaaggaatgcacaaaggattctatattcttaatgatttattaattaccaggatccttttctaaattgaatgtacttttgaattactaggtttcttctttttttttgttctgcaatagtgaaagaaaactcagtagtttagtttcagtttctcatggaaattggtaaatgttagttttgacttcatctattttttatttgtttttattagcgtagagtaggaagtctcatattctactgttctatctaggatggtgaaattccaaaggtgcctaacttgagtaagggatttgtgacaagatagtacacattactataagggctattatttcctgaactggatgtccctaaaagcaaataaactgcccactatctctactctagtgctctctttgtccttatcaacatatacctccaataagtaattacataattcaccgttaaacatggacccactctaggtaaaattaccctcatggaaacattttcactgtgagaatgatgaatttaaaaattatgtttgaatcacctaaaatgtatgtgcagcttctagatggccccttagatctgctgggctctagctgtgtactttaaaaaaacaaaaacagctttattgatatataatttacatattatgtaatttacccacttttaagtatctaattcagtgatgttttaatacatatgtagaactatgcagccatcagcacaatctggatttagaacgtttccatcattccaaaagattccttttgtcttttttgcagactcatacctaacacaaatctaaagtttatcactgttgccaggataattacagcaggttatgtttggtttcatttttaagagtggaggtgttcatgattctaagctcaggaatcttgtgatcatgtattaaatatgttatctcatactataatgataaaaaagcttaatgatgtgggttgggatggatattaacataaataattgagtccgctgcttctatagcaatgctgtaggatagaacaataatgtaagtgatatatgtaattaaaaaattctagaagccacattaaaaaataaaaataaacagctgaagttaattttaatattttatttaactcaatacatccaaaatgttatcattttaacatgtaattgatgtaaagatttattctgatagtttgtactatttcttgtactaattttttgaaatctggtatgcattttacaaatttgggcaagccacattttaagtgctcattagccacatgaggccagtggatactgtattgaatagcacagtcctatagcatatttattaatttgtcttgtagtaagatgaaatagacaataatacggaataatatcttaaatggaaatctttgttagtctctagagccttcattgcttgataaataggacatctaaactttagatataaatcagttgtcaatgagataaaattattgccagcaaatattttccttcaaagataagtaacttttgatatggcagttggtgaaatgaaagaatataatctgccttcttgttaaatggttgactattctgtagcttgtaggtagtacgtattagaaacttgtgtatgtgggaaatatttggcataatactgttttcagtatatagtagctattttttaaggaaattagtttcatacaagaaaaagattattataaaagtgatacttttgcatgaaatattagtttgtgttgataactcttagttaacccttaaagtttaaaacagtactcaaaaaaaaataatgagaatctagtattctgtagttaactaatctataagataaattgctaaagtactagggagcttgtaaatcttaaaaatctttttatttcagtgttcattcaggttggatatatttgaaattgtagatttctatctgtacaacatctcctagttaatagaatttttttccttcccctcccttctctctcctcctccttttctaaccaaagggcattttatcaacaatcatgctgaattcaattaatatctcaagctaaaaaactatgtaattgaggttgtatctggagaagatgggaaaacattgtataatttaagcccttaattgtctgttgagcttttagggctgagtaattgcctttcatacaaataaaagctttaactcttttctcaagagtgtaccaccgtccttagaatcaggtgttttaaatccagtttcttttaattaaatgggactgtagtgatccctaccctgtagagaaatcaacagaactagagaagctaagggcttgatcaggtttcccctagaacctgtgttgcctgcctgctgtatcttccatgtctttcttattcaacttctagaagtagagaaggttgggacttgagtgtagaagaaacatcagaataatttcaaaaaacaggaagttggaactataatttttaaattattgtattgtttttacggattttacatgtatagttaaatattaaaattcatctcttgcagttcaataaaagctatagtatagattttatttttaagaagtttatataattcttttgtgaaccaatatgtaaaactagaatatttattaaactaataatatgtattagtatcaataaaatatgtatttatttttaaattggtatgaaacaaaataaaaatttgtagacactcttaaaa

SEQ ID NO: 645 - DNA, 75065 bp, Homo sapiens
agttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtgagcggcgggggaaggcccggagaggctcgggcgtgggggccgggtctcgccgaggacccgccgacctcggccaccccacggctcgcggggcctgcgccggcccgacacaccccctcggccggcctaacgggtgcccggacccggggggcagcggcctgcgggccctcggggtgggctccgggccgggtgtcgcagcgcgggaccccgctctgcagtcggtccccgcgtgaacttgagctgtcggagcgcacccggctgcgcggggccctgctgtgtctgaaaagttggcgtgggacggggggtccgacaggcgtggcccctctctgggcttgaatgggggcgcttctccggccgggatctcccgtgggggtcccggggttgcaggaaacccgcgaatcaatgggacgggcgggaggaggatgggcaggatcgtggccggctgcgcctgacgtggcagcccagccagctcgggaggtggggcgggcgccgggagaggtcactcggctccccaccctgcccgtgcaagaccgggctctaggtgtggtgtagtggggtcgggtcagacctgtccttaagtgttgtgtgggcatcacccaagcccttgggtccaggatcacaccgctggggaggggcttgccgagaggtcgtcagtgattttcttggcgtaattaatgctgctttgggaaacgatctggtttttaagtgcctccatctaataatgggttctcttaaaactgcggcgcccggggaccgccgaggcctcctatgggctcctgcaattcgttgctccacgtcaccagtgagctggctggttccctgatcaagagtacagatttcatgcaggcactgctaggcggcagtgaaacgagtctttcccagataatagttttggacttttacatttcgttaattttaaaggtataataattgagagtttttaacttatttttttttttttggaggcagggtctcgctctgtcacccaggcttgagtgcagtgtgtgatcactgctcactgcagcctctacctcccctggctcaggtaatcctcctgcctcagactcctgaatagctgggactccatgcgtgcaccaccatgcctggctaacttttttttttttttttttttttgctattttttgtagacacaaggtttcaccatgttgcccaggctttaactttcttaaaaatcccttaaacttatttttgatgctcggcaaaataatttttgttgaactcaagaacttaattttttcagaggcagtaaaagatgatcctgaattatctgggtgcagagactctatttacctgatttatttctaaaaattttggcgtctaaagtcacacttacatctctgaatctgctgtctgcaggcctcgcctgtctccttggaacataactgagatccgggaagtaagcaaaaccaaaaagacctttgaacagttaagatgggtgttacaaagtccatgtgccagtgtgtttgacttggaggttatctctcagttgatacatagttctgagaggttcaactgtatgatttccagtgacagcaaataactgctgcagtttgggtaagtgatgtttaggcacttgctgtatatcaagtagtcagccgagtgctttatatggcttatcccaggtagtcattaaaataaccttaggagggccggccgcgatggctcatgcctgtaatcacagcactttgggaggccgaggcaggtggatcacctgaggtcaggagttcaagaccagcctcaacatggagaaaccccgtctctactaaaaatacaaaattagccgggcgtggtggtgcatgcctgtaatcccagctactcggtaggctgaggcaggagaattgcttgaacctgggaggcggagattgcggtgagctgagatcgcgccattgcactccagcctgggcaacgagagcgaaaccgtctctaaataaataaataaataaataaataaataaataaataaataaataaataaacgaccttaggaggtaggtgctattgttcccattctgtggaggtgggatctgagtcttagggagtggaataaattagtgatagagccaggattgaagcacaattagtaactcaaaggattggatagatgaatgtctaagggagcctaaataaacatttgataccaaaccacgatgtttagatccttttttgttacactcagatgatgttagtttttttgtttgtttgtttgtttgtttgtttaaaacagtgggaccgatgtctcactctgtcccccaggctggagtgcaatggctgtgtcacggctcactacagccccaaactcctgggctcaagcgatcctccctcctcagcctcctgagttgctgggtacaggtgtgagccacagtgcccggcgatgttacttttaatctttagttttgcttcaaaatctttgtgtgagtctcttcattttcttccatatgtttttcagaatcccctcctctggcaaatcattaagccttgaagtgtgctgtctcctaaacttttatccaaactaagatatttgggagaatttagtgcaacttcagaataatgatttttttttctttctttttttttttttttgagatgaacttttgatcttgtgtcccaggctggagcgcaatggtgtgatctcggctcactgcaacctctgcctcccgggttcaagcgattctcctcagcctcctgattagctgggactacaggcgcttgccaccacgctcggctaatttttgtatttttagtagagacagagtttcaccatgttggccaggctggtctcggtctcctgacctcatgatccgcccgcttcggcctcacaaagtgctgggattacaggcgtaagccactgcgcctggccgtttgttttttactattcactgttttcatttgagagattcaggagcatataaggaaaatatgaaatacttcagctaaaatgctaacgaaggaagtgaaatagatgagttaacttcgtgtgtgtgtgtttgccaagtattcccgggacattattaaattgttcttgttctcagacttaggatgatttctgtcctggtttgtgtgttttcctgattttaagtaaatcacccagatcatttattcagaattaaatgctaactttgacaagctgctttatttttccatactaaattataaaagttgtttagagtcttttgaaagagtaagaatttgatatgagtttctcaaatgactggaataggagaaacgtgcatccagattgtgtttctcattttgaaaatactcataccaaggttcatttttaggattttagcactgattttgaaaatgctgttttagtctcggaaccatggtgctttttaccccataaggatcagggatgaggctgactcgtgtggaagctggagattctgtgttcctcataggcagattccagaacagctgcctttaaggaccgttttaaagtgggggcagtgagttgatcatgtttgaggctgcattctcttgtggctgtatctgctgttgtcattacagaagggtgtcaacatggaatgtgagtttctcctattctgaattatcattgcagctcgatccacggtatgctcaagttgtcactttatttttgtcctaaacactgacctacataacctcggaagaacaagcggtggttttagatgaagggcttcctattcaaattttcctgtaggccaatggttattagtgctgtatctactgtagtgctgtgtctattagtagtgtgtattactgtagctagttatcagtagtgtgtatctactgtagctagaggagtctttctgagatccacgaccccgggccttccccctctagtctgtctccttccctccttcccctgttgcttagattgttgttagctgttatgtaggttgtaaacttttcatcctaccaaaccccatactggatcttatggtgtccatacatttcagatatgggacagttgatatttttggagtaatatagtgggtaagatgtggagtactccaagaagcttttgcttcacatatgcagctccctctgtagctgtttggcctgtgctcttttgagtgccagtctctgagtaatcattactctcatttattgaccacccactatgtgcaaggcactggcacacaattcagagcagcagcttgtagctattaaaagtttttgttcttggctgggcgtggtggctcacgcctgtaatcctaggactttgggaggccaaggcgggcggatcttgagggcaggagatccagaccatcctggctaacacggtgaaaccccatctctattaaaaatacaaaaaaattagccgggcatggtggcgggcggctgtagtcccagctacttgggaggctgaggcaggagaatggcatgaacccgagaggtggagcttgcagcgagccgagactgtgcactgcactccaacctgggtgacagagggagactccgtctcaaaaaatcaaacaaacaaacaaaaaaaaagtttttgttcttggccggtcttagtggctcatgcctgtaattccagcactttaggaggccaaggtgggtggatcacttgagcacaggagttcaaaaccagcttgggcagcatggtgaaaccctgtctctaccaaaaatacaaaagttagccagccgtggtggtgcgctgtggtcccagctactcagaaggctgagtggggaggattactggagcccaggaagtcgaggttgcagcgagccgtgatcacaccattgcacttcagcttgggtgacagagtgagactgtctcaaaaacaaaagacaaacaaaagagagaaaagtttctattctcaagaaagctgcaatgtagttgaaatgataggaaaatgtacaaaagatggccgagcacggtggcttacacctgtaattccagcactttgggaggccgaggtaggtggatcacctgagtcaggagttcaagaccagcttggccaatatggtgaaacccatctctactaaaattacaaaaaagttacccgggcgtggtggcaggcacctgtagtcccagccactagggaggctgaggcaggagaattgcttgaacccaggaggcagaggttgcagtgagccgagatcgcaccactgcactccagcctgggcgacaagaatgaaactcttgtctcaaaaaaataaaaataaaaaataaatattaaactttgctgatggacatagaagatgacctgcatgtatgttcatactacggtcctggagagcacccaggaaggctggtgaggaagcaagatgacatctctccaaattgatttcttaattcagaatagtatcaaagctaaagacaataaactgagtgaaataatctgtaatatacctaagtgacaaaaggttaatatctataataaagtactcctacaaataaaaacccagctgaaaaatgggcaaagttggcaattcactgaagaataacgaaagaccaatgaagcatgaaaggatgcttagtcttgctaggagttaggaatttgaatatgaaaatagcagtgcggccaggtgtggtggcagcgctttgggaggtcaaagctaaaggatcacttgaggccaggagcttgagaccagcctgggcaacatagtgaaaccctgtctctacaaaaaaaatgaaaaattagctgggcgtggtggcgtgcacctgtgtcttagctactcaggtggctaaggagggagaatcgcttaagccccaggctgcagcgagctgtgatcatgccattataccctgggttgggcaactgagtgaggttctgtctcaaaaaaaaaaccggggggcgggcaagcaaagaaaaaagaacagcagtacataccactgggtaggaaaatgttggcaaggatgtgaagaaagggtctttgcatttcgtgttagtagatacgtaaattggcatagcctttctaggagaaatttgacaatatcaaattttaaaatgttcatgtcttatttttggtttatgtgttttaatttgcattatttggggttacggattaaaattttttaattgatacattatgattggatctatttatggggtacagtttgatgtttcaatacatgtgtatgttgtatagtctaatctgggtagttatttccgtcacctcatgtgtttatcatttcttcattcgaaaacttctaactattttgtaatatataatacctcattgggaagattgcttgagcctaggaggtcaaggctggaagctatgattgcaccagtctactccagcctgggctacagagagagaccccatctcgaaaacaaaacagaaaacaaaagacatttaacctggcccagtaggataagacaagaatgatgttgtttaatgactgatttccatttaacaagttgtactccttaatatagatgtttggtgtatttggtaaggggatatcagtttcagaaacatttacaaaagtgagtattctgggagatcttattacctggtaaccttagcatgctttgatctcaaagtggagagaagccgactaggagctgctctggtttaatagcaggtattctactcccaacccctccaggagattcttgccccacccccttctgtcttcagctaggattcccattttcctatgaagacaggacagttttgttgttttaaaggaagaagctgctacttcctaatcaggatctcaggctggggaagaacagtgtgggaccacgttagcatccgcagatttccagcaaggctgtcctgcgtggacgctactccatggaccggcttcaaaccacacactgccctgtgcgcacctggggctctctcaccctctagctagtagttaattagggcagagccctatttacagtcacagagacacagtatgacctggacattcttcagaagtgttctcccaaaataccacaaaatgagaatttgaccccatgacatgaagataaaatgaatcccattttcttttgtccatttattcattcagcaaatattttctgagtcctgctgtgtgtcagggcccagtgtcccatgcagggaatacaagatggaataaggcatgaccccagcctttaaagatcttggtactgagtgaggtttttggggagaggagaggcaggaaccacatcatcacagtgtatttttataagtactgtaattggagctagggcagcagctggcatgaagcagttccccttatgtgcttgctgaatgaatcaacagtcctgagggagggtatcttcagagatgacatcccagaggaggtgggatatgagctgggtccccacgggggctggtaaagacaatatgatggtccctggttttcagtataggaatgctgggaatgaggacacaatttcaaatctgcctggcttccaaagttctgttagagtaaaaccctttcccacaaaattcacctacttgtatcctgtatgtttatatttaaaatattggaaagaaccatataggaaataagctggaaattgatttctcaaggcttcaacaaacaccaggtatggtctgactgctccctgttctttcttcttccccctctgaaacctcccggtttcttggttagcagcagccttgtcatttcccctttggaacattggtctctgtaggaagaaatcagttatccgttacggggaaaagactaagagcagattcactgtccgtgtctcctcctttggccctttggtttctattgatggatctggaagggtggcatcaacatttttttccatttctatttagatgtgtatgtgaataggctgagactacagttattcatctgagaaagtaacattcttacattcaggttttcagtttcagcaagctgcaaaatgattgttcataaaatattgaaaaacaacatgtaatacaaatattagccaggtgtggtggtgcacccacctgtagtcccagctactcaggaggctgaggtgggaggatcacctcagcccagggaggtcaaaggtgcagtgggctgtacttgtgccaccgcactccagcctgggcaacagagtgagacccagtctcaaaaaaagaaaagaaaaataatgtgcttttcacgttccagaggagtgttgtgaatgatttgggtgaagtgacttttctgttaaattcatacttactaaaatgtgtagtggtgtgaagtatgcattatagatgagggtgggtgggttctgacatttagtcagccttcagtttctttaatgcatttgctcagtctccagcatctgaaacccatagtttgcgtcctttgtcacataaatatttggccaaatatagatgtcagaaaagctgtgtgcacaccacataaatgtccagccttcctggctgagtgtggctgtgccatgcagtgctctggaggtgggttggtggttggaagtggaaacacagtttcaaggctttaaaaaagacagctgcttttgaagaccagctgtagttgtgggttcataccttcatgttgtcctagcattcaggaacatttttatacaaatacaatggaatttctattttattgtaattaatttattttttgagacagggtcttgctctgtcacccaggctagagtgcagggatgtgaccacagctcactcagcctcagcctcctggagtcacgcaatcctcccacctcaacctcccatgtagctgggaccacaggtgtgtgccaccttgcctggctatcacttttctatttttcgtagagatggagtctggtctcaaactcctgggctcaagcgattctcccgccttagcccccctatatgtggagattataggcatgaccactatgcctaactgagagggaagctttaaaaatcttaacatatccaagtaattgccgctcttagcaaagaagtcaccatgggatgcgatgccattattccagcgggagttcctgcccaactcttacctgagtcggtgcttctcatctactcctcatcccccttaatgacagtagactccatctccgttctcaaaagatttctcaccatggagatactgttttaccatacaaagaagggaccaggcgacatggctcatacctgtaatgccaacgctttgggaagctgggcccaggagttcaagaccagtgtgggcaacatggtgaacaaaaaatttgtttaaaaattagctgggtgtggtagttcacacctctagtcccacctactctggaggccgaggtgggaagattgctgaagcccaggaggtcaaggctacagtgagcttgatcgtgcctctgcactccagcctgggcagcagagggagaccctgtctcaggggaaaacaaaaaagaaaaatctgaatgtaagagacaagttataacactaaatgacagcagaattattgagaaatttgttcctacttaaggtgatatatttgagaagtaaaaggttcgtttgaatgatacacatcctggcataataaagcccctttcctgtggtcgccctttatagtgagacagaaaagcctgttagagcctcccaaaaggagcatgtttgggaatgggaagggatagaaaaactacaactgctcttgttcattcagagccatccctagacctgggccttgaccccacgcacccctccttccctgtctgcactccctgcacagtgtgatccacaggaatcccaaagctcttcaggcccttctaatacttcccttctgtttctctaggtatttctgggaaaagccagcttctgtttgcactggtcttcacaactcgttacctggatctttttacttcatttatttcattgtataacacatctatgaaggtatggtatgccatccacaggaatgtatttcatctacagtgcacaggtctatggacacttaatttatgtcagctgtgtatttttaattaaaatgctccaaaaataatgtcttaatatgctgttcttgactttaaaactttcagaccaccttgtatatataactgggactaaacgagctatcagtaagcatacatttttggtttcaaaacagtagttaattaaaatactttgaagttagaacttttttattttaggttccttaagtatgataaatctaaagctcttgataactctgtaagtaagagcggtaactattatattttcaagccgtgggaaattacagagtccccagagaaatccagcaagttggtacataacaaggaacgaaagcaggactcctagttgcagtgtctcatttcgctgctgtgtgaggaactgtctataggcttctatcttttttctttgccactgagtcagttttacttaaactgttgtgtgtgtgtcatttttattacatttgccgtgcttaaatgatctctataccatcatttacttagtaacgtatttttttaaacctttcaacttgtcctaattattagtatctataacacctttgttgtctttcttatattttttctaattcacattaaaactagtgtataactattaaaatacaaaatgtttgcacaccacctaacactttgtgtagcactggtggcacacaccccacactgggggaagttgtggactacgtgagcttcagttctttcgcacagtgttgaattcatgcttgtgaacacctacagagctgggaactgaggatgcggcagaaaataagcagaagtctctaggctggtgtgggagagtacacagatcatggcagtacaaatgactgcgatttatgatgggtgccacaaaggaaaagtataagagttgcgaacctatggatataaaaaacatgaaacaggcccagtagctcccgcctgtaatcccagcactttgggaggccaaggtgggtggattgcttgagccaaggaatccgagaccagcctgagcaacatagttagacccctgtctctaaaaaaaaaaaaaaaaaaaaaatacaaaaattagccaggcatggtggcatactcctgtagtcccaactactcaggagggtaaggtggtaggatcgcttgagccctggaggttgaagctgcagtgagccgtaattgcaccactgccctccagcctggcagcctgggtgacagagcaggatcctgtctgaaaaaaaaaaaaaaaaaaaagaacaggggctctcaggatatgtaataggagtctgatttctttctttctttccttctttctacaaatactgagcacctgtgcaccaggcactattctaggccatttggttattagcatacccaaggaagtaatatttcaactgaatcctattggtatggcacctaaacaacctccccccaacattttgtgttcaagagcattttcataagcactgttgaaaggagacaaagcagtatgtgagtctggtctttactaaaaagcaaatttgagtcacttataatggattcttcattaccaaatgatgggaacctagtattcaggaaataatgagcttacttaaaaatggttaggtccccacttgtctaggcaagttaaaactgcaggcattagaggtgtgtgagcaagaatcctctctccccctcaggatgcccaggtttcagaggaatccatgcttgcttggttgtagtttctaagcacgatgtcctgaaagtctggcgtgagacccgaggtgctcgtgtctttttactttaacttctgtgtgctggtgagaggagagaagcagctgttcttctccaggtgctgctaaggccttagtggaaataacgcccatcaagtttttattaatgttgagctggccacagtctaggtcctggtgagaggcctctctgctgtgagccttggctagatgcgctgagggggctcagtgcatgtgtagatggatgtgtgtcttgtttatgcatgtagattttgttttgtatttattcacatacatggtgaggagatcgagaccatcctggccaacatggtgaaaccccatctctactaaaaattagctgggtgtggcggcatgcgcctgtaatctcagctactggggaggctgaggcaggagaattgcttgaacccgggaagcggaggttgcagtgagccgagattgctccactgcactccagcctggtgacagagcaaggctccgtttcaaaaaaaaaaaaaaagttaaacttacacttaacatatgacccagcagtcccacccctaagtacatacccaagagaagtgaaaacttacattcacacaaacacttgtacgcaaatgttcacagcagctttatccactgtcctcccaaattagaaaccacctgtccttcaactggtgagtgaataaacaaactggtgcatccatacaatggaccaccaatggacgcagctataaaaaggaacaaattattaacactaggccctcacttaatgtcattggtaggttcttgaagtgaaacaacacacactgcaacttgaagtgaaacaacatacactgaagccagttttaccataggctaattgacatgagtaagagttaagttcctacagcatatttccggtccccaaaacaccaccagacttttaaataaagacccaaaacaggccgggtgctgtggctcacgcctgtaatcccagcactttgggaagccgaggcaggcagatcacctgaggtcaagagttcgagaccagcctgaccaacatggaaaccccgtctctactacaaatataaaaattagctgggcatggtggcaggcgcttgtaatcccagctacttgggaggttgaggcaggagaatcgcttgaacctgggaggcggaggttgcagtgagccgagattgtgccactgcactccagcctgggcgacagagcgagactccatctcaaaaaaaaaaaaaaaaaaaaaaaccgaaacaaatgtgagctatacatttatttatttatttatttatttattttttattttttttgagacagagtcagtctgtcacccaggctggagtgcagtggcgagatctcggcacactgcaagctccgcctcctgggttcacaccattctcctgcctcagcctcctgagtagctggaactataggcacccgccaccacgcccggctaattttttgtattttttttagtagagatagggtttcaccatgttagccaggatggtctcgatctcctgacctcatgatccgcctgcctcggcctcccagagtgctaggattacaggcgtgagccaccatgcccagccaacatgagctatacatttaagaaagattaataaaagcaacataattatttatccagtttttggtgaatccgtgcatgatggtggtcatagtggtggcggattaaatcaagaagtatatgtttacaaacaaaaattataaggagtacctcctactaccataaagttcaaaaacaaacaataacaaatatagcaggctcactgagtgcttttgtactacattgtttattgtggtacatatgtataattattgtatactactttatgaattattttaccatagtttgtattcattttccaacccacttacttcatttcagggtcccaggtggccagagcctatcccagcagctcaggttcaaggcgcgaactttcccccaactgcataggatgccattccatcacagggcgcgctcacccacacccactcacactaggacagttcacacatgccagttcacctaactggcatcgttgagatgtaagaggaaaccagagtatctctggtgggagattctccaagagtatctcttggagaagacccacgtggactcggggagagcatgcaaacgccatggatggcggccccagccgggaaccagtttcttttctcatcagtgttacaaccaaaggatgttattggcagacctgctatacacacaataagtttggttgcctctcagatgcattaggctaactgaaattggacccagaaggcaacatactatgtgactccatttatgtggctttctagaaaaggcaaaactatggacagagaacataagtgtgattgcactgcaggaggtgaaggaagcctgggggagtttgactgcgaagcggcagcatggcagaattttggggatgatggaactattctgtgtcctaattttggtggtggttatgcctcagaactgaacacctccaaaaaagagaattttactatatttaagttttaaaattccaaaaacaaagctaaggaaaaaaatcttgcctttccaaatacatgggtgattaaaaaagctggggggtgctggaacagtggcaaggtattgacacctggtgttttttcttttatttgtaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgaggttagtttaaaaggttacttagggccaggcatggtggctcatgcctgtaatcccagcattttgggaggccgaggcggagttcagcctccactttgggtggatcatgaggtcaggagttcgagaccagcctggccaacatggtgcaacaccgtctctactaaaaatacaaaaaattagctgggtgtggtggcacgcacctgtaatctcagttactcagaaggctgaggcaggagaatcacttgaacccaggaggcggaggctgcagtgagccgagatcacgccattgtactccagcctgggtgacagagcaagactgtctcgagggaaaagaaaaaagaggttatggctgggcgtagtggctcacgcctgtaattccagcactttgggaggccaaggtgggcacatcacgaggtcaggagatcgagactatactggctaacatggtgaaaccccgtctgtactaaaaaataaaaaaaattagctgggcatggtggcgggcacctgtagtcccagctactggggaggctgaggcaggagaatggcgtgaacccgggaggtggagcttgcagtgagctgagattgtgccactacactccagcctgggcgagagagtaagactccgtctctcaaaaaaaaaaaagaggttatttaggtctgggcctggtggctcaccacacctgtaatcacagcattttgggaggccgaggtgggcagatcacttgaggtcagaggttcaggcattcagcctggccaacatggtgaaaccctgtctctattagaaatacaaaaactggccatgcgcagtggctcacgcctgtaatcccagcactttgggaggctgaggcaggtgggacacgaagtcaagggattgagaccatccagctaacacggtgaaaccccgtctctactaaaaatacaaaaaactagctgggcgtggtggcgggcgcctgtagtcccagttacttgggaggctgaggcaggagaatggcgtgaacctgggaggcggagcttgcagtgagccaagatcgcgctactgcactccagccttggcgacagagcgagacgctgtctcaaaaaaaaagaagaaagaaaatcaaaaattagctgggtgtggtatcgcacgcctgtaatcccagctactcaggaggctgaggcaggagaaccacttaaacctggaggcggaagttgcagtgagccgagatcgagccactgcactccagccttagcgacagagcaagactccatctaaagaaaaaaagttaatttcatggtcatgtctggttatctagaatggacctatttgcatgtttgcagatcgtgtaggttttcatggagttttttgtttttattttctggtttggcaaactctagtgcaatgttcatgactggtgtaaaaaaatcgtagatgagaattaagcacccacatatttaggtgtctgctgacagtttactgtctgattcatttgaaatagaaacttgaaactgtatttcattatcttgacttcagtggtaccaaacacagagccctgcctgtcccagtgtgggaagaacaaggtctccctcctgtagcccacattttgtttgcttttcatgtacagatgtgcactgatgtcgtgtctgtgaccctgcttagcagcactctgcacctcttgcctttaggaaagctggtttgtggtgcccctagtactgtgcagtgagctgatctgctcctgagtgcctcttctttccctgctgaacaggcaaacggtgctgcttcacatcctggggccgatcaagtcactgtgctaccctgggtgtctgatgggtgctgggagtgcctggacttttctttttttttgagacagagtctcgctgtcacccaggctggagtgcagtggcatgatctcggctcactgcaacctccgcctcctgggttcaagcgattctcctgcctcagcctcccgagtaggtgggattacaggcacccaccatcatgcctggctaatttttgtatttttagtagagaccgggtttcaccatgttttccaggctggtcttgaattcctgatctcaggtgatctgcctgtctcggcttcccaaagtgctgggattacaggcatgagccaccacacccagccatgcctggacttttaaaatactcaaggaccctctgaaagtccttctatcatcatcgtgaataaagtcatacgctgggcagagaatttccataattacagttgtgacttctacccctttgatttaaccacaccagaaagcttaaggaataagaaaaatagtgaaaatatttcagtagtttggcaagatcagtcagtgaggaaaaacagcagtgaggaagtggaaggagcttatcaattatcagtattgtcaatcctggcggaaagcagggttgatttggtatcccagatctggagcaggacaagcttgtccaggagaaacctctgtatgtagattcatagaaaattgaagagggaagaataaacctggagagacaaggtgatgaaaattcaaagaggtagaggtgtccaggttacccagcttgtcacactggcagtgccttgcctcttaaaggttgcttaagtttctgtgatttatgccaggagtcctcaacccctgggccactgactggtactggttcatagcctgttaggaaccaggccacccaggaggagatgagccgtgggtgagcaagtgaagcttcattgtatttatagctgctccccatcactcacattactgcccaagctccacctcctgtcagataactggcagcattcaattctcataggagcatgagccctattgtgaactgtgcatctgagggatctaggttgcatgctccttatgaaaatctaatgcctgatgatctgtcactgtctcccatcacccccagataggaccatctagttgcaggaaaacaagctcagggctcctactgattctgcattatgacgagttgtataattatttcattgtatattatagtaataacagaagtaaagtgcacaatgattgcaatgtgcttgaatcatcccgaaaccatccatccaccctgctggtctgtggaaaaattgtcttctatgaaaccgatcactggtgtcaaaaaggctgggaccactgggttatgcagttgccaagctgttgttctattttgggccgacatgccccactccccactcatcttaggctgctttgtggtaaagaaagcaagagtgtttcctctgagctcctggtgggcagtgggtcgtgatggaagcttgccatttctcttccagatcctctggaccttctccatctacctggagtccgtggctatccttccgcagctatttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaaggtatgttgggtgcgacctgcgttgtttctagagtgacgtgttcttttaggagtgcccttgcccagcactcttctaatctggcactctctcataaactggctccagagaaacactttcatgattggccaataacattctggatcaggatgttgtctttttaaatataagaaccctttttcttttgcaatagcttttcctaaagtgacacattttcactgtaaaagattcatctggtgtttcagtgaacattaacaccagatacctctctatgcatacacagacacatgacttaaactgtacattgctgttctatacactgcttttatcccctcacatttttcatgtcactagaaatctacataattttcagtagccacagagtgtttcattatgtgcatgtaccataatttatttacccagcccccattcatgggtggtcaggccgttactggtttgctgttaaaatccagtcattaaatcagcatccttgtgtatatgtgtttttgcatttgtatgaacataggacgtgtgaactttacaaatatttgatgaaagctatcatccttgttcagaaaaaaaaaaacatttatgccaggtgcagtggctcacgcctgtaatcgagcactttgggaggccgaggcgggcggatcatgaggtcaggagatcgagaccatcctggctaacacgtgaaaccccgtctctactaaaaatacaaaaaacttagccaggcgtggtggtgggcgcctgtagtcccagttactcgggaggctgaggcaggagaatggtgtgaacctgggaggcggagcttgcagtgagcccagatcgcgccactgcactccagcctgggtgacagtgcgagactctctctctcaaaaaaaaaaaaaaaaaagatatttacgcaaatgcacccaaatgcatgtatatagttttgaggggttcaggagcccctgaaacccaaccacagatcccaggctaaaaatccagctatacaataaaattcctaatggtggaattgctaggtaaaaagcatatataggtcgggtgcgatggctcacgcctataatctcagcactttgggaggccgagatgggtggatcgtctgaggtcaggagttcaagactagcctgaccaacatggcgaaaccccatctctactaaaaatacaaaattagccgggtgtggtggcacatggcctgtaatcccagctacttggggggctgaggcaggaaaatctcttgaacccgggaggcagaggttgcagtgagctgatatcacgccattgcactccagcctagggaacaagagcaaaactctgtctcaaaaaaaaaaaaaaaaaagaaaaaaaagagcatatatgtcttatctctttccttttgttttttttgagaccgagtctctctcacccaggctagaatgcagtggcttgctctcagctcactgcaacctctgcctcccaagttcaagcgagtctgctgtctcagcctcccgagtagctgagattacagtcgcgcactaccatgcctggctaattttgttttgttttgttttgttttgagactgagtcttgctctgtcacacaggctggagtgcagtggcgcaatctcggctcactgcaacctccaccttgcagcttcaagtgattctcgtgccttgaccaccctagtaactgggattacaggtgcgcaccaccacgcccggctaatttttgtatttttaatagagacggggtttcaccttgttggccaggctggtcttgaactcccaacctcgtgatccgcacacctcagcctcccaaagtattgggattacaggcgtgagccaccacgcctagcttttttttttttttttttttttttttttttttttttttttttgagacagagttttgctcttgttgcccaggctggagtgcaatggtacaatcttggctcaccgcaacctccacctcctgtgttcaagcgattctcctgcctcagcctcctgagtagctgggattacaggcatgcaccaccacgcccagctaatttttgtatttttagtagagatggagtttctctatgttggtcaggctggtctcgaactcccgacctcaggtgatcctcctgcctcagcctccccaagtgctgggattacaagcatgagccactgtgcccagcctaatttttgtatttttattagagatggtgtttcaccatgttggctaggctggtcttgaactcctgacctcaggagatccgcccacctctgcctcccacagtgccggaagtataggcgtgagctacctcaccctgccatcctttgtgtttttttttttttttatctttttaaagagacagggtctcactctgttactcaggctgcaagaatgcagtggtgtgatccttcctcactgcagtcccaaactcctgggctcaagtgatcctccctgctcatcctcctgagtagctgggactacaggtgcatgccaccacacctggttctttttaaaattttttttttatagagatggggtcgctctcactttttttgcccaggctggtcttgaactcctagcttcaagggatcctcccaccctggcctgccaaagtactgggattacaggcatgagccactgcatccggcctttatgttatagtacccagaatttcataggcctccctacataagctatattttactatatattgattagggtgaaagtcataataacaaaaagccactatgaatttagtggcactttcaatcaaatttgtatttttaaaatacaattgcttatttcctataccttactatgtagaatcttgtgtgtgggagacttctaggaatgggaagaaggaagctaagtttgtcaatatcagtaaccttttgttttcttttcttctctttgaaattctagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttaattacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaatatttttattgaggtgtttgtgtgtttttcaatgtaagcatcatgagaaataaagcaaagttcagatatttgcccagtaatggatataggaaaagctgctttccagccaggcctggtggctcatgcctataatcacagtactttgggaggctaaggcaggaggatcacttaaggccaggagtttcagaccagcctgggcaacctagcaagaccacatctcatttaaaaaactagtaaaaatgaaaacttaaaaataataaaggcttctatccattggctccttaacagagagagaccaatctattcccctgtccagttcaatcacaaagaaactttgaagaagtttccctgttgccttatgccctggctaagagaagagcaggtggagaagtggttttaatggagatcatagtgatttatgggaacccttaagtaagaaaagcacatgctttgggcccaggcatgtgttgaggcttggttccctcacttgtactccctggccctggacttcacgtgagcctcgttgcctccagttacataggtaaactgccagggatttctgtgtggtttaaatgagctgctgttggcaaagctcgtggctggagcttggtacatatacagtaatcatatttgccctcctaactttctgcttactttgtgacatctgtttgaaaagctggttggaaactggttctggcaggagtccctctgactcgtttgatatgggtcagttttgccagaaggttcacaaccctccttaggcgcagcggctcacacctgtaatcccagcactttgggaggctgaggcgggcggatctcttgaggtcaggagtttcagaccattctggccaacatggtaaagcccccacttccactaaaaataaaaaaataagccgggtgtggtggcacacacctgtaatttcagctacttgggagcctgaggcacaggcatcgcttgaacctgggaggcagaggttggagctgctgagatcatgccactgcaccccagcctgggaaacagagtgagactccatctcaaaaaaaagaaagagccaggcatggtggctcacacctataatcccagcactttgggaggcggaggcgggtggatcaggaggtcaggacatcgagaccaacgtggctaacacggtgaaaccccgtctctactaaaaatacaaaaaaattagccgggcgtggtggcggactcctgtagtcccagatactagggaggctgaggcaggagaatggcatgaacctgggaggcgcagcttgcaatgagccaagatcgcgccactgcactccagcctgggcggcagagcaagactccgtctcaaaaaaaaaaaaaaaaaaaagaaagaaattgactccttggtaccttccaaaagcagccacccatctgaggctagcttgattggatctgcgtgggtgttttctgtgtgcctctgtcctcgtaccacccagccatcctcacaactatctgggttaactggaatctgtagcctggaatctgctggaagtgctgtgggtgtttctccagttttgaaacaattccttttgtccctgcactttaaaagccatttgcagcgtaacatagtacatatccttttaagcaatgacaagggtacttttttataatactaaaataaaatgctctgcctagtttcatcttgggcacttaaaaggtgagagtcacctggcgtggtggctgacgcctgtaatcccaacactttgggaggctgaggtgggcggatcacttggggtcaggagttcaagactagcctggccaacatggtgaaacctcgtctgtactaaaaatacaaaaattagctaggcgtggtggtgcacacctgtaatcccaggtatttgggaggctgaggcagaggaatccctggaactcaggaggcagaggttgcagtgagccgagatcatgccactgcactccagcctgggctggagtcaagactcagtctcaaaaacaaaaaaaaaaacaaaaaaactgccaagaaaggctatgaagaatactctgtaatttgcaaattatgaaactgactgaaagaacaagcaaagaagaatattaagggtattttatttttccccaaaattcatgatgggataaatatggcaggatgttattctgtgttaaatctacacagtgggcccttaggtgtcaggcatcttctatgtatctgaaatatttccatcatttcaaaaaagtcattgtgagtcacttttgtaagagctgtgctttgatctcgatagttcatctgggaaataagagtttcttaaagatttttttttttttttttaagacagagtctcactctgtggcccaggctggagtgcagtggtgggatcttggctcattgcaacctccgcctcccgggttcaagtgattctcctgcctcagcctcctgagtagctgggactacaggcgcataccaccacgcgaggctaatttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccagctaatttttttgtatttttagtagagacggggtttcaccgttttagccaggatggtctcgatctcctgacctcatgatccgcctgcctcggcctctcaaagtgctgggattacaggtgtgagccatcgggcccagccgaaattttacttcttaaaaaaatttgtgggctgggcgcagtgggtcacacctttaatccctacactttgagaggctgaagtgggtggatcacttgaggccaggagttccagaccagcctgaaactggacatggtgaaaccccgtctctactaaaaatacaaaaattagccaggcatggtggcatacgtctgtaatcccagctactcaggaggctgaggcatgagaatcgcttgaacccaggagatggaggttgcagtaagtggagattgcaccactgcactccagcctgggctacagagggagactctgtctgaaaaaaaaaaagaaaaagaaaaagaagcaaaaaattgtggctcatgcctgtaatcctagcacgttgggaggcttgaggccaggagttcaagactagcctgggccacatggcaaaacccagtctctactaaaaatgcaaaaaaattagccagatgtggtggcacgtgcctatagtctgagctactcaggtggctgaggtgggaggatcgcttgagcctgggaggtggaggttgcagcgagccaagatcacaccactgtactccagcctgcagaacagaatgaaacactgtctcaaaaataaaataaaataaaataaaatttgtatactaccagtttcccaaaagagatttctttgaaattaaattgttttgtagggttttgttattgtttgtaacattaagttcacaatacctttacttatactaacaaaagtttatgtagaaacattatcttattgctaagtacaaatcctgtttttaaaagaactattacttttaagaatttggcaggcatgaggtggggcatggtggctcatgcctgtaatcccagcactttgcgaggccgaagcggacggatcaccagagatcaggagtttgagaccagtctgtccaacatggtgaaaccccatctctactaaaaatacaaaaaaaaaaaaattagctgggtatggtggtgcgtgcctgtaatcccagctactcgggaggctgaggtcggagaatcgtttgaacccggaaggcagaagttgcagtgagctgcgatcgcaccactgcactccagcctgggtgacagagtgagactctgtctcaaaaaaaaaaaaaaaaaaaaaaggatttggcaggcatggtagctcatgcctgtaatcctagcactttggtttgggaggacgaggtgggtggatcgcttgaactcaggaatttgaccagcctgggcaacgtggcaaaacccgtctctacaaaaaatacaaaaattagtcaggtgttgtgctgtgcacctatagtcccagctacttaggagactgaagcaggaggatcacttgaaccttgggaagtcgaggctacagtgagctgagagtgggccactgtgttccagtgtggatgacaaagtaagaccctgtctaaaaaaagaaaaagaaaaaaaaaagtcgaggccaggagcaatggctcacgcctgtaatcccagcactttgggaggccaaggcgggcagattacaaggtctggagttcgagaccagcctggccaacatagtgaaaacctgtctctactaaaaatacaaaaaataagccgggtatggtgacacacgcctgtagtcccacctactcgggaggctgaggcaagagaatcacttgaacccaggaggcagaggttgcagtgagccgagatccaccactgcattccagcctgggcaacagaacgagactccgtcctccccgcccccccaaaaataaataaataaataaatgtaaatatataaataaatatatgtgtgtgtatatatatatatatatatatatatatatatatatatatacacacgatcataggcacaacctactactgaattaatggtggctcagcgttttggttatatatttgcatgccacacatacgtatcacgatatgtttgtgtgtatgtaattacggagagattaggcaaagttgaacaagcatcatttgaaaataaactttgttttcatgcatacataaaattagagaacttgttttacctcacccttaagttttaaatagtttatttattttatttatttttttcagacggagtcttgctctgtcgcccaggctgaagggcagtggtgggatctcggctcactgcaacctccgcctcccaggttcaagtgattctcgtgcctcagccttccaagtagctgggattacaggtgcccaaaaccatgcctggctaagttttttgtatttttagtagagatggggtttcctcatgttggccaggctggtctcgaactcctgacctcaaatgatccgcctgcctcagcctcccaaagtactgtgattacaggcgtgagccactgcacctggcccagtcttgggtactttaaagaaactcctagatggcatatttcatccatagatactacattctagtcctagttgataaagactttttatcacaccaacaaagttagtacttctttttttttgagatgcagtctcgctctgtcgcccaggctggagtgcagtggcacatctcggctcactgcaagctccgcctcccgggttcacgccattcttctgcatcagcctcccgagtagctgggactacaggcgcccccccagcaagcccggctaattttttctattttttttagtagagatggggtttcaccgtgctagccagggttgtcttgatctcctgacctcgtgatctgcccgcctcggcctcccaaagtgctgggattacaggcgtgagccaccgtccctggctagtaattcttaaatatcatctaacagtctatgttcaaattttcctgtctcaaaaacatctttttatctctgatcaatggtgtccagcaaaaaaaaaaaaaaaaaaccaaaaacatattttttatggtttgtcaatttgaagcacatccaaagcctgcacgtagcagaagcagattatcactttttttctttctttccttcttttttttttttttttttttttttggagggagggtctctctctgttgcccaggctagggggcagtggtgccatcatagctcactgcagtctttaactcctttaactcctgggctcaagcaatcctcccaccacagccttctgagtacttaggactacaggcccatgccaagacacctggccaattcttaaatttcttgtagagacggaggtctcactatgttacccaggctggtctccaactcccgggctcaagtgatcctcccgcctcagcctcccaaaatgctgggattacaggtgtgagtcaccatgctcagcctggcccacttttataactaaaggcttaaaactcaccagcaacagccacgcttttagagtatatagtagtgcgtgctgtggtggtatttagtaactaacccatcaaaaaaactaatatatgcacatatatacatactttttttttttttttgagttggagtctcagtctgtcgccaggctggagtgcagggcgcgatctcggctcactgcaacctctgcctcccagggtcagcgacctccctgcctcagcctcctgagtagctgggactacgggtgcgcaccaccacgcccagctaatttttgtatttttagtagagacggggtttcaccatgttggccgggatggtctggatcttttgaccttgtgccctatccgcctcggcctcccaaattgctgggattacaggcgtgagccaccgtgcccggcccatacacatacatttattgtacattttactgattcaaagaatgttgtgttggagatcccccaaaccaccttcaagttgagtgattttttttttttttttttttttgagacagagtctctctctgtcacccaggctggagtgcaactgcaatctcggctcactgcaacctctacctcctgggttcaagggattttcctgcctcagcctcccaagtacctgggattacaggtgcatggcagcacgcctggctaatttttatatttttagtatcaccatgttgctcaggctggtctcaaactcccgacttcaagtgatctacctgcctcggcctcccaaaatgctgggatcacagaagtgagctactgagcccggccatgttctatgatttgctagaagcactcaggctcagaaaggctgtcatacttatggttgtagcttattacagtgaatggatatggattcaaatcagcaaaggaaaaggtgcatagggcagtgtctgggagacgccaggcataagcttcctttcacagtggagtcatatatatatccttaatttgcccagcaacaatgtgtgacaacatgcataaagtatgtccaactagggaagcttccctgagcctgggtgtccaagggattttattaggctcggtcatgtaggcatggagcatccgtgtgactcaccttacctactcagtctccagccacccacccagaggttaacctaatacagcatggcgcaaggctgccaccaccaacccactgttagcataaactactagatgttgcccaaggcctgagatatacaaatacactcctatcaagtagaatattccaagggctcagaagttatgttttaggagctggtcaagagccaatcctttctttagaatgtgcataccccagacctgttgtgataacactgtgctgcatagatgtgtagcagataatttattacacaaataataatgatgacatataatactctttactataattccagatttccagatagcctgtcacagatgctttttttttttttttttttggagacagtcttgcactgtcgcccaggctggagtgcagtggcacgatctcagctcactgcaacctctgactcccaggctcaagtgattctcctgcctcagccccccgagtagctgggactacaggtgcctgtgccaccatgcccggctaatttttgtattttagtagagatagggtttcaccatgttggctaggctggtttcgaacacctgacctcaagtgatctgtccacctcccagagtgctgggattacaggtgtgagccaccgcacctggtcaatgcccagaattttcatcagcccagtgaaatacccttgtctaaaaatgtatttgttcacagaccttgcaagcttgtattttaattttattattattagtttcatttattctgaaacttttggtacagatcttgcaatgtttttactttttcttttaagagacagggtctcgctatgttgcccaggctggtctcagcctcaagccagcttgccacctggctgatgttgcaatgttaacattaatttcctggtactgttctctgacttccatcttctccttcccaagccctgccataccgctccagccccacccctgcctctcattccttctacttactcttttttttttttttttttgagacaaagtcttactctgtcgcccaggctggagtgcagtggcgtgatctcagctcactgcaacctctgcctcccaggttcaagtgattctcctgccccagcctcctgagcagctgggattacaggcacgtgccaccacgcccacctaatttttgtattttcagtagagatagagtttcaccatgttggccaggctgttctcgaactcctgacctcaagtgatccgcctgcctcggcctcccaaaagtgctggaattacaggcgtcagccaccgtgcctggccccacttactctacacataatcagttattcattcattgagaatttaagaatgcctagaatgtgctctattacattcataggagtgaataagatggacaaggtgcctctgctcgtgaaacttacacttttaagggaggaggtaagagataataaacatgatgtaatgtcaggggctcattatgtgccatgaaggaaactaaagcagcgtaaggaacagagcctgacagttttgctgttttagctaaggtggtcagggaaggcctctttgatgcagtgacacttgagctgaggcctgaatgaagtgagagatagaaatgaggcaggagcggggcaccatggctcacacctgtaatcccagcaccttgggaggccgaggtgggcggatcacttgaggtctggggttcaagaccagcctgggcaacatggcgaaaccctgtctctactaaaaatacaaaaatcgggccggccacggtggtttatgcctgtaatcccagcactttgggagcccgaggcaggtggatcacgaggtcaagagatcgaaaccgtcttggccaacatggtgaaatccgtctctgctaaaaatacaaaaattagccgggcgtggtggcccatgcctgtagtcccagctactagggaggctgaggcagaagaatcgcttgaacccaggaggcgggggttgcagtgagccgagatcgcgccctacactccagcctggcgacagagcgagactccgtctcaaaaaaaacaaaaaaaacaaaaacaaaaaaagaggcaggagaggctgggtgcggtggctcacgcctgtaatcccagtactttgggaagctgaggtgggcggatcacttgaggtcaggagttcgagaccagccaaggccaacatggcaaaaccctgtctctactaaaaatacaaaaattagctgtgcatggtggcatatgcctataatcccagctactcagaatgctgaggcaggagaatcgcttgaactcagaaggctgaggttgcagaactcagatcgcgccatggcattcccacctaggccacagaacaagactccatctcaaaaaaaaaaaaaaaggaaatgaggcaggagaatcaggaatgagggtaatcaatggttaacaagggttaaggcataagcaaaagatcagcaggtgcagccagttctgggcaagataaggcagcatagaggccacatctgcacttctgtgataacaagacagaagtttccacttcagccatgagtgttaaccacattctttctgcttaatgaagaccctaattgaggggtctcttgagctgtgtggtctcttgaacttcgtgtcaatcaatctgtgctttttacgccatttgtttgtcttttgttgatttgttttttgttgttgtcgttgttgctttgtggggtttttgttgcaatttttatttatttattatttttgagatggagttttgctcttgttgcccaggctggagtgcagtggtgtgattttgggtcactgcaacctccatctcccgggttcaagcaattctcctgcctcagcctcccgagtagctgggattacaggcatgtgccaccacatccagctaatttttaggagagacggggtttcgccatgttggccaggctggtcttgaactcctgacttcaagtgatcctcctgcctcagcctcccaaagtgttgggattacaggcatgagccaccgtgcctggcctagtttttgtattttcagtagagacagggtttcgccatgttggccaggctggtcttgaacccctgacctcaggtgatccacccgcctcggcctccccaaagtgctgagattataggggtgagtcaccgtgcccggccttgtgttgcaattctcggttcaacgcgcaagcccctgaccaactcacagccaagactttccatccagtaacagaaaacctgcaggaggactcttcctggcagaggaaacacagaatgtagaacccctggagcaaaaatgaccctgatgtcttttcagagggggaaaaggcggcaggcagtggggtgggtgatagaggcaaatagtaaccagggagacagataaatgagcccttacaaacttttgatgtgtgactaccagggaaaggcctttgccaggggctggagtgtaattttttttttttttttgagacggagtcttgctctgttgccaggctagagtgcagggcgcgatcttggctcactgcaacctccgcctcccaggttcaagcgattcccctgcctcagcctccggagtagctggaattacaggcatgtgccaccacatccagctaatttttaggagagacggggtttcgccatgttggccaggctggtcttgaactcctgacttcaggtgatcctcctgcctcagcctcccaaagtgttgggattacaggcatgagccaccgtgcctggcctagtttttgtattttcagtagagacagggtttcgccgtgttggccaggctggtcttgaacccctgacctcaggtgatccacccgcctcggcctccccaaagtgctgagattacaggcgtgagtcaccgtgcccggccttgtgttgcaattctcggttcaacacgcaagcccctgaccaactcacagccaagactttccatccagtaacagaaaacctgcaggggggctattcctggcagaggaaacacagaatgtagaacccctggagcaaaaatgaccctgatgtcttttcagagggggaaaaggcggcaggcagtggggtgggtgatagaggcaaatagtaaccagggagacagataaatgagcccttacaaacttttgatgtgtgactaccagggaaaggcctttgccaggggctggagtgtaattttttttttttttttgagacggagtcttgctctgttgccaggctagagtgcagggcgcgatcttggctcactgcaacctctgcctcccaggttcaagcgattcccctgcctcagcctcccaagtagccaggactacaggtgcgtgccaccacacttggctaactttttttttaaattttagtagagacgaggtttcaccatgttggctaagatggtctcgatctcctcctgacctcgtgattcgcccaccttagcctcccaaagtgttgggattacaggcgtgaggcaccgcgcctggcctgcaatgtaattttatgcacaaagtgcagccttgcaaagtcccaggcagggtgcaggctttatctgaaggttcacaaagtcaccctggctgctgaagagggcacagcagaatgagaaagcacagtggggtgatgagcccaggcaggagatgaaggtggctcagaccagggtggggcagtgggggtactgaaaagcgctcagactccaccccgccagctgcagggtggtttcagaccctgaactcgaggggttcctaacacgggctccttacagcaaggggcacagatggaagcaatgttgtcccatgcttgcaagtctcacagaacgggatatgagtcccacacctgccattgacagcctgggtctctaggctagctaattcctccaggcctgaagcgtccctccttataaaatgaaaatttcggtcaggtgtagtggctcacgcctgtaataccagcactttgggaggctgcggcgggaggatggtttgaggccaggagttcaagaccggcctgggcaacagagtgagactccggtctctacaaaaaataggaaaatttatggagaaaccccatctctactaaaaatacaaaattagctgggcatggtgacacatgcctgtaatcccagctactcaggaggctgaggcaggagaatcgcttgaacccaggagatggaggttgtggtgaaccaagatcgcgccattgcactccagcctggggcaacaagagcaaaactatgtctctaaataaataaataaataaataaataaataaataaaaataaattagccgggagtgtggcacgtgcctttggtctcagctactcaggaggttgaggtgggagagtcgctggaatccaggaattcaaggcggcattcaggagttcaaggctgcagtgagtcatgattgcgccactgcactccaccctgaacgacagagccatacgctgccttaaacaaacagacaaacagggccgggcgcagtggttcacgcctgtaatcctagcactttgagaggcccaggcgggcggatcacttgaggtcaggggttcgagaccagcctggccaacatggtgaaacttcgtctctactaaaaatacaaaaattagccgtggtggcgcgctcctgtaatcacagctacaccggagcctgagacaggtgaatcgcttgagcccgggaggcggaggatgcagtgagccgagatcacacccactgcactccagcctgggaacagagcgagactccgtcaccaaaaaaaaaaaaaaaaaaaaaaaaaaaaaaaaaaaaaaaaggaaaaggaaatatcaccagaacggatatcactgcactcttcacgaaaaagaaaaagaaaataccagaacggatttcaccgaccggcagacctgcaatcgactcagccagcgccttccggatcagcgtttctgcgcaggcgcagacagctccggcggaagaggcggtgtagggctcagtgcgcttgcgccgatctcggcctcagcgtgagcatgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtaaggacggcggctacgggggcggtggagcccaccggagagggagcggggggcgagctgtcccttgagacggtgacagaagtggcttcccaagcactgtcgcggtcccagcgctggccacgcatcctcttatcgagttctcaccactgcccgaagaggtgggcagtggtgctgtgtccatttgacggatgacaaaccgaagcccccagagtgtgtgggctgaccccgggggacaaacagggggtttcgaagtccgcgcagcaggacgcgagcacccctttgtgtgcagcgccgagacctggccctggggtgccacgagggtgttaccgccggcaaaagccttggcctcgagttctcctttcttgaggcgggagcagccacttgtgcccttccttccctttgtacggggcacttgaatctgcaacacgaaggataggaaaaaataccgagccggttgtggctgcatttcgtgagaagcagacaggctcaacatacaacgctgttgtctttcaaagtgtggaatcagtgggaagtggcattggtacctgaagtctgttcccagaggatctgtgcagggaatgaatcattgttatgcaaaagtagattcttggctgggcgccatggctcacgcctgttatctcagcacattgagaggctgagacgggaggattgcttgagggcaggagtttgagaccaacctgggcaacatagtgagaccccttttctttttatttttttgagacagggtctcactctgctacccaggcgggagtgcagtggtgcgatcaccactcactgcagcctcaacctcctgggctcaagcgatcttcccacttcactcttccaagtagctgggaccacagactcgtgccaccacgcccagctaactttttctattttttgtagagatggagtctcaccgtgttgcccaggctagtgtccaactcttgtgctcaagtgatcctcctgccttggcctcccaaagtgctaggattacagacgtgagccgccgtgccgggcctagatcttttattgttggcaattatattccaggccaggtgcagtgattcatgcctgtaatcccagcactttgggaggccaaggcaggaagatcacttgaagccaggagttcaagaccagtctgggcaacatagcaagaccctgtctctacaaaaagaaaattatattccaaagtgaaccttgccttgttttggaaaatattaactccttttatttctttttttttttttttttttttttttttttttttgagacggagtctcatatcgttgcccaggctggagtgcagtgacacgatctcggctcactgccacctccacgtcccaggttcaagcaattctcctgtctcagcctctcgagtagctgggactacaggtgcgcaccactacgcccagctatttttttttttttttttgtatttttcgtagagacagggtttcaccatgttgatcaggatggtctcgatctcctgaccttgtgatccgcccacctcaccctcccaaagtgctgtgattacaggtgtgagccaccgcgccctgtccccttttatttctttgtatcatgttctacacagcagctccttggatttcatttctgacccttcccttttttttttttgccaggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggtaaaaagtagccttttctatttgatacctatttttttatagctttattgagatataattcacataccatacaattcacttctgtaaactttccaattcaacagtttttaatataatcacagagttgtgcagccatcaccatcatcaagtttataccattttcttcactcctgaaagaaatcctgtaccaggcgggacacagtggctcacacctgtaatcccagcactttgggaagccgaggtgggtggatcacttgaggccaggagcatgagactagcctggccaacacagtggaaccccatctctacgtctctactaaaaatagagaaaattatgttggtgcatgcttgtaatcccagctgctagggagctgagatcatgccaccgtactccagcctgagtgacagagtggagactctgtcacaaaacggaaagaaagagatcccatacccattagcagtcactcctcattttccccaaactctcccaaccctaagcattcactaatttgctttctgtctgtgtacatttgcctattgtggacatcatataagtggaatttattcactgtgtggccttttggtctggtttcttaagcttagcataatgtcttcaagattcatcgatgttttagcatgtatcagtacttcattttgatggctgaataagagcatcgaatgaatggaccacattttatttatccctttgccatttggtaggcatttggattgtttccatttttcacctattacgaatagtgcagctatgaacattcgcatacaagtgtttatacagacatgttttcatttctcttgagtgtgtacctaggagtgaattgctggatcatgtgttaatgctctgtgaaaccttttgaggaactgccagacttttccaagcagctgtaccattttacattcccaccagcagtgtataagggttctaattgcccaacgctcttattatatgacttgttaattatagccatcctagtgaatgtgaagtggtagctcatgattttgttttgttgtgttttgttttgtttttttgagacggagtcacactctgtcacccaggctggagtgccatggcgcaatctcggctcactgtaacctctgcctcccgggttcaagtgattctcctgcctcagcctcccgaatagctggggccacaggccatttgttttttgtctcatggctttgaggaacatttctttggtgactaatgatgttgagcatcctttcatttgcttattgctcatttgtgtatcatttttgcggaaatgtctgttcagatcttttgcccaattttagactaggctattgatccttttattttttatttttattttttgagatagagtctccctccgctgcgcaggctggagtgcagtggcgtgctctctgctcactgcagcctccgtctcctgggttcaagtgattcttgtgcctcagcctcccatgtagctgggattacaggcacccgctaccacgcctggctaatttttgtatttttagtagagatgcggttttaccatgttggtcaggcttgtctcgatctcctgacctcacgtgatccacccgcttcgacctcccaaagtgctaggattacaagtgtgagtcaccgcgcctggtcccttttatttttacattgtgagggttacaactattttgttgttgttagagacagtgtcttgctctgttgcccaggctagagggcagtggcgcaatcatagctcactgcagcctcaaatacctgggctcaagcaatcctctcttctcaacccccaagtagctggaagtacaggcacgtgccaccatacctggctaattttttttatttttattttttgtagagacagggtcttgctatatagcttagactgatcttgaactcctgggctcaggtgatcctctcgtctcggtctcccaaaatgctaggattacaggggtgaaccaccgcgtctgatcacctattcttcatattttttatatgtgttacagttttctgtagataaccatttatctgagaatgtctccagaagtgttggaaaccttccctgttggattcctctgcttcataggatgatgtgagcactgtggtgactaataaaggaatgcattcttagaaatgattcattggtcagaggcagggctgtgtgacatgccaccatccgccatgttttagtcctttgtcactgcttgaattgggatggacgaggtatgcatatcagatatatgctggtggtgaggtgcactgggaggcgctggtgatacagtgagtgacggcatcaagatcttgacagtttggaataaaggactgaaatgtaaaaggtgttagctcataggagcaatgtagagggtagaaatgttagcagcaacatctttcatgagaaaaagaccttagggtttgggatgaccagcaagagtggcatgtgcctgattaccacagtaacatagaaaacagagctctgtgtattttattttacttttttcttttgagacagagttttgcccttgttgcccagggctggactgcaatggcgtaatctcagctcactgcaaccaacctctgcctcccagattcaaacaattctgcctcagcctcccaactagctgagattacaggcacgtgccaccacacccagctaatttttttgtatttttagtagagacagtttcttttttttttttttttttttttttagtagagacaaagttttttgtttgttttgttttgttttttttgttttttgttttttttttccggatggagtctcgctctttcacccaggctggactgcagtggcactatctctatctcggctcactgtaagctccgcctcccgggttcacgccattctcctgcctcagcctcccaagtagctgggactacaggcgcccgccaccgtgcctggctatttttttttttttttttgtatttttagaagagacggggtttcactgtgttagccaggatggtctccatctcttgacctcgtgatccgcccgcctcagcctcccaaagtgctgggattataggcgtgagccactgcacctggtctagtagagacaaagttgaaccatgttggccaggctggtctcgaactcctgaccttagctgatccacccacctcatcctcccaaagtgctggtattacaggtgtgagccactgcacccagctagctctgtgtattttagtatgcctctagaaacatccacgcaaggaggctggattgatggaggctccacgtttgtgttggcccccaaatgtaggctgtcattggtgccagatgcttaaggaaagaaagaaaccatgtgtacagtgtggcttcagcgctgggaagcttcttattgaaggtgaagtattgagactggtgtcatttcagatacagcattatctaacttatttgcccttttttgttcatctcacattctggttagaccactgagtttgtggctgtaatagcagggtcagagtggaagcagtcggtgtacttttttttttccttacatgtttgtttgtgttgagatatttttggtgttgggacgtctttacctccctgtgagggatgctcatattcactccgttccctcttcctagacactcgtacaatgcttgcatcatcatgtacttgtggtcagagctcagaagtcatctgtgggttgtcggagtgttctgggttgtctatcccacagcctcctccaaacagaaccccgttttgttttgcccccatcccacacataccaagtatgcgtcagagaagcagaccctaggccgggctcacgtattggtgattggttcaggaatggacacgtgacccagtttggcccagtgagagtcagggagagtttggtggaaggttctggggaagtgcttccttgcccctctaggaaggatccaaaagccatttatcgtcgctctcctggctgaagctgtgtctccactcacagcgcagggcaagctgacatacagggcaggggagagctgggagaagcacaaggagatggaggcttgtctcggtcagggcagccccgatgccgtcttgcttctgcactcagtcgctcgagtcattgtggcccttcctgcttttcagccagtttgagttgaattttctgtaacttgtgggtagagatatcccagccaaactgaaaacagtattttataaaaacatgttcgtttaattgtcagtttgttgcacataacattatatgccttattaaaaatatgtattgaaggccaggcgcggtggcttacacctgtaattccagcactctgggaggctgaggcgggtgcatcatgaggtcaggagatcaagaccatcctgactaacacggtgaaaccccgtctcttctaaaaatacaaaaaattagctgggcgtggtggcgggcccctgtagtcacacctactcgggaggctgaggcaggagaatcgcttgaactcgggaggcggaggttgcagtgagccgagatcgcgccattgcactccagcctggacgacagagtgagactctgtctcaaaaaaaaaaaaaagaaaaaaatgtttgtttaattgtcagtttgtggccgggcgcggtggctcacgcctgtaatcccagcactttgggaggccgaggcgggcgaatcatgaggtgaggagattgagaccatcctggctaacatggtgaaaccccgtctctactaaaaagtacaaaaaattagccaggcgtggtggcagctgcctgtagtcccagctacttgggaggctgagccaggagaatggcatgaacctgggaggcggagcttgcagtgagccgagatcgcgccactgcactccagcttgggcgacagagcgagactccatctcaaaaaaaaaaaaaaaattgtcagtttgttacacataacgtcatatgccttattaaaaatatgtatcgaaagctgggagcggtggctcatgcctgtaaccccagcactttcacaagagggaaactccgtccccccctcaaaaaaaaaacaaagaaaaaaccaatggtcagtaggaaaatgggcaaagaacatgaacatgtaaaggaaatataaatgattgattgactgatggattgattttgagatggaattttgctctgttgcccaggctggagtgcagtggtgggatctcagctcactgcaacctccgcctcccaggttcaagcagttctcctggctcagcctcccaattaactgggattacaggcacacactactatgcctgtctaattttgtgtttttttgtagaaaccatgttggccaggctggtctcgaacttcccgccatggcctcccaaagtgttgggattacaggcatgagctactgcacccggccgacatagctaacttctgttgtcccttttgtttcgtaaatcaagtcccagtagcctgtcatctgagctgaaagaatgcttctttagcttttggctgatactcctctctgaaaggaacatcacaagatgtggagggaacatttggagcaggtggaattcagtcctctccatccagaagactgatcctcttcttctgtagctcaattgaggaaaactttttttttttttttggagacggagtttcgcttttgagtccccaggatggagtgcaatggcatgatctcggctcaccgcaacctccgccttctgggttcaagtgattctcctgcctcagcctcccaagtagctgggattacaggcatgcaccaccacacctggctaattttatatttttagtagagatggggtttctccatgttggtcaggctggtcttgaactccaggtgatctgccgcctcagcctcccaaagtgctggggattacaagcctgagccactgcacccggcatttgaggaaaactttgatactgtggtagtttctttttctttcttttttttttttttttgagacagagtctttctccatcacccaggctggagtgcagtggcgtgatcttagctcactgcatcctctacctcttgggttcgaccgattctcctgcctcagcctcccgagtagctgggattacaggcgcccaccaccatgcctggctaatttttgtatttttagtagagatgggtttttgccatgttggccaggctggtctcgaactcctgacctcaggtgatccacccgccttgccctcccaaattgctcggattataggtatgagccaccgcacccggcctagtttctatttttaatttgaaaacctcccaaatgaaatcccactgttgcaccttgtgggaggtttgattggagatggtccacccttatgactaccatgttttgacagaagaacccttttgacatacaaagtctgccttgtgccatgtgtggctttgattgtgggatgcctccttgtatctcctctgtgtttgtatcccaagagctcattgctaagctgggtcagagaagattgcagcattggctataggagttgagtgtactgattctgggacctaggccttcctttcattgctcttccataagtggctgtgtctgatgatggatgatagggttacttaaccaagacagtggtgaggacattacatttaggaatgcagctgtgcttgtcggttatggggccagcgaccttaggaagcctgctgcggcagccaggtccatactagcatctgtttttcttaaggaaaaataaaagggaaagtttttctttttttttttttctttttttttctttttgagatagagtctcactctgtcgcccaggctggagtgcagtgtcacagtcttggcttactgcaacctccgcatcctgggttcaagcaattctcttgcctcagcttcctgagtagctgggactacatgagcacaccaccatgcctggctaattttttatattttagtagagatgaggtttcaccatgtcagccaggctggtctcaaactcctgagctcagacagtccatccaccttggcctcccctgagctcagacagtccatccacctcggcctcccaaagtgttaggattacaggcgtgagccaccgcacccggccagaaattttttctaggcaggcaaaaccgtgtaaaggagattttctcagtaccatcatcatcatcatcatcatcattatcttttttaaaaaataatcagagatgaggtctctctgtgttccccagcgtggtctcgaactcctgggctcaagcaatcctcctgccttggccacccaatgtgctgggatcaatatcttattttctggaaccttaatcagagcaactccatctcttgattccttgtctgtgtatttcattaatgcagtatcagcagttgtcatcacagttggagtttcaagtccaggtgctgctgacattaggatgtgtctgtttttagaatcccagccctccaggaagcagtgtgtatgcagatactgtttcctgtttctctggggtgtttggctattgttataacaagctccaaatataggactgtgtttttttttttccacatacctgcaccctttccccctcagagaggttagtgttacaattatttagcttataaaattttgtctttgtgccaaaaatgaggctgttagtgcctaatattttatttatttatttatttttgcattttaaaaattatttttatactttaagttctatggtacatgtgcacaacatgcaggtttgttacatatgtgtacatgtgccatgttggtgtgctgcacccgttactcgtcatttacattaggtatatctcctaatgctatccctccctcctcccccacccaactacaggccccggtgtgtgatgttccccaccctgtgtccaagtgttctcattgttcagttcccacctatgagtgaaaacatgcggtgtttggttttctgtccttgcgatagtttgctcagaatgatggtttccagcttcatccatgtccctacaaaggacatgaactcatccttctttatgttagtgcctaatattttaaaatgtaactatttcagtcattctaacagaagataattttttgaatttaaaagctatttcctggtagggtgctgtggctcatgcctgtaatcccagcactttgcgaggcaaaggcgggcagatcacttgaggtcaggagttcaagaccagcctggccaacatggtgaaacccagtctctactaaaaatacaaaaattagccaggtgtaatgcctctaatcccagctactagggaggctgaggcaggagaatcacttgaacctgggaggcggaggttgtggtaagctgagatcacactactgcactccagcctgggcgacagagtgagactccatctaaaaaaacaaaaacaaaaattaaccaaaaaacgcccacaaaaaaacaactgtctatgggactatgaggcctatttcagcgtggtggtgtgcacctgtagtcctagctaccagagaggctgaggtgggtggatcacttgagcctgagaggtggaggctgcagtgagtcatgattgtgccaccacactccagcctgggcaagagagtgagaccttgtctccaaaaagaatggtagctattacgctctctgagcttcagtttgcttgctcatacgtaaaatgagataatgactaacccagtcattgtggggattacagaactacgcacataaagtgttttaggttggtgtctagaacaatgtaggtctcaaagggacgtggagcttgttttcatggctgttagaacttgggtgaccatatatccctgtttgcctgggacagttctgttttgtgcctgttgtctcagcataattattactattattattattattattattattattattattattttgagacggagtcttgctctgtcacccagactagagtgcagtggcgcaatctcagctcactgcaacctccgcctcctgggttcaagcgattctcctgtctcagcctccctcgcaagtagctaggattacagacgcccgccaccacgcctcgctaattttttaatttttagtagagatgaggtttcaccatgttggccaggctggtctcgaactcctgacctcaggtgatctacctgccttggcctcctcccaaagtgctgggagtacaggtgtgagtcaccgtgcccggccccagcataattattaatagtccccttttttcctctcagaagtataccagtttgggccatgattatattgtcaccccagtgagaacccagaagtgtttttaatccctgctaaatcttaaaaaagagcccaggacttcttgtcacgtttcccatcctcattttctcacttgctgtctgacttaggtgctgattaccaattataagtagaaaaagtcaggaggcgggtgtgcacagtacaaatgtatgctctgcaaaagctgtatttttgcaaaaaggaagctcttcatctctgaggaagcaactgagcagtcggaacgttttttgtatttcaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcaggtgacatctcccttcttctctttgagtttcagtggatttgaggcataggtgaacaaacccttctaacatgacagagagtccagcgtccctcggacttcctcaaatagttagaaattggagttagtttctgcgtaactcatgaaaatttagagacactgtttgtccatgaaatacaactcgtctttcgttatgcacgtattgatgtagatttctttccttactggttctttattttctacattcccttctgtctctctctcttttttttttttctttttttcttaaagtcttttattcctaacccttctcttataagaattcggaagaaaaccaaagaccaaaaccagagcaaaaactaaaactaaaggtatgaaaagagatacggtgtccagaagtgggacagggaataatattctagaacaataaggttttcgtgttttctaggctaaaaatcttagagatgatccagtcccgcccccttaacaccctctgttctaaataaggaatcagacctgggctgttgctgcgtttctcgagtcacaccgccagggggcagcagagccccttcgggaggggcatttcccggttgcgtgtgctcctcaatccggcgtcttgcagtgtgaaatatttaaacatatagatgagaggcctatcagagtactctgtgataccttcatgagaagagccctgaggcaccgaaggggaagggcgtatgtcatggtcccagggccatatggagaagaagtgcccgctgcatccgggcgcaggctgcaactctgcccagcggacacctccctgttccttctgtggcctttactgttagggcagggcctgggttaaccactgattcataaggaacttttttttttttttctttgagacggagtctccctctgtcgcccggctggagtgcagtggcgcctcctcggctcactgcaatctccgactctctggttcaagcgattctcctgcctcagcctcctcagaagctgggactacaggcacgtgccaccacacccagctaatttttgtgtttttagtagagacggggtttcactatgttggccaggctggtctcgatctcctgacctcgtgatctgccggcctcggcctcccaaagtgctgggattacaggtgtgagccaccatgcccagcctcataaggaactttctagaagaaagttgcttgcctcaggcaggttccaggagagctgcatcttcctcggtaacagaaccctccgtggtagagactcagaaactgaacctggaggagggaccccggacatctgcgtctgggctggggcccgcagtcaccgagccttttcctctctctgtcttgcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagtaagccgaggggatctggtttggtctgtttcttctgtttcagtaaatgcttctgatggagccggtccctctgttcccataaaaccgcgtttgagaacctggtgtctttgggtgtgtggggggtggccggagaccctctgtctgtgatgagccctccagggagcagttaactgcaagagccacaccttctcagaccctgtgtcccaataggacatgtcttcgtattgacacccactcactaccctgtcaaaatgctggattagcctgtaaggaaccacataacggacgctgtaccctttgagaataatttgcagctgctgttgagcagataccaagcacaggcagtggcatgaatcgaggttggaatcagatagtgagtgacttcttaccactttgtatcatgatggaaatgatcgacgatgctacttttggaagacagtttgaatagatgattgcagcacagaagggagcgtcattctagagcgagttcttccgcaatttgaaaatgcttgttttttttttttcacatgcagcgtgtcatctttttatatgacattctctgctaaatgctgttaaattccatactgagatgaggtaagggaggaagagttctctgcttatcctgcacacctgccagtctctcttcccacctctgtgctatccgacttggcaccattcagggctggtcctggagcctgacaccaagtcatagcagcagcctccgtagagggaagagggaagcgtgtcccctcagtaacttaaagaagtgcttaaacctagtcttaagatatctggaagagggaagaagagaagctggttatttctagaggatgtcgtaatctacatcacaggcagaactgatggctcagtggctgagtggccagtatattgtctttttttttttttttttgagacaaggtctcgttttgtcacccgggctggagtgcagtggcgccatcttggcacaacctccacctcctgtgttcgagagattctcctgcctcagcgtactgagtagctagagtactacaatagctgggatgacaggcacctgccaccacgcccagctaatttttgtatttatagtagagacagggtttcaccatgttggccaggctggtctcgaacttctgacctcaggtgatccgcccacctcggcctcccaaagtgctgggattacaggcgtgagtcatcgcacctggcagtatattgtccattcttacgggctacaagtacccggaggtgattgagaattcctaattcctccatttcctggagaaaaaggacatgtcaggcctaagaagactcactctctgttgctttcccagcttggggtcctttatgaggcttgccataccctgtgagtatgagtttagtctcataaatctctaccatccactgtgtttcaacaaaaccttcccagcatcttgagaaatgagagtataaacgtgggctaaaatggtgcattgctacaaaaacggacaatttatccattgatttctccactttacaaaatatttgaagtagattaaaaatagttgagtcacatgaagtgaaattttaagacagacgaatagcatttttatattctccagtggacttgtctgagggcaggatgtgaaaacatattcaggtcacatagagaagcactcctgccaggagcagtctttttaacatacctctgtgtctagaaatgtctgtgtgtgcgtgaatgcctatcaactatagaagactggattttagggaacccgggggtggtgcctgctgggttttatgacaggccattgtggtttcccacccaggacacagatctggtgcccagcgacattgcggcgggcctcgccctgcttcatcagcaacaggacaatatcaggaacaaccaagagcctgcccaggtggtctgccatgccccagggagctcccaggtgagcctggcttcatggagtgtccagttctgacacttacaccttttggtgggtcttcagaatcatacagctaacctatagcaatttcttcctcccttccttcattcccctttcccctccctcccctccccctcctccccttccctcccctctcccaccttttttttttttttttttaagacggagtctcgctctgtcgcccaggctggagtgcagtggcacaatcgcggcttactgcaagttctgcctcccaggttcacaccattctcctgccccagcctcctgagtagctgggactacaggcgcctgccaccacacctggctaattttttttcttatttttagtagagacggggtttcaccgtgttagccaggatggtctccatctcttcacctcatgatctgcccacctcagcctcccaaagtgctgggattacaggcgtgagccaccgtgcccagcctcccctcccctttttttctttttctttttatgagatggagttttgctcttgttgctcgggctggagtgcaatgacacaattggctcaccacaacttccacctcccgggtgattctcctgcctcagcctcctgagtagctgggattacaggcgcataccatcacactcagctaattttttgtatttttagtagagatggggttttgccatgttggccaggctggtctcaaactcatgacctcaggtaatctgcctgcctcggcttcccagagtgctgggattacaggcatgagccaccacaccgggcctatttttcatttttttaacttttattttaggttcaggggtacatgagcagggttgttacaccggtaaactcatgtcacgaaggtttgttgtacagattattttgtcacccaggtactaagcctaggaccctacagcagtttcattagcagcagggttggaatctgattggcggcttccactggttgtattgcatcacctgtcaggtgaggcatcttcgttatcaactggagttcaggtagtgggaacccattcctggccactttatcatccatcatatctttattttttattttattttttgagacagagtctctgtcacccaggctggagtgcaatggcatgatcttggctcactgcaccctctgtctcctgacttcaagcaattctcctgcctcagcctccacagtagctgggactacaggcgtgcaccaccatgcccagctaatttttgtatttttagcagagacggggtttcaccgtgttggccaggctgttctcaaactcttagcctcaagtgatttgccggccttggccccccaaagtgctgggattacaggcgtgagccactgcatccggccacatttatcatatctttgaaggcttatgttttaggaaatttgctgttcaattctatgcattagaacaattcctcctgggatggggactgcgattctccctgggtgtgtttgctttcttctctggggctgggggcagaagcagttcagctttgcttggtgataattttcctgccacaggttgttatgtttttgagaaagaaaattgcacgtagacggtatgtatcttcgctgctccgggttaagccactcagttcttgacagctcgtgtgtggcagtggcatggaaatgtactagtttcaggcatctagataggaagcgccggctcatttcagcaaaaacagcagagaagtcattggagtgttttttactgttaacttccccgtgcttgctgtgttcctataaaatgaggagtcaggctgggcgtggtggctcacgcctggcttcccagcactttgggaggccaaggcaggttgatcacctgaggtcgggagttcgagaccagcctggccaacatggtgaaaccccgtctctactaaaaatacaaaaattagccgggtgtggtggcgggtgcctgtagtctcaacgacttgagaggctgaggcaggggaattgcttgaacctgggaggcggaggtagcagtgagctgacattgtgccactgcactccagcctggtgacagagcgagactctaaaaaaaaaaaaaaatgaggagtccatgtcatccttattgaaggagcagttttgcctgtgggcgtctgagagttctattcaacgaaggagcaggaagagtcaggaatgagttcaggtttcaggtctcagtgtgttgatcctctgtgtcaggagttcccttaataaacagtagtttttgtccttctcttgtaggaagctgatctggatgcagaattagaaaactgccatcattacatgcagtttgcagcagcggcctatgggtggcccctctacatctacagaaaccccctcacggggctgtgcaggattggtggtgactggtgggttggcacagtctgagcctccatagccatatttcccttaaaaaaaaaagctattttgagatatttcaaaaatttgaaagaacagtgcaaagaactcccatgaatcctttacctagagtcaccagctgtgactcatctggtcacatgcgctgtatctctctctctctctctctccctccctccctcccccctgcatatatatatatatatatatatatatatatatgcacatgtattttttttccccgaaccattttatttttctctttttgagacagagtttcacccttgctgcccaggctggagtgcagtggcgtgatctcagctcaccacaacctccgtctcccaggctcaagcggtgctactggctcagcctcctgagtagttggaattacaggtgcccgccaccatgcccggctaattttcattttttgagatggagtttcactctgttgcccaggctggagtgcagtggcacaatctcggctcactgcaagctccgcctccctggttcacgccattctcctgcctcagcctcccgagtaactgggactacaggcgcccgccaccactgctggctaattttttgtatttttagtagagatggggtttcaccgtgttagccaggatggtctcgatctcctgacctcgtgatccgtctgcctcggcctcccaaagtgctgggattacaaacatgagccaccacgcccggccacacccggctaattttctatttttagtagagacggggtttcactatgttggccaggctggtctggaactcctgaccttgtggttcacctgcctcaccctcccaaagtactgagattacaggcgtcagccaccaggcccggtctcaggtaatttttgtatgtttagtagagacaggatttccccatgttgaccgggctggtctcaaactcctgacctcaagtgatctgcctgcctcagcctcccagagttctgggattacaaggtgtgagccactgtgcccagccccagtaataccctttttagcaatttttttctccaatccaggatgatgcgttacatctagttgctgtgtctctttggtctccttcaagttttaagtttctcagccgttctttcctttcatgatattgacattttgaagaggacagtgcagatattttgtagaagggccttcaatttgcatttgtgtgatggtttccccatgattagatttatgttttgcatttttggcgggaatggtccatgacaaccatccttcctagtgtatcatatcaggggatacatgatgccagtttgtcccatttctggttatattaacattgattgcttggctgaggtggtgactgccagccttgagaccatttaaatatcttgtcccaggccgggcgtggtggctcagacctgtaatcccagcattttgggaggtcgaggccagcggatcacttgagctcaggagtttgagaccagcctgggcaacctggcaaaactccatctcactaaaaatataaaaattagctgggtgtaacagtgtgtacctgtagtcccaggtgcttgggaggctgaggcaggagaaacacttgagcccaggaggctgaggttgcagtgagctggggttgcaccactgtactccagcctgagtgacagagcaagacgctgtcttaaaaaataaattaaataaatatatatgtctatatcccaccaggtgcagtggctcatgcctataatcccagcactttgggaggccaaggcgggctgatcacctgaggtcaggagttcaagaccatcctgaccaacacggtgacaccccgtctctactaaaaatacagaaattagctggacatggttgcacacacctgtaatcacagctactcgggaggttgaggcaggagaatcgcttgaaccagggagttggaggttgcagtgagtggagatcacaccattgccctgcagcctaagcaacagagcaagattctgtctcaaaaagaaaaaaaaaaaagaaaccaaaacaaaacaaaaaacaagtaagtaaatgtcctatccctctctgaattctcatctggcagtacagcatccattgattcttgtctgaatcacttattaccaggatggtggcaaaatcatgatttttctttttctttctttctttcttttttttttttttttttttgagacagagtctcaggatcctggctcactgcaacctccatctcccaggttcaagtgattctcctgcctcagcctcccgagtagctgggattacaggcctgcaccaccatactcggctagttttttgtaattttaatagagacaggttttcgctgtgttggccaggctggtcgaactcctgacctcaggtgatccactcgccttggcctcccaaagtggttggattacaggcatgagccaccgcacctggccaaaattgtgatttttctaaattcatcatttcttctacattaattgtcattctcctataaaaaagagctttttatccctacatcttactgtcaatatggatttatagattcttaaattattcagtgggttgtaattatgactgtttattttgtattaagtacagtgtttatttgatgctcaaaatgttccagattttgtcctgcagactggctccagtgttcttttcatatgaccccatcatgttctgagcacttcctaacctctggattttgctttttctttttttgggactgttgcccaggctagagtatagtggtatcatcacggcttactgtaacaccataccctcaacctcctgggctcaagtgattcacctgcctcggtctcccaaagtcctgggattacaggtgtaagccaccacgcctatgtatttattttaaagatcatgagattttactaatatcttttttttgtttgtcttttaagagacggggttctctcacctcagcctcccaagtagctgggactacaggcatgcactgccagacccagataatttttaaaaatgttttaaattaataaatttctttttagagacagttttgctttgtggcccaggctggtctccaacacttgagcgatcctcccgcctcagcctcccaaagtgctggcatcatgggtgtcagtctcctggccctgatatcttttaattctagtccaaagccacagagtttctctttgcttctccacatcatgtctgcaaagagaagcttggctcccagcaacatcagcgtgagttacccatgctcagtcccctattactaagaaaatagtttcagaattgctatacccagttccactacaaaaagggcatctgctaagtacagtttgcgatgtgtttgtagtttttttagtttttatttttatttattttaatttaatttaattgtattttttgagacggagtctcactctgtcacctaggctggagtgcagtggcgcgatctcagttcactgcaacctctgcctcccagttgcaagcaagtctcctgcctcagcgtcccgagtagctgggattacaggcgcctgccaccacacctggctgagttttgtatttttagtagaggtggggttccagcacgttggccagactggtctcgaactcctgacttcaggtgatccacctgcctcgatctcccagagtgccggattacaggcatcagccaccacgcccggcctctttttgttttttaaacgtagagcacagtactcaaaagttacttctatgatttcttgtttattttctacggagttggctgtgctgttcatttggacaggtttgctttacctgcttctgttggcattcagttttagggacttgcccatccttgttgatgaattttttgaatatagaaatcattaacatgatgccagaagtcagaactctatccaagaagtgtacacagagaggtattatctttaataagccattccgggcccagtgcagtggctcacgcttataatcccagcactttgggaggccaagacgggcagttcgcctgaggtcaggagtttaaaaccatcctggccaacatggcgaaactctatctgtactgaaaatacaaaaactagccgggcatggaggtgcacgcatgtaatcccagctactcaggaggctgaggcaggggaatcgcctgaacctgggaggcggaggttgcggtgacctgagattgtaccacggtactccagcctgggtgacagagtgaggctccatctcaatcagtcagtcgatcaaattaagttttaaaaagccattccatgtcagccaggctaagtcctgagaattgtccgctctggtcctcgcgtctctgggaacatgtggcagtgaggatggacgttccttgccaagtggctctgttcggcatagtaacgtctttgtcctctttttagctgcagaagcagaaccacagactatgacttggtcggaggcgatcagctcaactgtcacttcggctccatcctgcacaccacagggctgcagtacagggacttcatccacgtcagcttccatgacaaggtgtggacgctgcagacagcggctcttcacttcttttgggtcctggagctgttagagattctgatggaagttatgaattattcttcccgtaattcatagacacacaaacacacttctaagtcctgtgtactatttcagaggggccacagactctgggggagccacacagatgccctggtgcaggttcagaacccaggtttcacataagatagagacgtcttcatcagagatagcgcgctgtgtttcttacctcgcccttctgttgaggagtgaaatccctcagtattaatgccgcatggccttctgggattcgtatcgtcgtcctgggttgtgagtgccatcagtagtgtagtgtagcaggtctggcactctgggggggtcactgtcaccttgggagaagctgcaaaagccagctgtgggccgggcacagtggctcacgcctgtaatcccagcactttgagaggccgaggcgggtggatcataaggtcaggagttcgagaccagcctggccaatatggtgaaaccccatctctactaaaaatacaaaaattagctgggcgtggtggcaggcgcctgtagtctctgctggtcgggaggctgaggcatgagaatcacttgaatccgggaggcggaggttacagtgagttgagattgcgccattgcactccagcctaggtgacagagcaagatgccatctcaaaaaaaaaagccagctgtgcatggctgcagtgctgcgtgttcagtgtcgctcgctgtctctccaggtgattctcataggcaccgcagcgggaggcctgctggcgcagatcggcggctctcccactttgctgcccagtagaacctcttgaggagcttttaacactgctgaggtccaggccgcaccctgggccagttcaatccgaatctctggggaggtcagagagaggctaagaaaacaaagatcctttttcatgtagagcagcatggtttatgaaggccagtccctgccagagtgggtcccactgtgtagtgagcgtgagtggagaggcggtgtcccctcctctctgtgccgcaggacttgggctgtcattgcagacactgcagggctccgactttgcgtgctggtgcgtgtgttcactgtttaggccccatgcttgtttcttgctcctgcaggtttacgagctgccgtttttagtggctctggatcacaggaaagagtctgttgtggtcgctgtgagggggaccatgtctctgcaggtaacgttggaacctgactttccagccctgggagtgggtgcgggagcgggagcccacagctgctcggctggggaaatccgtcagtaaccgcatgagacacaggggaaaatggtgaggacagaaaatgaggatgtgagcctggggttgggaaatactccctttgcaaaaagggatgaagctgtttcatcttcactgagaactgtcagcagcagagcggccagcaggttggcccccccgccacaggagctcccagagggcacctgcttgacccctccctgcctaacttccctgagcccagccaggccccacacccgggagccctcccggggaatttctgcaccagagccagatggcggcagtgagtcagtcttgctgcagagagtcacgcccctggccaccagccccgctggaggctcccggtttggatcctcacaggccctcgtggcctgccgttctccaggtgaggtcaggactgccgacatccatccccagcccatggcccctcttctgtcttcctcagtccatactcctgggccccttggagatgccaggtgacgctttccttgtcaaagctttcttctctccattccggtttcctcctggccactcctcagtctcacttcccgttcttctctgctgacccagaaaatgagttgagactccagagcctgtgtgctcagccctcttctgctcctgactggctctggggtagcccccctaagtccagggccaggaccccaaacttgcatcttcaggagccatctgtgggtctcccgggaggcaccagagaagccacacttcccacagggctgctcctcccggggggcgccctgttcacgtcagctctgccatcgtccccccattgcccatttaagaagcagtggcgcctgtaatcccagcactttgggaggccaaggtgggtggatcacaaggtcaagagatcgacaccatcctgtccaacatggtgaaaccccgtctctactaaaaatacagaaaattagccaggcatggtggtgggctcctgtagtcccagctactcaggaggctgaggcaggagaatcacttgaacccgggaggcggaggttgcagtgagtcgagattgcaccactgcactccagcctggagacagagtgagaccctgtctcagaaaaaaaaaaaaaattagccgggcatggtggcgggaacctgtaatcccagatactcaggaggctgaggcaggagaattgcttgaacccgggaggtggaggttacagtgagctgagattgcgccattgcactccagcgtggcgacagatcgagactctgtctcaaaagaagcagtggcgtcgtctgtggtttctgtgcgccctgtctgctgtgtgtgaacttcctgccccagcctatgtggccctctctccatttccagcgccatggccccgcttttggccccagtcctctagcttcccatctccgtccttgtctagtctcatctccccagtctgtttgattgtttgtttgtttctaagacagggtcttgctctgttgcccagggtggagtacgatggtacagtcagctcactgcagcctccacctcttgggctcaagtgatcctcctgcctcagcctctcaagtagctgggaatacaggcatgtgccactacacccagctaattttttctatttttgtagagacaggatctcactatgttgcccaggctggtcttggactcctgggctgtagccatccactcacctcagcgtctgtccattgtcctgtccaccaaggactcactctagaacacggatcggatcttaccgtcctgctcagatacctccagtggcttcccattgcctttatggatttatctttaaatgttctttttttaattccaacttttattttagattcagagggtacatgtgcagatttgtagctgggtatactgtgtgacgctgaggtttggggtactgttgatcccgtctcccaggtactgagcatagtacccagtggttaggttttcattccttcccctgccctcctctagtagccccagtgtctattgtcccctctttgtgtccatgaatacccaatgttgagcttccaccgtcgcatcagaccatgcggtgtttgcttttctctgtctgcgttaattcgctgaggatgatggcccgcagctgcatccgttgctgcagaggatgtgtttttgcgcttttctatgcttgggcccactgtctttaacatcaagtttgtgtttcttatcacagctctgggtgctttacccagcagcctcccccatgcccactccgcagcctggacgctgctgccggggcctccagcccagcagcacagcactcgcctgtggaccttttcaaatatggctggtgtggagccgtgcccagggccccagccagcgggtcctgctgcccctgttgggaggacgccgcctgtcctctctgctttcacaacaacctcttccttcgggtctggctgtggcgtcacctcctccagggagctgcccctgcgcctgggctgtgccccatcctctgactcggcactgcctggcccttgctgtggtgctagtctaggcctcctcctctccacggtttcacctgttacggggctcctgaggacgggaaccaggctttgttcagaaccctggcacaggttctgtgccacggggtccttagaatacgtgtgtgtgatggggaaggcgcagggcgtgtcttaggcacactccatggtcccctccacccttcacgcctggcccagagctggtcgtgccatcagggccctcaggagccaccgctgggtttccctctttagtttagggttcagtcccaggaccgaactaggagatggtgccatccccgccatcctccacagaagtgtcaggagcagggaccacctgtcattctcccaccctgcccatcacaggctgacggccgcttctgcaacgccctttttacaggatgtccttacggacctgtcagcggagagtgaggtgctggacgtggagtgtgaggtgcaggaccgcctggcacacaaggtatgagcgcggactcgtgtgtcttgcctgtgaatgctgaccacacagaagatgggtgcctcgggtcagggactgcacagagcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgcgcctcccgcgctgcctgattctcacagcagccctgggaggctgtgggatttcgtttgttctaagagagagaagcctgttcagagagagcgagtgccttgcccaaagtcgcgtggctactggaataagtagcaggttgggcatttgagcccagctctgtggcttttccttctctctgtgtgtgttttctgagaggcagtctccctgtgttgcccaggctggtcttgacctcctgggctcaagtaatcctcctgcctcagcctcccagagtattgggattacgggcgtgagccaccacacccagcctctgaattcattcaggtagtacattctcatggtgaagaacagcttcatcaaagctcagagcagcagagagtgcgcaccagggtctcaggaggcaggcccaccccacgggcgctctgccgggtcattcacatattctctgtgcagatggcagatggcacggtgccaggcttacagtttcatgctcactgtgctatgggtgtgaggctgcctcagctcctcccgaaggaatgaaaaccccctgcccagagtagaggggtaggggtttctagttttgggggcttcctgtaactggtgagatattcctgacacacattggtcagtttcactgttcgttggtcgttagtgtatagttccgggcatccagtgcgttcacagtgccgtgaacccgtgtccagtcccacacccctaacacaagctctgaacccatcaccactcacttccgcttcctcccttccacggcctctgggaacctctgttctactttgtctctataagtcgtctcttctgggaaccccacagaagtggaatcgtacaggatttgtccttttgtcagtggcctgtttcttttcttttttttttttgagatggagtcttgctctgtcgtccaggctggagtgcagtggtgccatctcagctcactgcaacctctgcctcccaggttcaagcaattctcctgtctcagcctcccaagtaactgggactacaggcgcacgtcaccacacccagctgatttttgtatttttagtagagacggggtttcaccatgttggccaggctggtctctatctcttgacctcgtgatccacccacctcagcctcccaaattgctaggattacaggcataagccaccgcacctggactgtttttgtttctgagacagggtcttgttctgtcacccaggcttgagtgcagtggtgtgatcatagctcactgcagcctccatctcccaggttcaagtgatcttcccacctcagcctcccaagtagctgggattacaggcgtgtgccaccatgcctggctaattttctactttttattttgtagagatggggtctctctgtgttgcccagactggtcttgaatctcctgggctcaagcagtcctcttgcctcagtctcccaaagtgctgggattgcaggcgtgagccaccacgcctggccctttgctgtcttttttgtatgccagttcacaaaagactccagtttgcccattactgtgtgaggaaaggaggaactgtaagccttagtacagagatgccccagaaacccgtcaggggccagggggcttggcctgggtggatctgctcaggcaaaggctttatgtgaccacaagctgaggatccgcggcttggctggcagctgaggcccccaagtgctgggttcatattttagtgacagttcatcccttgggtcgggaaggctgccgctcagggcctgtcctgtcctcttggcttcatttgtgccaaatcacgctgagtttggctctgacgctgtccacggtaattggactccaaacctgtgtggccgaaagggctttggcatttgttgttggatgtgcgccggggaggctcgccagcagcagcttagtccacgtcctgctgggctctgcctgcccagcaccagccacagggtaggtgcccagtgagtgtggcctggagttgactgcatcccgccgtcgcaggagagagaaagggcatctggtaatttgttaagaagtgctgtcagggccgggtgcagtggctcacacctgtaatcccagcactttgaggtcaggagtttgagaccagcctggccaacacggtaaaaccccatctctactgaaaatacaaaaattagccgggtgtggtggtgagtgcctgtaattccagctactcaggtggctgaggcaggagaatcgcttgaacctgagactccgtctcaaaaaaaaaaaaaaaaaaaaggaagtgccatctgaatgcacacagagtgttgaagcctttttaaaaattttcttatatgatggctgggttcagcattctacttgtagaattatttaattcttagaaacttgtagttgcagccaggtgcggtggctcacgcctgtaatcccagcactttgggaggccgaggcgggtggatcacgaggtcaggagatggagaccatcctggctaacacggtgaaaccccgtctctactaaaaatacaaaaaattagccgggcgtggtggcgggcgcctgtagtcccagctagtcaggaggctgaggcaggagaatggcgtgaacccgggaggtggagcttgcagtgagccgagatcgagccactgaactccagcctgggcgacaaagcgagactctgtctcaaaaaaaaaaaacaaaaaaagaaacttgtagttggattagagatgatcaaaaaccatctcccatcttctgtgggatttcctccaccccgtcctattagaatcgaagctgcacgggacaggggccaggcccgcttttctccgagcccagcacaggagcacactgaggaagcattttgaagatatttttgattgacagggtcatttcttccctggcactgcttttcttttttaaaaatttttttagggcttaactgcgtgtagggaatggctttattttttttcttttatttattatttttatgatgattatttttcagaaagagtctcactgtgccacccaggctggagtgcagtggtgcaatcatagttcactgtaaccttgaactcctgggctcaagtgatcctcctgcctcagcctcccaaagtgttggaattacaggcatgagccacctgcttaattttcaagaagcctgtttcagaggacagatgtatatgttagaaaattttaaatttttgctgggcacagtggctcacacctgtaatcccagcactttgggaggctgaggcgggtggatcacgaggtcaggagttcgagactagcctggccaacatggtgaaaccctgtctctactaaaaatacaaaaattagctgggtgtgatggcgcatgcctgtaatcccagttactcaggaggctgaggcaggagaattgcttgaacccaggaggcagaggttgcagtgagccgagatcgccccattgcactccatcctgggcaacagagcgagactgtcattcattcattcattcattcataaataaataaataaaattttatttactttttgaagttaaagccaaacctgaccaccctaaaactcacttctgatggtttagttttacctttgcaggaacagtggatgcttatcagtgtctttgattcagaacttcgtggattctgtagttgttttagagaaatggggtcttgctatgtggcccaggctggtctcaacctcatgcgttcaagtgatcctcctgcctcagcctcccaaatagctcagattgtaggtgtgagccacttggcacagcggtagaactttatgtttaaatgttatgtaaaaagtctaaatctgaccagccgtaggaacttggctgaagtaaattgtgatatgttcacacagcacaaaacggtgtagctacagaaaaagccacagaaatgtatctgtggaaagatgtttggttgttttgggttttttgtttgtctgtttgttttttgagacagggtctcactctgctgcccagtggtgcgacgataactcactgcagcctgaacttcatgtgttccagcgaccctcccacctcagcctcccgagtagctggactataggcgctcgccaccaagccccgttaatttttttttttttagtagagtcaggatccaggctggtcttgtatttttattttagtagagactatgtcgcccaggctggtcttgaactcctgggctcaagtgtcctcctgccttggcctccctaagtgctgggattacaagcgtgcgccaccacacctggcacctgcttcacgtcaggcgctgtgcaaggtgccaggagcacagccatgcacgatggacgtggctgctgattctgcagtctcagatcccaggagagactcacacatcagtgcacagcgtcatcccatctttgagtctctgctgggcctgccttgtctgaggattaacggccaccttctttgtctgtgtttttagggtatttctcaagctgccagatacgtttaccaacgactcatcaacgacgggattttgagccaagccttcagcattgctcctgtgagatcttagttaacgtttctttccttgtcctctttggagctgttgtttttacccttcacctcattctgctgtctgtcctctaggagtaccggctggtcatagtgggccacagcctcgggggcggggcggccgccctgctggccaccatgctcagagccgcctacccgcaggtcaggtgctacgccttctccccaccccgggggctgtggaggtgagcctttgttttcctgctctaacagcttgctacttacaagtcatgtggtcaagactcatcttttttttcttttattttcctgagatgaagtcttgctctgtcgcccaggctggagtgcagtggcgtgatctcggctcactgcaagctccacctcccaggttcaggcggttcttctgcctcagcctcccgagttgctgggactacagacacccgccagcatgccggctaatttttgtatttttagtagtggtggggtttcaccatgttggccaggctggtcttgatctcctgacctcaagtgatctgcccgcctcggcctcccaaagtgcagggattacaggcgtgagccaccgcacccagctgaggtttgtgttttgaagcgctatttcacagaagaaagtctgtctagcctttcttagacctatgtgaccatacctgtaatttcctcaatgatttaattctaagagtcttttttcaaacagactttattttttagagcagttttaggctgacagcaaaactgagcagcagattgtagggatctctcataccctccctccccacaagcaagcacaacctcccccattctcacagccctggcagaggggtccggttgttgacatccatgcgcctggtaggcacatcgcccagagcccgtagtatgctgagcactccctccgccctctcggggggcatatgccctgggtggggacacatgcataatgcacatgtttaaagacatttttatgagtttgaaaattacttttttttttttttttgagacggagtcttgctctgtcgcccaggctggagtgcagtggcgtgatctcggctcactgcaacctccgtctcccagcttcaagcgattctcctgcctcagcctcccgagtagctgggactacaggcgcccgccaccacacccggctaattttttgtatttttttagtagagacgggtttcaccgtgttagccaggatggtctcgatctcctgtcttctgacctcatgatccgccaccttggcctcccaaaatggtgggattacaggcatgagccaccacgcctggctgaaaagtttatatttttttttgctgattccagcatactgactgttctgtgtaaccttttgccatgattataaaggaaaattataccactttatttcattaaaatgaaataaaggccaggcgtggtggctcatgcctgtaatcccggccctttgggatgattaaaaagtatgtacgtaaagaacaaaaagagcttttcttcgcacacttggtttctttgacatatagttcacacaggaaaaaacaggagaatgtataagtgcttaaatctttccctcaataaagaagtgttcagaataatgaattgttgcctagcagtctacagaggcagacattaattttttaaaacttaaatttcagtcgtctgttttcttgctgtcttttttttttttttaattgacacagagtgtcactcagtctccccagctggagtgcagcagcacagtcatggcttgctgtagcctctgcctcctgtgctcaggtgatcttccggcctcagcctcccaagtagctgggaccataggcgcacaccaccacatccagctaatttttgtaaggaacagggtcttgctatgttgcccaggctggtcttgaactcctgggctcaagtgatcctcctgcctcaccctcccaaagtgctaggattaaaggtgttgagcactgtgcctggcctcattttcttgctttctcaagaatattctcaagttttgggcttgaaatgagcaagtattttttttttccatcgtccatatctggaatcaaccgtttctccaaggaatattggttccttttagcaggaaatggtatttctgaactgaaatcggggcactggtagttctcattaccacagggctggtcataatttccaggccttttcattggaaagaggtaggaaaggcttttgttacaccaaagagaaaatgtaactgtagtgtatagtgatacttaaacatcaggaggctgggcatgttgggtcacacctgtaaccccagcgctttgggaggctgaggcaggaggatcacttgagcccaggagatcgagaccagcctgggcaacatagacccggttccttacaaaaattagctggacgtggtgacgtgtgcctgtggtcccagctacccgggaggctgaggcagtaggattgcctgaacccaggatgaagaggttgccgtgagccgagatcgtgccactgcactccagtctgggtgacagagctacactccgtctcaaaagaaaaaaaaaaaaaattggccgggtgtggtggctcacacctgtaatcccagcactttgggaggccaaggccggcagatcatgaggtcaggagatcaagaccatcctggctaacacggtgaaaccctatctctactaaaaatacaaaaaattagctgggcgtggtggtgggcgcctgtagtcccagctgcttgggaggctgaggcaggagaatggcgtgaacctgggagatggaggttgcagtgagctgagattgtgccgctgcactccagcctgggagacagagcgagactccatctcaaaaacaaaaaagtcctttctgtcaccccagaggtagaatgtggtggttttgactggtgtttccattatgtccatggctggaaggaagcgtgtctgtgttcctctcctcctgttgatgaaagcctgcaccttttccctgctcttctgtctctggtcgtggctgttcactttcaccgcatgtcctgagatgaccccgcagtggcacacacagtcctcctccttctcccagctgtgcgggacgcactattatgtgactcgttgttgggagctgaaggcagttctgtggatgggtgtttggaggctccagcctctgccggtgcaggttctgccgcagtgaatcgcctgttgcctctgccccttcatttttgctggggcatcttttttttttttttttcttttgagatggagtctcgctctgtcgcccaggctggagtgcagtggcgcgatctcagttcactgccagctccgcctcccgggttcatgccattctcctacctcagcctcctgagtagctgggactacaggcgcccaccaccacgcctggctaattttttgtatttttagtagagacgggcttttaccgtgttagccaggatggtttcaatctcctgaccttgtgatccgcctgcctcggcctcccaaagtgctgggattacaggcgtgagccactgcacccggcctccagtgcatctttgatggagtcttccaagcgcggtttctgggtcaaaggacagatccatgtgcttggtccgccttggtgtccagtttgcggttttagctgcggggcgtctctgttgaacacatattgtggctttagtaggatctggccagtgagttgccataactgacgtttcccctaccctccctttagagaagagagaacagagctgaggcctgggaacctaacccctcagtgttactgatttctttcatggaagcccttgtgggcagtgtcatcgtaaagctaacatcctctctctgtttggaatttcagcaaagctctgcaggaatattctcagagcttcatcgtgtcactcgtcctggggaaggatgtgattcccaggtaagcccacctggtgctgtgcccagggctggggggttgggagtgccaggtcccagcctcagtgtgcccctttgctaaacaggctcagtgtgaccaacttggaagatctgaagagaagaatcttgcgagtggtcgcgcactgcaataaacccaaggtaagcgggtgccttgttgagagggtcagcaggacacggggcctgtccctgagatcctgtggagagccgggaggaattgcaccctcagtgcagggcactctatgctgttgctggaagttctccttccaccatctgatcagattctgggctaggactctgtgatgtctaagaaagcaaatggctgcagcaagtgcgggaaatgtcacagggaggaaacaggatctgggctgggagcagtggtgtatgcctggaatcccagcacctcaggaggccaaggcaggaggatcccttgaggccaacctgggcaacacaacaagaccctgtctctattctaaaaaaaaaaaaagaaaagaaaatactctggaggaactgtttgattttgctttctgacaaacttcttagtcctgtcttgtgactaacagtttgttaatgccttttggctttgttgtccgaaagcttagaaagcaaggctgccaaatagaccttaagaggtacaggcacatttatctacactgtggatatcatgcagttattaaaatggtgatatatgtccacgtcaagggttttttaacatggtggtagaaatttatgtctgctggccaggcgcggtgggtcacgcttgtaatcccagccctttgggaggctaaggcaggcagatcacctgagtcaggagatcgagaccagagtggtcgacatggcaaaaccccgtctctagtaaaaatacaaaaatgagccaggggtggtggtgagtgcctgtaatcccagctacttggtaggctgaggcagaagaatcgcttgaacccaggaggccgaggttgcataagccaagatcgcactccagcctgttggatagagtgaggctctgtctccaaaaagaagaaatttctgtctgccgataaagatagatatccattgaaaagttcaaaagaaaaaaaacttaaaaattattcttaagagatatgactcatggcagagagtggggacaaggagatacagatatatgaattttgacaaaaatttgaaaatacgtatgccaagggtggttttgtttagtgtcggtagagatgatttttacttgtttaatccctttgttttctgacctttctcatggttttgttcctaatcagaaagaagaaacgcaatttaaatttttctccttaccaattacctcccccagttttttcttttttgagacagggtctcgctttgtcacccaggctggagtgcagtggcgcagtctcggcacattgcagcctcccaagttcaactgatcctcccacctcagcctcctgagtagctggggctacactacaggcatgcgccaacacacctggctaatttttgtattttttgtagagacagggtcttaccatgttgcccaggctggtctcaaacttcggggctgaagcaatctgcttgccttgacctcccaaagtgctgggattacaggtgtgagccactgctgtgcccagcctaaaattttttttagaaattagtatctagggcgggcccggtggctcacgcctgtaatcccagcactttgggaggctgaggtgggtggatcacctgaggtcgggagttcgagaccagcctgactaacatggagaaaccccgtctctactaaaaatacaaaaaattaggccgggcgcggtggctcacgcctgtaatcccagcactttgggaggccaaggcgggtggatcacgaggtcaggagatagagaccacggtgaaaccccgtctctattaaaaatacaaaaaattagccgggtgcggtggcgggtgcctgtagtcccagctactctggtggctgaggcaggagaatggcgtgaacccgggaggcggagcttgcagagagccaagattgtgccactgcactccagcctgggcaacagagtgagactccgtctcaaaaaaaaaaaaaaaaaaaaaatacaaaaaattagccgggcatggtggcaggagcctgtaagccgagctactcagtaggctgaggtaggagaatcgcttgaattcgggaggcagattgtggagccaagatcacgccattgcgctccagcccatagaaattaatatctaatgcctttcagggaaggaagggtaaagctgatttccagaattgccggaaaataattaagggaaatatccctcacagtctgtatggcttagtttttaatattgctccacgtgtgatggttttactgcccaagagagagcccacactcatgatctgtgactaggcatagagccttgtcctgagccgaggtggctgccacccagcacagctcgccggtgcatctttgctggagtcttccaagcggggtttctgggtcaaagggcagattcctgtgcctggtccgccttggtgtttcgggaggtctcgggtgacagagggtgagtgacagcattctactgattgggtctcgccctcagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtgagtgcggcgtggtgggtgtggtgggcaggcaggagcagcgcggggtcagccctggggccgcgtgggagctgtctctccttttctgcttcaggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagtgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcaccatagtg

SEQ ID NO: 646 - DNA, 45185 bp, Homo sapiens
aactgcagccccctctcgcgccgcctgcgaagacaaggtcagtggccgcgaagttggaacgtgatcggagccacgaggcccagtgaggcggcaccgagggggcagcgcaacgcgctccccctgtccagggcgtcaagtgcgcccctcccggggcccgcctgtgctccgggcggagcgcgctagctgctcgggcgcggggcgttcttggtgcgccgggccgtggtgagtccgggctcccgtggccgcgtgctgggaggagactggagcccggttaggaagaatggagttggcgactcgctaccaggtgagggtccggccgcccgccgccgtccggacgcacccacagtttgacttccctttgccacccggtcctgctggccttgggctggaaacgtggcccttggctgcggcactggggatctggcgcgcccagccggttgagtgccggagtgggcgcgccctgcaggtgtgcgcagtgggtcacgtttgtgctacgcggaccacagaggccggtcgccccagcacacaaccgcgctcagcctggcgctctgctcagtctcgggtggccgccgggggtgcaggcggggagctagcggggcgcagcgcctgcgtttgcagccctcgtgagacgggggaggggctttttttgtgcactccccacactttctccgggaattggcacagagatcaggaagcttaagaaagttgtaattttttttttttaacagtcgatcgccagaccagtccaacttggataatggagtttaaaaataataactttagtgtttattctagaacttttgtaaacgttttcaaggaattagtaaccatttgggggaaatggtaacgtcattgggccgagttaaacaagctgcaagatcccaaatcatatgcacagcacgaccccaattacgcgttaagggcctaactcgtctttaaaactcattagcaaacacttgagtaagttcccccaaacgtttcagtgagtagtgggaatgtgaacgtgacttcagttttctctttttacttcttaaaagagcttttctctacgttatcgtaatggagatacatgtttacttagaagtaagcaataaaaacatttttcataagaactaaaaatacaacctttaaaaagggaaacaagcagccacgcctctgcttgtgggagcacggagatgctttgtgcgaggattgtttttttttttttttccacttgttttattgagagtcgcgagactcactgcttccaccttgcttccgactggtgtttactttcctccacctgcgtgcctggcccgggagaaggggaggcggggccgccagcgttggaaggcgcagagtgcccggcgcccgagcccaaaccgctgtcacctgcccgagtctggcggcaaagactgagccactaacggtagctttggccttttagtaatttctgaagccttcctgaaaatggtcgcttgagaaaaatctgttgttgatgtttctgagaatatttttaaaatgcctcctgtgagataaactattaaaagcaagggaaacagtaaagcctacggaatgagacagggttcgattttttattttttgccactggcttttaccgtgtattagcatccttttttttttttttttttttttggagacggagtttcgctcttgtccggggtggagtgtaatggcgcgacctcggctcactgcaaccttcgcctcccgggttcaagcaattttcctgcctcagcgtcccgagtagctgggattacaggcgcccgccaccacgcctgtctaattttttgtattttttttttttttttagtagagacagggtttcacaatgttgtccagtctggtcttgaactgctgacctcaggtgatccacctgcctcggcctcccaaagtgctgggattacaggcgtgagccaccacttccggctggcgtcctaaccttctaggagtttctgttgctacaggactaaaaacaaaaaacaaaccctctggatggagatttgagctccttgtgagtttagtcagaaaatgtatctggaatttatcactccggagctccttgtgaatgtaatcagaaaatgtttctggaatgtgtcactcctgttgttaagctggagagttctttgcacttccactactgatattcataattcatgcttaggaaactcagaagtcccagaatgtgtagttggaagtgagcgtttactgccacacaatgaggctaatttttggtagttctaaaatgttaaataaactatttatcatgtaggggttacccacaaattatatccgatccattatgcaccaattaaggcaaattactatatgtaagatgatcagggtttttttttttttccttttctgaagacctaattggcagtgcaaatcaaagatgtgtgatggtttttccagtggaaatgttcctgttcatcgtaatttaaatgtgcacagattatagtctctaaattagtggagagtggttctgtggggtgggcaggtgactgcggataagaacacttaatgaacatttcaggcacagcaagatgttaaattcgtgtggttccaccctgtcccccagccttatgaataaagcaatgtgatgaaccacctgaagtggcattactgcacatcaaatgtcgctcagctcagtgtgcagtgggttttcatctcacacattggagtaagtataatttctatcgcttggaaagcgcagagctaagtgtttcagcaaagcagcttaggcctaatgttatgagtaagaagcaaacaaggagactcatttactctgaactactttcgagtctgctttcctgccatcccaccagtgtgttggatttgatgtcctctgacagtgattacgcttcccccaggctgtagtcttgtcgtgctgaccactgtgtctttgtgcttttatataaaatgacagaaatagctcgtaaaggcaagggtgtgatccctgactaagagctgtcaacagtgcagctcatgggagctccagcttgctgcagctccgtaggagagaaactggtaggcactgaatgtcagtgttctcctcgtactctgttctagctccagagtacaggatggcccatttgagaaggaaatgatgctaaatgttcttgtaaataggcaggagcacgctgttgaaggggtaaaggggtatttttctggtattggtctcttagctgcaaagtgctcccatctgatcctgttgtttaacatgtaattccagagccccagaagctggtcacagaaaggacaatgatttgccactctaatagtcttgtatttaaaacgctccttggttgttctgtgttctgctggctaccccatccatagcagagcaggattctcaaaaatcaggcgaaaacctcagagatcataatgattctgatcaggtacacaggccaggaaacaatgagataattgtggcctaaaacaattacaaacattagagtaaattaatgaaaaagattagaacatcattggaatagaataagccaggcattacatttaaactgctcttgagagttttcctttactcaaagttatgttttagaatatttacctccagtatacagttttgttttagaaaagactcggctttattcaccaaaatggaatagattacaggctacttaaagtaggtagggatagagataagaaaatactactggggccattttgttctttttgtttatgaaaagcagtgctttctgtagtttttttgaaataggaccattcagaggcatatttggtaaataccactgaagttaacactcagaaaaatgtatcttccatagtagtaaatgctagcaccctgcatgcagcacagaaataaagtgtggagtctcacagtgcaaggggcctgagctttagttcaaataaatcgttgatgtttcctgcctgttttccttcatgatcatcagctgaggatagagggcttgctgactgggttagtacactgatcagatagtcagttgagcaccggttatgtgctaggcattggtagggtggaagaacaaagacacagaaaacacgcctctttccccacactctctaccagaaggccatgcttgaactcccttcctcttctgcttttgccagagctcagctggctcctgctctgtgctatggggacctgggggaccttgggtttggagagtagagggagaccttaagagccatccttttttgcccccaaggaatggaaactatcacttccttttaaaagtcatgctgtgctaagtacttaaaagttatcagatttaatccccactgtagttctgtgaagtaggttgtgttatctgccttttaaagataaggctaaattgactaatttgctcagggcaatttgtaaggaattggcccttgctgctggaatcaccgggccttggtgagtcaggaaacttgccctgttccctcctccctttaactagaagggctggagtgttaacagcagctagtctggttcttttttaggaactcaccagattatgctttatactgcctgtaaaagtcagtttgggaatgtgaataagatccaccaagcttttacataggaatgacttttatgtgaaatttgcattgtacaaacaataacatgttaccgtaagctgcactgaaccacttctctgcttcccctactctccgtgccccattttctgcagtttccatgaagtgtttgcctgtagcacagtcgtcatctttgtctaacctttacagtatgattgctgttggaatctgctttccttagcactatcagcattacttttcctagtagcgtagagatctttacagttttcatttttagtgactgtctagtgtttctagatgtgtattttatgtattttctgttgaaaaaatatttttttctttattagaggaaataaatatctcagggtggtatactgtatatcttacggcttgtgttggagtctgcactatttttaataactctttataatgtatttaatatctcataaagggaatgtgcctgattttcaatggttaggagcctctgacacattgttttcctagggcatttccccttttgttgcgctatattagctgaaagaaagcagtttttgctgaggttagaaccaagcttatgataactggactgaaagaatgttgtctccttgaacttagagcatctcatagaatgttctagttggggggaaagtggagagtagtcccagaaatctgttctttacatccggtctgcctagaaaaccaagaaaacctataaatgtgtcagtggacatttagtggaagtgactgcagattagggctatggggaatttgtggcaagttggtctcattgacttggcggaaggcagggacaccccatccacagcgcccacattcatgcttccacctgtgcatctacagcaggttctccagggtgactgcatcctgcagctatgtaggttactgctcctggaagtcttcccatccattgcccccaccgctggctcaggtgctcgccctgggaacttctggagtacctgggctgacttccctgatcacatttatcataccacactggaattgtttaaagattgtttctcttaccctaccacttacgactcagttttcatcagctctcttagcatggtgtctggcatatatttgatgcttaggagacgatgtccagcatgtattagatgcctaataaatatccattgaatggatggaagggcaaagtagtattgttagtaatatactcttttaattaacatttatatagcgttttctacttttcagagcacttcgcaggcatagtttggaagtcatcagggctggttcttttccttccaggtaagtggtgtagggttgcactttcctggccctgaaacagtcaaggctatttgacttgctttggccagtggaatatgagaagtactatatgtcacttctaagtgaattatttaaatgccagcataccacttactgtatctcattccctctgccactgcatctgtcagcattctgcagagtggtagctctatcagcccaggttctggtgtgaggacagtgtggaatagagccttgggctggcctgtgatggacatgtaatgtgaacaagacggaagcctttttttttttttttttttttggtttgaagctattgattgagatttagggttgtttgctactgctttatagcttgtcatatcctaacagaccagggtgctcctatttcagttttggattcaatcactctgtggttgtcatctgagtgatctggggtcatggtagtcgtggtaacaaacgtgggtgggtttctttttgattgttagagtgatgagggtgaggggaatgcccctggtaagtggtttggagttcaggggtattaagtaccatgtggcaggcaggagagtcctacaggatgaagcagttgttctgtccaaaacgtcagttgcaccttgttggaaaacactgagaacagacttgtccaatttgataatcttttagactccagagaaatcttaacattggcttcacatgttctatctgctgacctccctggaggaggaaattacttcacacttcccaagtgatttggttcacttcactcccaggatctctgccaaaattccagttcattaggtactcatctgctgaatagctcttctaagacctgtgtaaatacatatctaaaatgacttcccatttatttcttctcttttaaacataacattgactaccctgtggggctttttattgtggtaagatatacataataaaaggtactatttttaacctttcagtgttactaagtatagtcacaatgttgtgccgccatcactgatctctcatgagctttttcatcattttaaactgaaactctctacctactaaacaattacccctatgacctcttcctccagcccctggttacttctgttttagtttctgtctctgaggatatgactatcctaggtatctcatatgagtggaatcatatggtatttgtccttttgtcactggctcatttcacttaacattgttattaaagtttatccatgttatagtatgtatcagaattttttttcaattatttctcttttgagacagggtctcactctgttgcccaggctggagtgcagtggtgctatcgtggctcactgcgccttgacctcctgggctcaagtgatcctcccactgcaacctcttgagtagctgggactataggtatgtactaccctgcttggctaatttttctttttaaaatttctggtagagatggagtctctgtgttgcccaggttggtcttgaactcctgggctcaagcaatcctcctgtcttggcctcccaaagtgctgggattagaggcataagacactgtgcctgacgtcatttcttttaaagtctgaataatactcttatgtgtacataccatctttatttactcatctatttatgttgtcggttgtttccaccttttggctattgtaaataccaatgaataaacattggcatacaaatatctgcttcagtccctgctttcagttgttctgggtgtgtgttcctaaaagtagaattgctgggttatatgataatactaaattcaattttttcagaaaccactatactgtttggcacagtggctgtgtcattttatatcatcataagcagtgcacgagtgttccaatttcttcacgtctttgccagccctagttctttcctggatttttttttaatggccattctaatgtgcataaagtggtatctcatcgtggttttgttttgcatttccccaatgattagtgatgttaagaatttttttcttgtgcccgttggtcacctgtacctcttctttgaagaaatgttaattcaagtcctttgcccatttcttaactgggtttttgtagttgttaagtgagttatttatatatcttggatattaatcccttattagatattatttgcaaatattttctctcattctatataggttgccttttcactgtcttgatagcgccctttgcacaaaagtttttaattttgaggtctagtttatttatttttcttttgttgccatatccaagaaattattgccaaattcagtgtcatgaaacttttcccctgtattttcttccatgagttttatagttttagctcttatatttagatctttgatccatcttgagttagtttttatagatggcttaaggtaagggtccaacctaatccaattttcccagcactgtttgttgaaaatactgttctttgccattattcttggcatccttgttgaaaattagttaactgtatatgcaagggtttgtatctgggctctttattcatttccattgatatatatgtctgcctttatgccaagaccacactgttttgattactatagctttgtagtaagtattgaagtcaggaaatgtgagtcctctaacactgttcttttttttttttttcttttttaagggatggagtcttgttctgtcacctaggctagggtgcagtggtgcaatctcggctcactgtaacctctgcctcctgggttcaagcaattctcctgcctcagcctcccgagtagccgggactacaggcacatgctgccatgcctggctaatttttttttgtattttagtagagatggggtttcaccatgttgcccagggtggtctgaaactcctgagttcaggcagtctgcccacctcagcctcccaaagtgctaggatttcaggtgtgagccactgcgcctggtctgttcttcttttttaagattgttttggctatttagggtcctttgagattccacattaattttaggatggacttttgtttttacgaaagaagtcactgagagtttgagaaggaatacattgagtctgtacatagcttcagttagtattgtcaccttatattaagccttccaatccatgaacatgggatggttctccatttccttgtcttccttgattttttcggggatgtagttttcagtgtacaaggcttttttcgcctttttggttaaacttatttctaagtactttattattctgatgccattgtaaatggaatcgttttcttaattttcataattgttcattgttagtgtgtagaagcatagttgatttttgtgttgattttgtgtcctgcaatgtctaattgttagctctaactactttttgtgtaatctctagtgttctctacatatataatcacgtctcttatagcagagataaattttgcttcttcctttccaatttggatgcgttatttatttttcttgcctgattggtctggctagacctcccaatactgcgttgaatagaagtggtaaaagcaggcatatttgtctagctcctgatcttaggggaaaagctttcaatcttccattcatcattgagtatcttgttagttgcgggtttttcgtatatagccttatgttggtgagtttaagtttccttctattttttttttttctgatgagggaagggtgttgaattttgtcagatgtttttctgcatcagttgagatgatctttgtttttcccctttattctgttcatagggtgtactacattaattgatttttatgtgtttgaaccattttgcattcctagaataaatgccacttggtgatcttgtataatccttttgctacactgccgaatttgttttacctgcattttgttgagtattcttgtatcagtattcgtaagagatatggctgtatagttttctagtatctttctctggctttggtatcaggataatgctggtcacatagaatgagtttcaagtgttcctccttcttcaagtttttggaagactttgagaaagactggtgtttgttcttctttaaatgtttggtagaattacccatgaagccatcttgtcctggggtttactttgttgggagggttttgattactacttaaaatccttatttcaaatatattcagatcttctgtttcttcataatttaatctagctaggttgtttgtttctcgggatttatccattatatctagataatccaatttgttggcatacggttgtttatagtactcttaaaatcctatttatttatttatttattcattttgagacggagtcttgctctgtcgcccaggctggagtgtagtggcacagtagcggctcactgcaacctccgcctcctgggttcaagcagttctctgtttcagcctcccaagtagctgggattacaggcgcccaccaccaagcctggctaatttttttgcatttttagtagagatggggtttcaccatcttggccaggctggtcttgaactcctgaccttgtgatccacccacctctgcctctcaaagtgttgggattacaggcgtgagccacagcgcctggccagtcctttttatttatgtaaaattggtagtaatgtccaatttcattactaacgttagtaatttgagttttctctgtatattttctagtcatgtagcttaagatttgccaatttgttgattttttttttcaaagaataaacttttggcttcattgatttttctcttattctattatctattctattcatatctgttttaatctttgtttccttcctcttgctaactttgggtttggtgtgctatacatttcctgttcccctaatgtgtatggtttgttttttggttggagatcttcatttttattgtgtttacagctataaatttacctcttagcagtgccttttgctgcatcccatatattttggtaaattttgttttcatttacatttgtttcaaagtattttctaatttcccttgtgatgtcttctttgacccatggttgtttaggaatatgttatttaatttccacatatttgtgaatttttcatttttccttctgttactgatttctagtttcactctactgtaacaaaggatagtattatttcagtcatttaaaaatatattcacacttgttttgtggcctaacatatagtgtgtcctggaaaattttctgtaagtacttgagaaaagtgtttattctgttgttgggttgagtgctattagttttagttggtttataatgttgctcaagtcttctgtttccttattgctctgtcttgttctgttcactgttgaaagtggggtgttgaagtttctatctgttgttgcagaacagtctatttcttcattcagttctgtcagtgtttgcttcatatatttgggatctttgatgtttggtgtgtgtatatatttataattgttctatcttctagtgaattggctcttttatcaatctgtaatgtctttgtctttcacaacagtttttgactattttgtctcatattagtatagccactccatctctcttttggttattatttgcatcgagtatctttttctgtccttttacttttaacctattggtgtctttagatctaaagtgagtctgttgtagatagtgtagagttgtatcctattttgaaaaaatccttcctgccagtcaatttcttttgatttggagtttaacacatttaaatttaaagtaattactggtggggaattacttaatcttgtgatttaagaaataggttttctgtatatcctatggcttttttgtccctcatttcctctgttattgccttcctttgagtttagttgattgcttagtattggcacattttgactctcttctcatttcatttccttttcttcttagatagtttttgtgttaccatggagattacatataacattctaaagttatagcaatctggtttgaatgataccaatttcacttcagcgacatacaaaaattctactcctatatagctctttttccatcattttatgtaattgagatcaggaattacatctttatgtgttgtgtatccatgaacagattcgtaagtatttttaatcctttagaaaataacaagtagagttataagccaaatttacaataatactctagtttttatatttgtccatgtatttacctttacctgagaaccttatatttttgtatggctttgacaaagttacggtgtagtgactttcatgtaaatgtgaagtactcctttcagcattttctgttgcaaatgccagtagtaatgaattcccttggcttttgtttatttgggaatgtcttaatttttatctcatttttgaagggcagttttttttttttaaccagatggagaattcttgtttgatagtttttttcccttctacattttaaatatgttacaaataaatcatcctactgctttctgacctttaaggtttctgtgataaaacggctgataatctttttttttcttttttttatactttaagttctgggatgcatgtgcagaacgtgcaggtttgttacataggtatacatgtgccatggtggtttgctgcacccattaacccgtcgtctacattagttatttctcctaatgatatccctcctctagtcccccaaccccgacgggccccagtgtgtgatgttcctcttcccatgtccatgtgttctcattgttcacctgccaactatgaataagaatatgtggtgtttggttttctgttcttgtgttagtttgctgataatttagctggtttcctgcttcatccatgtccctgcaaaggacatgaacacatccttttttatggctgcatagtattccatggtgtatatgtgccacattttctttatccagtctatcattgatgggcatttgggttggttccaagtctttgctatcgtgaacagtgccacaataaacatacatgtgcatgtgtctttatagtagaatgatttataatcctttgggtataaacccagtaatggattgctgggtcaaatggtatttctggttctagatccttgaggaatcgccacactgtcttctgcaatggttgaactaatttacactcccaccaacagtgtaaaagcattcctatttctccacatcccctccagcatctgttgtttcctgactttttaatgttcgccattctaactggcacgagatggtatttcattgtggttttgatttgcatttctttaatgaccagtgatgatgagctttttttcatatgtttgttggcagtataaatgtcttcttttgagaagtatcatatctttcgcccactttttgatgaagttgttctttttttttttcttataaatttgtttaatttccttgtagattctggatattagccctttgtcatatgggtagattacaaaaattttcttccattctgtaagttgcctgttcactctgatgatagtttcttttgctgtgcagaagctctttagtttaattagatcccatttgtcaattctggcttttgttgccattgcttttggtgttttagtcatgaagtccttgcccctgcctatgtcctgaatggtattgcctaggtttttttctagggtgtttatggttttaggttttacatttaagtctttaatccatattcagttaatttttgtacaaggtgcaaggaaggggtccagtttcagttttctgcatatggctagccagttttcccagcaccatttattaaatagggaatcctttccccactgcttgtttttgtcagatttgtcaaagatcagatggctgtagatgtgtggtgttatttctgaggcctctgttctgttccattggtctgtatatctgttttggtaccagtaccatgctgttttggttactgtagccttgtagtatagattgaaatcaggtagcatgatgcctctagctttgttctttttgcttaggattgtcttggctatacaggctcatttttggttccacatgaaatttaaagtagatttttgtaattctgtaaagaaagtcattggtatcttgatggggatagcattgaatctataaattactttgggcagtatggccattttcatgatactgattcttcctatccatgagcatggaatatttttccatttgtttgtttcctctcttacttccttgagcagtggtttgtagtttccttaaagagatccttcacttcccttgtaagtagtattcctaggtattttattctctttgtagcaattgtaaatgagagttcactcatgattttgctctctattattggtatataggaatgcttgtgatttttgcacattaattttgtatccagagactttgctgaagttgcttatcagcttgaggagttttggggctgagacgatgggattttctaaatatacagtcatgtcatctgcaaacagagacagttggacttcctctcttcctatttgaatactttttatttctttctcttgccagattgccctggcaatggaaaatggaaaaatattccatgctcacggataggaagaatcagaatgttgaataggagtggtgagagagagcatccttgtcttgcgctggttttcaaagggaatgcttccagcttttgcccattcagtatgatattggctgtgggtttgtcataaatagctgttattattttgagatctgttccatcaatacctcgtttactgagagtttttagcaggaatcggtgttgaattttattgacggccttttctgcatatattgagataatcatgtggtttttgtcattggttctgtttatgtgatggattatgtttattgatttgcatatattgaaccagccttgcatcccagggatgaagccaacttgatcctggtggataagctttttgatgtgctgctggatttggtttgccagtattttattgccaatgtgaaaatcttcgttcatcagggatactggtctgaaattttctttttttgttgtgtctctgccaggttttggtatcaggatgatgctggtctcataaaatgagttagggaggattccctctttttctgttgtttggaatagttttagaaggaatggtaccagctcctctttgtacctctggtagaatttggctgtaaatctgtctggtcctagactcttttggttggcaggccattaattactgccccaatttcagaacttgttattggtcttcaggaatttgacttcttcctagtttagacttgggagggtgtatgtgtccagaaatttatccatttcttctagattttctagtttatttgtgtagagctgtttatagtattctctgatggtagtttgtatttctgttggatcagtggtgataccccctttatcattttttattgtgtctatttgattcttctctcttttcttctttgtctggctagcggtctattttgttgatcttttcaaaaaaccaactcctggattcattgatttttttgaagggtttttcatgtccctgtctccttcagttctgctgtgatcttagttatttcttatcttctgctagcttttgaatttgatggctcttgcgtctctagttcttttttttttttttttttttttttttgagacggagtcttgcactgttgccggggctggagtgcaatggcgtaatcttggctcactgcaacctccgcctcccaggttcaagcgattctttttgcctcagcctcccaagtggctgggattacaggcacccgccaccacgcccagctaatttttttgtgtttttagtacagacagggtttcactatcttggccaggctggtctcgaactcctgacctcgtgatctgcccacctcggcctcccaaagtgctaggattacaggcgagagccactgcacccggccactctctagttcttttaattgtgatgctagggtgtcaattttagatctttcctgctttctcttgtgggcatttagtgctataaatttccctctcaacactgctttagctgtgtcccagagattctggtatgttgtctttgttctcattggtttcaaagaacttatttatttctgtcttgatttcgttagttaccctgtagtcattcaggagcaggttgttcagtttcaatgtagttgtgcggttttgagtgagtttcttcatcctgagttccaatttgattgcacttggtctgagagactgtttgttatgatttccgttcttttgcatttgctgaggagtgttttacttccagttatgtggtcaattttagaataagtctgatgtggtgctgagaagaatgtatattctgttgatttggggtggagagttctgtagatgtctattaggtctgcttggtccagagctgtgttcaagtcctgaatatccttattaatttgctgtctctttgatctaatagtgacagtggcgtgttaaagtctcccactattattgtgtgggagtctaagtctctttgtaggtctctaagaacttgctttatgcatctgggtgctcctgtattgggtgcatatatatttagtgtagttagctgctcttgttggattgatccctttagcattatgtaatgcccttctttgtctgttttgatcttcattggtttaaagtctgttttattagagactaggattgcaatccctgctttttttttttttttttttttttttgctttccatttgctggataatattcctccatccttttattttgagcctatgtgtgtctttgggtgtgagatgggtctcctgaatacagcacaccgatgggtcttgactctttatccaatttgccggtctgtgtcttttaattggggcatttagcccatttacacttaagattaatattgttatgtgtgaatttgatcctgttattatgatgctagctggttattttgcctgttagttgatgcagtttcttcatagtgtcagtggtgtttataatttggtatgtttttgcagtagctgataccagtttttcgtttccatgtttagtgcttccttcaggaactcttataaggcaggcctggtggtgacaaaatctctcagcatttgcttgtctgtaaaggattttatttctctttcacttatgaagcttagtttggctggatatgaaattctgggttgaaaattcttttcattaagaatgttgaatattgaccccaccctcttctggcttgtagggtttctgcctagagatccgctgttagtctgatgggcttccctttgtggttaacctgacctttctctctggctgcccttaaccttttttccttcatttcaatcttgctgaatctgatgattatgtgtcttggggttgctcttctcgaggagtatctttgtggtattctttgtattttctgagtttgaatgttggcctgtcttgctaggttggggaagttctcctggataatatcgtgcagagtgttttccaatttggttccattctcctcgtcactttgaggtacaccagtcaaacgtagatttggtcttttcacatagtcccatatttcttggaggctttttttgttcctttttcactctttttttctctaatcttctcttcatgctttatttcattaagttgatcttcagtctctgatatcctttcttctgcttgatcgatttggctattgatacttgtgtatgcttcatgaagttttcgtgctgtgtttttcagctccatcaggtcatttatgttcttttctaacctggttattctcgttagcaattcctctaaccttttttcaaggttcttagtttccttgtattgagttagaacatgcttctttagctcggaggagtttattacccaccttctgaagcgtacttctgtcaattcatcaaactcattctccatccagttttgttcccttgctggtaaggagttgtgatcctttggaggagaagaggcattctggtttttggaattttcagcctttttgtgctggtttttcctcatcttcgtggatttatctacctttggtctttgatgttggtgaccttcggatggggattctgagtggaagtcctttttgttgatgttgatgctattcctttctgtttgttagtttttcttctaacagtcaggcccctctgctgcaggtctgctggagttagtttgctggaggcccgctccagaccgtttgcgaggttgcagaacagcaaaggattgctgcctgttttcttcctctggaagcttcatcccagaggggcaaccaccagatgccagccggatcgctcctgtatgaggtgtctgttgacccctgctgggaagtgtctcccagtcaggaggcatggagtcagggacccacttgagaaggcaagtctgtcccttagcagagcttgaacgctgtgctgggagatctgctgctcctttagagctggcaggcagagacgtttaagtctgcttaagctgggcccacagccacgcctttcccaggtgctctgtcccagggagatgggggttttatctgtaaacccctgactggggctgaacagctgataatcttgttgagtgtcacttgtatgtgactactttcaagattgtctttaggcttttaatatttgattatatggtgtctttgaaaggacctcttccgagttgtcctacttggaattccttgagcttctgggatgtattccaattcatgcctttcagccagtttggggagttttcatccactgtcgtatcaaataatctttgtctctttttctctctgttttctttctgagtctcccatcattcctatattggtgtgcctaaagaagtagtttaggctgttttcactcttctgtattctttttaactttttctcctctaatttttttctcctctgactcagtattttcaaatgcattatcttcagatttgctgatttgcctgcctcctcaaatctgtttttaaaccactctagtgaaattttcaacttggtcattctatttttttcagctccataatttctgttggagtccttcttcatttctctttgttaataggctcattttgctcgttttccagattcacgttagttctttgtgctttttgttctttcagcataggatagttttctttgtctagtaagtccagtgtctgtctagtaagtccagtgttttcctctgggaaagtttctgtcaattaattttgcttctttgaatgggccaggtttttcttcttttttatatgtctttgttcttttgttgagaattaaatattcgagaagtggccacctcttccagtctttgcagactgactctgtgctagggaaatctttaaaagattggctgggtatgttctgaccctgaaaactgaagatcatcttagatcttttctgaacatactgtcttgcctggacctgtgtgtggcttttttccactccccatggcttctattcaatgtctttattattattgttattattattagttgtgagccagggtcttgctctgtcacccaggctaaaatgcagtgccttgatcacagctcactgcagcctcaaactcgcaggcttaagagctccttttgcctcaggctcccaagtagcagggactacaggcatgtgccatcatgcctaggtaattaaaaaacatttttttttttgagatggggtcttgctacattgcccaggctggtctagaactgagcttaagtgatcctcctgcctcagccttccaaaatgcttggattacaggcatgagccactgtatccagccagtattacctatttttggtttgcagttccttaatgaccactgatgtgtgtatttttatgtacttgtttgtcatttgtatagcttccttggagaaaggtctgttcaaattcttcacctattttttgattggttgtttgcctttttcttgagttgtaagaaatctttatatattctagatagtagatccttattagatacatgatttgtagctatttctcccattctgcagatttttcttttcactttcttgctgtcctttgatgcacaacagtttttaattttgatgaattccagtttattattttcctcgaattgttgcttgtgctgttggtgttaacatgagtttgtattttttttattaactgctgaatactaattaatatatagttatagaaaaacagatcgttttcttatttagatgcttggaaatgtttttaatgtaaggacactaacaagctacatgcctttgagtaagtctaactgtggttgccctaattttactttatttttatttcttatagagatagggtcttgctttgttgcccaggctgaacttgaactcttggacttaagctatcctgcctaggccatctaagtagctgggactacaggtgtgtgcctctgtgtctggctgtcactcccattatatgaagcacaaactgatggatgagatcccatcacaatctgatgatctttttttttcttctttaattgtttgagatagggtcttcctctgttacagtggcaggatcatagctaatagcagccttgaactcctgggctcaatcaatcctccctcctcagcctcccaagtagctgggactacagacatgccactatgcctggctaattttttatgttttgtagagctggagtcttgctgtattgcccaggctagtcttgaactcctaggctcaagtgatcctcctgccttggtctcccacagcactgggattgcaggcatgagccaccacacttggcctgataatccttgattttatgattctcttaactgctaatagtaattcatatacgccttcaccctgagtttagctacattttcctggcagtcttgaaattgcactgtatttaattttttaaaaattaactgccctattttagatgtatatgatggtacttagtttctgaagccttgggttcagtgtcctcataccagttctgtatagaagtgtttgtctcctcacaccttccccatcattgagcatgcccttaaaaatggaagcaaaatgttgctaaattgctagatgaaaagaatacttgttttacttgccattcttttcattactaggtaggctgaggacttttaaagtgtttttagcctcttttgttttccctagtgagttttctttgttttgccattttgtctgtgtggccatggtatatatttcattttgtatgaggtttttagcaattttaataatttgtcatatttttgtcagatctttgccctacctttttttgtttgtttgtttgtttttgtttctgaattttcttcttttaagtagcaagctttaaactgttacatggtcagtgatctacttttccattttggtctcctttacgtgattggtgaaagtcctccccattcagaggtcagatgcatgtgtgtgttaatttaattctcttttgtgcttgtttaccatttaactcgtcgaccatctgatttatttgttttctttttattgaattatgagaattctttatattttctgggtgcaaatcagagacagcatttgcagatattttctcccagtgtgtggctttccttttcattctcttaacggtgttttctgaagagcagaagttcttaattttgattgtttactttacacattttaaagatctgtattgtgttgtatctggtgttgtatcttaagaattctttgcctaacttaaggtcacaaagattttctcctcttctaaaagttttatagttttatattcaagtttgtgatccattttgagttagttcttgtggttggtgcatggtatgtacttttcttatgggccaacaaatttatttgtaaaaaattcaaagaaatgattttgcataagaaaataacagttctcgcccttcgtggtgtgttaaagaggaaggaatgctctcctctgtgtagatctcttttcatagatgcaagatagtacaccttgcaaattctgctgtcattgctatcaaaattgctttcaaaacacttaataaggaaaatgcagtagtgtgcataaatatcttttgtctgctttttaaatcttaaaatagagcttgcttctaggtgaaatgtacactgaatattcttggagtatatcagaatcagcccttgtatcagttggcctaaaaagtgaatcttattttctttctcttcaaaaactaatactgataaatgtgttccttctgggtaggaggttgtattttttaatccaggaaggatgaatttagatatcattgagttatggaaaagctttaatttaaaaaatattatacttaatttcacaatataaagttttaaatgaacaatacttcacgttaaaatattttcaaaggtaaatacttgattgaataccaactgacagtttgatgatctttttatagcttattagttttttaaattgaattttaatggagactcaggctgacaaaggtcaaaatggtatggagacctccagagcactgctttgtatgcctgaaaggcacctactcaacgagaagccagcagcaactcagcagggtttatttttattagtatagcttagctgggatagaacaaagctggatttcagccaagtgtggttctgcaaacagctttgtcctccagactatcagttaactaatgggcttacaggctcagatacctggttggtcagacactaaagctgaagccttggcacctacaatgatgtatctgaacctcccttaggtgagagagttgggttcttaagccacatgcccctaaagtgatggtaccattaaaactaggctaaggtctggacttgttctgtcagtttggaagatttcattcacttaaggaaggaaaaattcccctctaccccggtttttctttttttctttttctcttttagagacagggtctcactgacaccctgactgtagtgtagtggtatgatcatagctcactgcatgcagcctctaactcatgggctcaaccgatcctcccattttagcttcatgagtagctgggactacaggcacacgccaccacaacccagctgatttttgtatcttttttggtagagacggggtctcaccatgttgcctaggctggtctcaaacccctggggtcaagtgatcttcctgcctcggcctcccagagtgctgggattacaggtatgaaccaccatgcctggcttaaattgtctttcttgtcttttttcgttgaattctttttaaattgtgctaagatacatataacataaaatctcctatcttagccattttaaaatgtatggttcagtagtgttaagcatatttaaattccaaaactctttccatcttggaaagctgaatctgtatccattaaacagtaactccacgtttctccctcccctcagcatctggcaagtgccattctgctgtctccgaggattcaaccactctaggtacctgttataagtagaatcataccgttcttggttttatcgagactgggttattatcatttagcataacgtcttcaaagttcatccatgttgtggcatgtgtcataatttccttcctttttagtgttgaataatattcaattatatgtatgtctcacattttgtttatccatttatccatcgatggatacttggattgcttccaccttttggctcttgtgaatcatgatgccatgaataagggaaaggatataaagtttttcttaatcttcttaacactttgatgccctctactattactactaggcactagtagatatattaatactgttggtaatatttggaattctggcatttgcagtttccttggtgtcccacagagccctatgagttccaccgtgcatgttccctgaacaagtttgagatccagtctgtagatgggaagtttcttaccaacactcagattctcaggttctctgggaatgttggaggtcagacacaccagacccctgttcctgcagggcagtgatcagctggagtggaggagtggcctgccttccctgatatatgtgttcagcctaccagtcagcaccatcccatattgtcctacagctgacctactgccctgttacccacctgcttggccccaaagcctgttgagttggcataatgtatttcagagaaaagctctcaggtaatctgtatggcttataagggaaacctgcagtcctttctgaaaggggagctgtgaatatgactgctttgtagaaagatgtcttaggattctgggtgaaaatttttaattcccctcatgtaggaatgtcacagagtgtacctttttgacttagtattttcctagtaaaatacacctttcttaagaaaatggctacaaagtcagatgcatgtaaatgctttcagcaagggtttgttgatcatctgctttaggctgggctctatgttaggtgcctgtggattccattctagtacctgtgttctcatagaattgaatcctggtcccccatatgacttttgatgatattcacactgttaattccaataaagacagagtagacaaacagaaactgtacatgaaaggaatagcatgaagttgtcgatttttaacaagtattataaataatgaaacggtcttttcactttcagatgagaattttcccttttttttttggttcactagatagtagttatcctaattcagaagttcaactaatgtaaatatccattgattgagaaattttgtatttttgttgttttcagttacttgttgtagttttctttttggtgagtcttatgattggctttattgtaatagaatggaacacaaactttgaaaaaaaaaaaaaaaggtcttgcatttttgtctagactatgcagctacccagtggatcgctgctgaatggaacaggaaagtgacagatccttgggcctaatgtatcactgtgttgtggaactggtcattcattagaagaggtccctgtgtatcctttctatcaggtccttctcatataaatcttgctgcctttgttgcatctgttagacaaatcagttcgttgcattgaggacacttgaatattttacagttttttttttttttttggcaaatcttgaagcttgtgactatctgaaactcttttaataccttttgaaggatcagagccctgcgtaccccaggaatgcacaccgtttttttgaaagtgtgctctttccttttgttcctaatcagtaattatagccccctaatggtacctctggagcagatgcagaagtcaaagatgcagaaggaggaattagctagtcagacacaggctcgcagcagtggtggggctgaacacaatagcacagggactaatgcagttgctgctggaagcagtttattcctatcaccaaccctctccattccttgtatgtatttccattaaatccataaatggggtgctcctcctcctttaaaccatttatgttaaaagaagcttctgggccagcagggctgtttgaattttgtagaatggtgagaaggccaaaagaaaaagactgaaattgacacactgtccctcttagtgcctctgcagggactgaactcagtggctattatgtagctacaacataggcacactttcataagtattgtctgtgtttctctagtctgggtgttttccttgcgtattagttctgagtgctaaacaacaacaaaaggtgtctttgaaaagataaggtggcaaacattgtttaacatacctccttgagaaaagtttcaatattttccccaagaatgatgtcagagttaggctttgctagtgctgcactacgtgtggctggtaaaaaaattgttagtggaactctacttctgtaagtgttgttcttgtttgtcccttgcagtgattttattagatggtgggaaagtgtttgtattaacccttcagcatcactgaacttggggtatcccatttctgtatttatgttacacttcctttgattgaaccattattttctaattatttttaatcaagaagcattaaaataaggatgaaagtaaatagattaaggattaccagtttcctaaatggaacctgactaaatgtaaaattaagtcaacacacccacacagagaattccacgaagctaagtagcttttgaatacacaactctgtatatgctagtgcagtggtcaaagtgtgagatggaggacctgagaccctttcacgggtccatgagggcgaatgtaatgtcataataatactaagattatttgccctttttgctgtgttgatatttgcactgattgtgcaaaagccaaagtggagaaaactgctgatctttagcatgaatccaggtggtagcaacaaactgtattagtagtcattgcattcacctccatgcactcaatttaaaaagaaaatgtcagtttcacataagaatgttctgatgaaacagtaaaaattattaagtctcaactgttaaggacatctttttaatatactgcatgatgaaatgggaagtacatgtgaaacatttttgcataaccatgtacaatgatcatctggttagctgaaggaaaagatcctgtgtatagtgagactatgttccagggctagaaagaactgcaaagaaatcttgaactgcactgtttgttgttggtagtatattggtggcgtcagtttggcgctattttgtgtttattgtagatagagcaccacatggataagtatattaaaaattttgggaatcgagggttttccttgtggtggaacggcgatgctaatgtgagatgagggagagatgagggagcagaggaagaagcctccgtgttggatttgaattcagggtgtcaccatgaacttgtgatttacctatttaaaatatccttgctctgtccaaagagcctacaagcagtgatacttaattaaccgagatgcattgtgttctccgagcttggtttttaaatgccatttcccagtgaaaggtttcagggctccttggagaaatggctgatttgaggtctgggacaggaaacatacaaggttagcttgccatgcttgtgtcagaaagcaaggaggtgttgaaagacccttagtgccatgtcagaaagacagaggatgactttccaagaagctcccaatggccaaatttgggacagtcagcattatgagagtatggattataacacatttaataataatttttagaaatccatggatatacatggtagaagaaaagggggagagtgagagaaagactatattatacaagaatgccagctactttgtgaaggagagagaaaatctgaaaatttctcttttgcagtccctaatgtaataattcattcaagggtgccctggctcatgcctgtaatcccagcactttgggaggctgaggtgagaggatcacttgaggcaaggaatttgagaccagcctgggtaacatagaccctgtctttattaaaataaaaaatataaaaaaaaagaattgtcaatggacgctgaaactgttgagcaagatgttatcagggaggctattcacagaatctcaagtctcactctgcatattccttattagtgacaaaggagaaagggtgttttttgttgttgttattgttttttgttttgttttgttttaaaagcgaagaacaaatcaggctgattccaccttaacttattgaccaaacagcaacatcactaaaaaaagagacagccagaccttatgtgctttccaaaggaagaacatagcacttcctaaaaagtagtcttggcaaaagcaagccaactagaagtaaagcctccggattcaactcccaaattgtaaacccaaatgagtctgttaaacaccaccttggggatgcaaaaaaaataaaacttcagacttggacagactccacagtcaagtgacccagcttcttcaaaaataaactgcaagagaaaagagataaaggagtgatgagaagggatttaagagccatgttgatcagtgtgaaccttatttggatcatgatgcagataaactaagtttttaaaaaatgaggcagaagaactgtgaatacagactgcacatttgatgatgatacagagtgacatgatactatgtctacagttgcctcacaataatttagaagaaggggagttgggtcgggatccaggggaagcacagttagccttgggcagataattacggggaggatcaatgtgtgctcattacaatatcttcccatctacttttgaaatatctttgaaagtttttataatgaaaaattttttaaaaattactaattaatagtgggataacttgacattttgtgcccccttatgcaatgcattgaggagtacatgtcacctatgtagaatggtgacaaaaatacataacctgaatctaatcatgaggaaacactcagataagctcagaatacatgacattctacaaggcagttgtcatggtctatctaaaaagaaagtcagtgttgtgaaaaacaacaaaaaacagtgtcataaaaatcaaatagaacagttgcagatattaaaatatagagttacagtaaatcgtactattgaattaatgttaattattttcggtacaattatggttttgtggttctatgggagaatgtccttatccgtgggagatatgtgctgaattatattcgggccaatcaatacaatgtttgcaaattactttaatcaatgtgtgggaatatatggattaggttggctcatattaaattgctattttcctaagttaaaaacagccaaatatcagcaaatgcccatggttcaacctaatatttgttgaaacagagaaagaaagcaaatgcagtgaccaataatgggtctagataaagaatcaacaggtgtttgtactattttttcacatttctgtgtgtttgaacttttttaaaacaaagaattgggagaaaatagtcaacttacaaaaatgaactccagcagatacatatttgtggattaagtgtgctgacattgttctctctgggatcaattatcccctaatagcatttgaattctgttagaattaatccccagctacttaagttgacttacaatatagaaaagaagaaaagctacttatttcattgtatgaactttctactttctgaatcagcctatgacaaagaagagaaaaataaatagtgtaggtgaacattaagaaaagtgcttaatgatattttatggcatcttttttatgtagatgacatttaaagatgcatccactgtaggagaaaaaagagatcattggttcttagaaacaatttttctttttgtcaagagatcaaacatgtcttctctctggcctggttttaacattctctgtaaaatagggtgtatatctagaattttaagttttatctcccccacccaccccacaccttattttgccatgagttcttagctgaagagtgttttgctgagggttactggggacttctgggcaaccgtggcagttggatgaagtgatgagatctctcctcccctccagaaaatgtccctaagtgattagcaagaacccctggtttaatcctgcctcttttgaatccaaaacagatccctaaagaagtggctgacatctttaacgcccccagtgatgatgaagagtttgttggcttccgagatgatgttcccatggaaaccctctcgtcagaggagagctgcgatagttttgactcactagagtcagggaaacaggtatggatgattccttccaagcagatgtgttcatctggaggcctgaatcttggtttggatgttcttttatttgaacatggtgtgagattggtgatatcagttcattgtctagcattttattttagaaacattatgtctgtgtcttcctgttttaaaaaactggtgagagaacctcgttcactttgctgtgttaatccttccctgtaccataattcttttttttttttttttttttttttaaataaagggacctcacatgatcaagtgcattttcttggctgccttggggctgtaacctgtggcgaggctgtgttcagggtcttcccacagaggcgaggctgcggcgaggcatgagggattgtgtggttacggggagacaattacacctctgtggtcccgtggtgcaattctgttggcatgtcctcttggaattgctggggagagccttattcttgcgttaattactttgatctctagcactcacaagttagagttctctgacaggtagattcctggaggttcacattgtgtcctagtagtagaatggccaaaatctctacccttcagtggcattttcttctgagttaattgtggcactcaaaattcctcattctgccttgaccatggcctctccaaaaaggcagcaaattaaacccactttgcttccactgggcaagtccaggaagggaagcagttaattatatgtaagtgaagtgcctgcttaattacgtgggccactgtaagttctggcctggtgggagctgtgctttctgagatctctggaggctccctggtctctgtcgtcctcatctcatttggcatctccacagcagttgaccccaccagtagacctccttctaaccacctgggtttcttcctctctgttacaccttttgctctttgttattattattttctttctttccaagatggagtatcattgtgtcacccaggctggagtgcagtggcatgatcttggctcactgcaacttctgcctcccgggttcaagcaattttcccagcctcagcctcccgagtagctgggattacaggctcccaccaccacgcctggctaatttgtgtgtgtgtgtgtgttttttttttttttttttttttttagtagtgatggggttttgccatattggccaggctggtctcaaactcccgacctcaggtgatctgcccgccttggcctccgaaagtgctggaattagaggcgtgagccactgtacctggcctgctttttgttactgtcacttgttttccctgttcgtgtccctaaatgcagatgttctctaagggtttgtcttcagtcttctcacttagtgaatcttgtctgttgtcctgctttgagctgttactgtattcttttgtggagcttgtcttctctctccagccccaggtggtttctgactaccagttggactggtcctggttgctaagggagatctgaaactcacttctccttcccttggttgtctttctggcttccccctttccccatcttgatttccatcttttgttcttggccttccctcccctcttccatctccttgactcccgtccaggagttgatgaaacttctgctgtgttcctggtgtccatccttcccttccctctgcagctgccgtagccctcgtagctcttacccgaatgctcatcccttcctactaggatctgttataggattgacctccggtcagctcctcccttagccctccatctgagcacagtcaggcggtggggagagcagagcctgttggatccaccttgaggagcatttgagcaaggcagaacatgtctaaagggccgagcacagagcctggcaggcaccgggcattaagaaacagaacagctgcttctgctgctatgatgactccttttgtagtcaggtgtgttctccccagggaggacagtgtgccaactgcttttcatacagatactgcatttaatccacagacctccctgggaagctgcagttttgcaagtgatgaaactgacgttcaggaaggtgtaatgacttgcccaaggccccacatctgggaagtaccaagctgggatgttccaaatccagggccaccacttctcagcctcttaccccgccgggtctctttcctacctgctatgctgcagggcacaggaactgaactgacactctcattatccactgttctgccctttctgcccactggtccatgctgttcctgcctatctgtgctctcaccatttttctagcctctaccgtggctcacatccagttatgctacttcttccatgaagtcttactggattttctttccctccgtgtgccatattgctttgtatcccttagagcactgaccctcaccagggttattcgtggacctgtctgcctccctgttagattataaactccttaagaaggggagacctcatacttgaatggtgctttctagcttccctggctctgacttttcgtcctcatgtattgttcctttcctctgatttcaagcatccaacaccccacctgactgtatacagtgagcacggggggtgttgtttgctgggtgcagttgaaatggggtgcttgtctggctgtctggttcaacaggccattgctctctggtctgtttcttccatgtcacatggacttcaaaataagtttatccacctatgttagcttctcctctgatgtgttatttgcttatggtcctgatcatggtagatgaccaaggcctatagcatagcacccagtattgattttgaagatgaatgaaccagtgccagagagcaatcagcagtgccagggtttctaactcagaatgcagtggagcagtgtggagtggagattggcatcatacagacccacatggaaaacagtacttacacactttggagtaaggaaactaaagcacaggcctcagttcaggacaatggtaagttgtttttctctatcaggactgaccatcaaagatggtaatctctcccaagatgcccattgccctgggaggccagcacacaggatcaaaatagccagaaaaactggaagatgggaactcatagcttcaaggcttgccctgttcccttcaggccctaggcaggggctttaggtagttgatgaaatttgcacacagaaataccactctaaattagcctgcaggggctggcccaaggctctgtgagccagatgtttcttgcactgagaggcctcaggtgcatggtgggtttccttagcagcagctgtgtaccattcttccttaataatcaagccctggctgcttctctaccccgaccccacaggctcatgatccattttaaccaatagagagaagctgcatgaacttgcacacagtatgtgtatgctaactctggtctcccttaaacacgatttgaatttcactttaaagaaacttcccttttgtgtgtgcaattttttttctcaagcagctgcactacagctatcaacaaaggaacaaagtaattcagctctgagcaaactcactccaattacccataataattcataggagacatttttaagcttacagaatgctagatgtaggcatttctttctgtgtgcccctgtaagtttttccacttgtctattatatctatctttccccagagatatatgagctcaaagaagtatataattaaaggcggggaaacgcagtggggtagatacagattccccgccaagtgtggtgttacaaggggtcattgctatatcagagatggggggaagagacgtcagaggaaactggggacagactctagtcttgatgaggtgtggcgggcttgcagggggctggtctcgtgggtctccctttggcctgcagtttgttatttcctctttctttcaagtatactattaagagagttgggtttccatctttgcactatttcaaaagaaaaagtattagaaaatgccttttcttaaagagtcacattgcatctttccttctgctcacttgccacctagccatggttgttcacctctcacctcctgcacgagagaaattcctgggggtgaccttgaatgagctttccatcaggcccccatggtgtctgctcatggagcaagtctaggctctctggtggtgggcggtgggggctgagagaggccccagccttttcctacagagaagctcgctgttggtgaatgggaggcatgctcacccacttggaggagactccggctttgaaaggctgttggaaagggaagccaacacgtgggagggagccaggttttctcctcatatcttctttccatgtgttttggttctatgtgaaagcagacgtgtctggttgccagctttggcaggagaagctgaattccatgagcacttaccagtcacattagaagctgattgagactacacccaatttttaaaaattgtctgtcttgtaggtctgaattttgtaagctttagaaaatgtgtatatatgtaatatatacgtgtacgtatgcgggtttttttgagagagggtctcactctgtcacccggctggagtgcaatggtgtgatcttggctgcaacgcaggctggagtgcattggtgtgcagctcactgcagcctcgacctcccagggttgggtaatcctcccaccttagcctcccaagtagctgggactacaggtacatgccaccagacccagctaatttttgtattttttgcagagatgaggtctcactatgttgctcaggctggtcttgaactcctgagttcaagtgatctgcctgcctcggtctcccaaagtgctgggattacagggtgagccactgtacccggccagtgtttttttttttttgtggtaaaatacacataacatgaagtatatcatttcagctgtttttgatgtgtacagttcagtgcattaagtacattcacattgttgtccatccattttcgtcatctccatcagaagctctgtacccgttcagtagctcctcattctacccttccctggtaacctctattctactttccgtctctgatgtatgtgtgtctttaatttagcaggatgtgcgctttcattccaaatacttcacagaagagctaagaagaatttttatagaggacactgactcagagactgaggattttgcaggatttacgcagagtgatctgaatggaaagactaacccagaagtaatggtaataattacaacaggaagggatgtgggtggtaacgtttttaatcctgtttctgaaagagttttacttgtaagcagtcacttcacaagtgaaaagatttttcttacatatttatcttacaagcaattaacataacctaaaaaaattgctcctggaaggctaatccctggtccaccagtccattattctcttagagaaaatccattcatcttctcctcgtgccttagggggtttttggggatgtgtcccaggcgtcctttattgtccttctcaaagaatttatctctcttggccaggcacggtggctcatacctgtaatcccagcactttgggaggccgaggcgggtggacctgaggtcaggagttcaagaccagcctcaccgatatggtgaaaccccatctctcctcaaaatacaaaaattagccgggcgtggtggcgggcacctgtaatccaagctactcgggaggcggaggcaggaggatttcttgaagccgggaggcagaggttgcagtgagctgagattgagccactgcactccagcctgggtgacagagcgagactccatctcaaaaaaaaaaaaaaaaaaaaaaaaaaaaaaaaaaaaaaaaattatctcaagagttccttaaacctcttttatctaaaagtttatcttagatgacaactttcttgagatactttcttactgtgtgtgaagtgacagtttttggtttgaagttaatttggcaaaaatttggctgtggtacaaacttggtgttccccatgcattgtggatttggatttgtcatgctttttagtgttaaagatgacccaggcctgcctggattctggagggaagtctactctcagcacttcctatgaacagacttgttagttatttgtttgttttatcctgcacagttaggctagtttactgcccactcgtgtttgaacctgaaggtaactttaaggcacagccttcggatttaagtgcagaaatgttttctgctaaaaatagcatacatttatgcaaaaaataaacatgctactatcttcttcagtatgaagatggaacgtagagtttacgcctcttcacagccagaagctgctaaagactaacttttggcagagactgtgtagaggtataaataagccgtgactcctagcctgccatgtccctcacttgtcctaggagagaatgtagagcataaaagcccgcatggtaggctgcttcgtttgatagtgattttttgctatgagtagcaacatagagctgtgccagcctggaggccccaggtctcctttggctttctttgcagaagctgtttgtgtggcagttccatcagttctggccagcaagtccctagcttcttgccagcacgatattaagatgcttctaaaaccctaatgggcatcatcagttagcaatgtacttattttctgttctttagtgaagtgatgtctggttattcgaagcatttgcatttctagtgagagaaagtgaattaccccagaagtcttccctcccacctgcccccaagtctatggactgtgtgatgtagttacatagatcatgatatagcttacagttcagcacaggcccttgcaaattttattttagaatccagtgagaagaaaagcattgttgcctcccagcccaccctcctgcccacccctgtgggaactggcgaacctatctttcttgataatgggacattgctgtaacttggtttccaggggtctgctggccggatgcgaaataaccacatccatgtactacacttgtgctcttctcttgggtctgattctgggctgctgtgtaccatttgttctttccttccttcaggcctctgtagtgagctgttccacatctggtaaagagaggcctgtcgatgatgaggatggtagataaatggatcaaaactgaagttcttccctgacagtgtcccctgaaattgggttcctttgcagtacaccattttgaattctgaagctattaatatgggaagttcagggtattaaaaaatagataaatcagtgccatatagtcttactcctcacttggcttggtgtggatataccagggttggcagttatctgcgttttttttctccctgtgtcttatttctaactttagtccaacgagagtttggggttgatggtcgtcaccggggaggaagcagagtccctgaactgatcctgggtccgtatcggtgccattccgtgttcttggtagattttcagaattcccagataatggttcccaaagttttctagcttctggtcatggaaggatgcccagaagacgtcctagatcttacatacttaaacctgtctctgtaccactgctaagagtcccgtcacatccaagctgtcacctaggtgatgtatccctgttactgccttccatatttactgtgttctcacttgtaaaacagagcaatgtttgaatgctggagacctctgccatgtggaatttgaaaatgtcgggtgaggatttcttgagttgactgagtggtgttttgctacaacctgtagagctttgtgacctggtttcacctcatggctctgagggttccagagaagggaaaggtgccccttgactgaggacgcagtggcaggtcatctgcctgtcctgggtcactgccctgaggtgcagtcagctctcccgccctgttattcaggagtctggttcctgctatttagaggagaccagtcagcatttttcccccgttgcgtcctttcctgtctgaagatcacatctgtcatgctgctgtctctccttttctgtgactgtctctcctcttgctggtgctccctggttgtcccacggtggaggaacccaccctgtcagtgttttgcttacagccctcatgctctgaatggaacccatttctgtcgcgggtatgatggtgcacagttcagtagtaggttgcctgctctctgattttattcatcaaccaatttcttgcacatttaaaggaaattcagagggaactcataatatgaaggggaagcttttcatttttcatgttttttctcataatgctgtcagttgttttaaatgcatgtcttttttgtgggtctgtaacagtgtctttgtgctttttcttgctcttattttattaggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatggtgaggcttcacggagggcgtcctgggagttggcaccaggctctggcagcagttgctgggctcccagaaccactttgctcctacagctgctgctgttgctttggcttctgtcaagaaaatatactctgggtattgtgtatccttttacttttccagaacccagagcaactattacatgatcagctctggtttgggaacagaaagagattccccagcaccatttttagcccctacatggtgccataatgctgcttactgttgaccaagctaagttctaagtatatagttgtgttggggatgagaggggctgaacaactagcccgttcccagcagagtaaagcaggggaagtgggatgtcaccaagtccactgagaagttgcaaggagcaggttgggcaggtagcttttcaccacagaaccactcttctatggtgaccagcactggttctgagacttctgaaggaatggaagaggtctaggaattaaaacaacctcaacagtgttaattcactctacattgtcttcattagaacaatgaatggaaccaggtgaaatctttgttacatatatttggtttttctgtatataatcaattactgttaatctgatcattgtagagaatcattgtttgcttcataattgtttatctacagtttttttttaaatagttctaccacttatcccttttagcattttggtaattttttaatcttttccttttaaaaaaagaatgatgcagtgatactgtatatgcaagcttatatgtctaatataaattacttacaaaaatggaatgcctactttcggattatttttatcctaagaaacatttttacttagctaagggaaattttcagcactgtatccatctgcatctttaaaataagctattttctttatgatttttttggtggcactcatataattgtataaactaaaacgaatcctaattaaattctctggcatattaatgcctattatttggtattattagttcacgtaggaatatcttcatagattactttgattgatgagaaattaatctatttaaagaatcagacttttggagttctaaataaccatcgaaataatctagttgagctttttcttttttgaacatcctgaaacttgagactcacgtgtgcaaaatgaattgtcccagggtcacaccgccttggattagcctccgagtcgggatcggaacctcatgctccaggtcttgatcattccaggactgttttcatagtgttgtgttgtccttatatataaggaataggctagtgttcattcatatgaatgatgacatcagcatctcaggtctggaggtacaatctttacatgtgaggttaaaagtataactgttgtgggttatataaactattcaagttaggtttcttatggtggcaaaatggaagacttgagataggtgttggatgacctaaacctggagccctatttttgtaagattctttcttttgttctgaacttcagcttgcccagttattggcggaattgaactcgatgccagatttcttcccagtacgaaccccaacctcagcttctgtaagtagaactccttataattataccaatactgatatatggtgatcagccaccagacggcttttattcgagagagtccccagttgtctctgtctgtgctcttgatttcagaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggtattttctgactaatacatgaattagtttttgtctgagctaccatccctccaaacgtgaacgcacgtcactgtcaccccagggctggttctgaccccgtgggtctgcggcagctgagaacttgcatttctctctgcttcccaggtgatgccattgctcctgagatcacactttgagaagcagccctggtctaagctggaggtcacagagagagtcttttatccaagccgagctgagaagcagctcatttgttaggaccctgctttaatctctgctgcaggcaataaagaaaagtgcagtgattcctccttgcctttctgttttaggcatgaggcgtttcaagcgctttcagtttggagggagcaactgtggacccatttgtgggtttggctgttcagtgtggttcacctctccacagagtttacagcaaagaaccaaaaaccttgagttcctcctttatgattgtatcgccttgctgagaaggaagcttggcaggtggcaggagctcagtaaataactaaatgaaatggctgcagggaaatagaagagggacggggttaacattaatggtgctagatctttgagagtttaaaatatttataatttttttataactgctcaacacatctccatgttctgcttgtgttcattgtgcaggggaaatgccgggagtacagacgacgtcaccgtatatcttcttttcggccagtggaggatatcaccgaagaggacttagaaaatgttgccataactgttcgagataaaatctatgataaagttctggtaaagtatacattaattgtcattcttattgggagtcgaaggcattggtattgaaatctcacttgtttttaaactctatcagggcttatgccatctcaccaagggctcagagccaggctctgaattggagggtcaaaagtcagctgtacctgggaaaggggaggcagcctagtgcagtaattcccatctggacggcggtctctcttagggatgcgtagaatctgggggaagggaacggtatagtttaaaagggatttttatatgtaactgttaatggtttaagcatatagttttatgttctaaatattgaaaaaagtatatttggggggtaatataaccatagaaattaaagtttggcagaatatctttggtaggaaatgggttaaatttcttctaaatggtgatttagagggaggctttgcgttctgcattttttttgtgtttttctggatatgtaacgggacactgtcaagttttaaatttagttgccaatatttaaaaaaaaatagatctcacattgaaggtatccaggtctgcagagctaggctggggccgaggtgatgccacccaaggctcattgcccctcagtcacctgtcacctttcaggggctctgccacccctgcctcaagcttttctctggtctctcttcctgacagcctgatcatttcattccttctgggtctctgctcagcctcatctgacctaatatgtttctctggccacagacctgtgatggttacattctagagcagtggtccccaacctttttggcaccagggactggttttgtgaaagacagtttttccatggatttggggggcaggaaggggatggtttcaggatgaaactgttccacctcagatcatcgggcattagattcttataaagggtgcacaacctagatccctcacatgtgcaattcacaatagagggtttgtgctcctatgagaatctaatgctgctgctgatctgacaggaggcagagctcaggcggtaatgctcgcccgtccgctgctcacttcctgctgtgcagcccggttccaaacaggccacagactggttctagcctgggggctggggaccccggtctagagacaatgctgtggttcttaggaaaacagtcctgcttgattcgaggagacgggggtatttcttcatatacttggaaatgcacatggtggcatctggcctcattgggcatcagcatatccctgtgttcacctgctcactgccttccccctgtagggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggtaggaacagtgtttgcatttgttgtaaattgtattggtgaaggaagcaagctataaagatgggcctcctgggttctcactgggaactagggagctccagaactctggtttttcccttccatttgtatcttaaggctccagggaaaatgaaaaatagggattccttctggaaggagagcaagctgaccagtgaatagaagaattaatgttgttagattttccattgtcagagcaaaacttgcttacagtcctctagttttatgcaagtaatccctgtacctgtccttcagcaaagtgatttccctctgatttgttttgtttttcctgggccaggctgagagggaggtggagattgcagtatagagtgctctctgtgtgcctggcactgtgcaagctgtcgctcactctgttaccataaatttgtttaatcccatgaaataggtgtataacctctctcagctccctcggtaaaatgagacatagtatcatggtgagtaggcacgaccttgagcctggggcagtcctgctcccgagtgtgacctcttaggcagcagtcatggggtaaatatatggtcctcaactgacagacaaacaaactgctgctcaggttagtcattcaacaataagcacacattgaaagggctgaaattcataccttgatattttggaaaccttgtgctcctaaaccagggctgacatcctgggcctgtgacctgcatgctcgcacagggccctgtgcttggccaaatgcttgtgaaaatctccataatttttaagcaaggagccctaaaaggtgtcatttttcagtgtttgcatgtgacgtggggtgattcagccttcctgccttgtgaggagccccctgggacgtagactgaaagatgccatgtgattaaaggttggaggagaggccagctgagccattctggatccgaatcccagttcttgccagaccctgtagataatgagcgaagtgtctgctgtcatctctctgttaggattgggtgtgtcccccctgtcgtgggatctgcaattgcagctactgtcggaagcgtgacggccgctgtgccacaggaatcctcattcatctggccaagttttatggttatgacaatgttaaggaatatctggagaggtaagtaagtctctagcagcttacaaaacagcttgaaatcttgaggctgagcacaggagaccctctgggcaagtagttgttgccttcccgtgtgacttacttacttatataaaccacgagtaccatccattctgtatctgtttgcattggaaaagctcaggcctgatattttccctattagggaatcttctcctttgctagatttttcaactcaactccacgttgcctttaaccaaaatttctccttgaggtgtatgacagaaatggaaggaacaaacaaacaaggcaggctgaggggaaagacacagattatgaagaggcagccataatcctagtgcagagagagagttcagggcaagaggacagaatgtgagttacaagtttcatttatgtaattaataaactctgaatcgtggttctggaatgcgggagtgaggcaagtcatgcttggggcgtactacaccagagggtatacggatattgatgcataaattgtcaggatttcgagtgtcaggagatctgggttctggctttgtactcttagatgattgtggaatctctcaagcctagaatgccatttgtgtatttgtactactttaccaaatacttctcatctttttcccagcttacaaaaggagctggtagaagacaattaagaggaaaacaaacagaaccagccacctcaccatagagtactccaacaagacatgcataccattggtgcctaagaaagatttttttacagttgtgtttttatacagaaattctttgtagaaattactattttttgttaaagattgtttatatgcttacaaagatttctcaggaagacagcagagcagaggaatctatatagatgtatgcacagacctgtctgtatgctgaactttgttaaaaatatctgccagttattaaaaagcacagtttaaatggggtggggttaaagttcaggtaagtaagttagagagaaaacattgtatgatcagctcctgcacttgatctatctatctttggcttcccaaacagtaactcactccaggccaagtgtgccttagcacgagtgaccacagtttaatagaccacacacatcgtttaacctgctcttggtcattggaaatttacactgaacaaagtgcaattaactgtagaacagttttatttttattaaaacttgactgaacaaaaggggaccatcaacattgtagacactggacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagttagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagtaagttgtttgatgcaataaacattcaacattctggttttgtcat

SEQ ID NO: 647 - DNA, 60387 bp, Homo sapiens
gagtcaccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggtgagggggcgggcggcgggcaggccaaggccggagggggcgtcgcttgagggggagggagggaatcaggccggggggatcgtgcggaggggcgccatcggatggggcaaagagatccctgaaaacgtattgccgggggacggggacttgcaggacaagaaaaccgtgggagaatatgctggatgagagcaaagggacctgtaagggcggagggcaccgtcggtggaagcagggcaccgtcggatggaacggagggggcacaaaggtgcacaccgctagtggaggcccatagcagggactggcgagggaactgccatggggcaccgccggcggcaggcccaggggtctgggatgggaggtggggaggcgtttagtcctagaggcctgtgatgcttagggcgggggagccgtcaggctaagagagattgggaatcagcttttagaagaggaggggcttgcccgcctgtccgctggatatacggacaggaacgctgggccggggcgagggacccagtgggggaaggtggttggtgcagaacctgggaattccgttctccggtggggagcgcaggcagaccaggctgggggcatctaaaccgggaaggagagtgcgcggcgaccagatggggaatcggggtgcagatgagagtgctcgggaaccgacgggagaggaagtggggtcgcgctggagctgcctgtgcgcactggttgggaagagcccccatcatcttaggcctacgtgcctgaagtccttgctgggcgcggatcctgccgcctgtccgcggtcccggagtcagggaggaatgatgtcatcgctgctggcgcggagggaatggaagggggagggcaactcgggtgcaccgaggctaggcctaagggagaccatgcttgctggccaccgcccagggggctccctgacctcgcttgtctgtcaggcaaccgggtgggagacgtggaggcctagccagctcgtatagtgaggggggaagagagggaatgtctaggctgtgttcgctttatccccctggagcctgagctggaattggaaggaggcaaggtgggctacaaatccgaaagtgtggatgccccatttctctgagctgtgctggctggagcagagctgagttctccaagttctgaagttctgcttctgtgttaggcagggtggccagaaacaggtctacccttgggcctataaccccctggctgacagatgtgctttgtagcttcctgggcgagtaacctacccattacagcagccaagatgggcctcggcagggacccatcaccacctttttgtcacaccttttgagggatggtagagagaatcattagtggccacttagcaggagacaaaggctttttccccctttcatgactgcttagacagttctaagagccaaaacaaagaagttttacagaagcatacaatattaaaccggagagaggtgttgcaggactttttcctagcctcatgccatcattggattatttgggagccagaaaatcctggagagaagtccatcccatgaacttaaagaaggactttgggctggctgaagataattttcctttctgagttctctttctagctaacctggcttgtcaaacgagattgcccttccagttctaagcatctaatcaagaatcaaaatagagggtggatgaaggaagaggaggttcaagtgtgtcaggaaaaggaagcaatgagttgtttcttgtcacccatctggggttctcaaaaaggaaggaaatagctgttcaaggaaaggggagaagaaatagagccaccaggctctcagttgtccttggtgcttctgttattgcctgaaattctgaatagtggtttggctgggtagagaactcttgagctgcttccggtctgtgtggccctggagttggagaagcatctgtggcaaggaggcacttagaaaagctctgactgccttcagacccctttaactgctaaagtcacccttgtgcaagagaatacttttttttctttttttttgagacagggtccctctctgtcacccaggctagagtgcagtggcacgatcttggcccaatgcaacctccacctcctggattcaagcgattctcctacctcagcctcccaagtagctgggattataggcccctgccaccacgcatggctaatttttgtatttttagtagagacagggtttcgccatgttggccaggctggtcttgaatgcctgacctcaagtggtctgcctgcctcggcctcccaaaatgctaggattacaagagtgagctgctatgcccggcctgagaatactttattgagtttgagtgagagccttatggaaatagcaatatagtcatccctcatttgagggtcatagacattgccccgcttcctgacctctgtccccaggttgtattccagaggcacctcaaaaccctttaaataccctgtgtattgttgagaccagcagaatcttgtgtgatgtttcttcaggagtcttcattttggggcataaagaattaagatagtccagcctgggaaacacagtgagactccatctctacaaaaatatttaaaattagctcagcatggtgctgcatgcctgtagtaccagctactcaggaggccgaggcaggaggattgcttgagcccaggaggttgaggctgcagtgagccgtgtgcctaccactacattccagcctgggcaacagagcaagactctgtctccaaaaaaaaaaaaaaaaaatcaagatagcatatcatagaggtaaagggcaaaaaagagggcaaagtggctctttaagggtatttggataggccataaaaaccagggtcccaggctcagacttagctatgacctatttcatttttttgccatttattgagacctctaggaagtctctcctccttcctcgattgtttttccatttatgagatgaagacaaactatctctttaaagtttaaacaatagctcctcactctcccttctaaagaataccacagagacctgatatcattgattcagcaattggtttaccaaataattattgagcatctgctctgtcccaaatattaaactgagtattagggatagagtggttagcaacacagacacagatgtgaccctgcccttgagcccacagtgtgtcaaagtttgtttctcttgctcactctcttagtgtgatcctccactgagggcagagtaggggctgactcattaagcctcaagggagccaggcaacgctggtgtcatcatcattgcccctttctggaccaagctgtatggatagaggcttgtcacatgggcgccatcatcaaataactctccccatcccatagtgatgggaagaatccagaggccattgcctacttggaaagataaactctagggggagcacatctttatttttttaattatttaattgaaagagaaactcaggcttgaaaagaaggcctgggggcgtggcagaactgggagagaaggcagccagcagatctgggtgtttccaaggtgctaatttaagcattagatctcagctagtgggaggaagaggaggagatccctgccctgttattgctgctgctgttgtcacagctgcatggagcctcctgtctctggtgggagtttgcctgaaaggagtggcttccctcctttccccatcacaccaattatttaattggccttgttgcaactcagcagctgaaccaggcctggtctatccctgagagctccccagggtctcttcctgtctcctttattttttctctctcttttgagacggagtctcgctctgttgcccaggctggagtgcggtggtgtgatcttggctcactgcaacctctgcctccagggttcaagtgattctcctgtctcagcctcctgaatagctgggactacaggcgcatgccaccacgcccagctaatttttgtatttttagtagagacaggctttcaccatgttggccaggatggtatcaatctctcgacctcatgatctgcccgctttggcctcccaaagtgctgggattacaggcgtgagccaccgcacttggcctcctgtcttcttatgaaaggagtgagagctcctcttagagacctatccactggactccattcctgctgtatctatctttcagacaatcctgagtgtttctgagcacagattctcccaaagaaactgccagggataggcacattttgtgtgtcagctctgtgtctgagccatacacctcactgatctagagaagttcccagcagcccaaggctctctgttgatcagttgggttgagttcggtatattgtttgtatgagaaacagggataggctctctggccctattgtctgtctgctcagcttgttggtgcagccgcacagtctatgtcttctcttcggctgcaattggagaggaagagatttgttttaagaacaaatggagcttttaagcacttaattgtgtcaggcaacaccctgcctcctgtgctctcagggaccaaagagacttaaagaatggcaaatggcaccagatagggtctctgcacagctgaaagaaatgttactgtagcgtcactgaaaccaggttatcagttaactcatttgtttagttcacgagcatctactcagatcaggtactttaaggatacagggacaagtaagatctctccagtgggtggccaagagaaggatgggctcagatggctataggaaggtttttagatatatgtcaaaaagagtagagatcaatgaagtgtcatgagaaagagtgacaccctgctttgggagagggtgaggaatgctgagattctgactctgactacatgagcttgggaaggagtttcagactcctactgcttcctgacactcagggatggatggggatggtcaggacgggacattaattcagtgggtaggctacagcggctcctgaaagtggcggagagaacattataaagatagcaagtagccactgtggaaaactgacctatatatattctatgttctgggcaccttaagttgcctccttgtggtcagatgacttttcagtttaagggtggattctcctagtggatccatgtggctcatgacccagcagtatttctcaggctcctgggcagaggcacccttctttcctgccctatattacaaactgaggatcaggtttgttcaagcctgcagctccttactactcatctcctcatcaaacaaacaccaagtaagaacctattctctgctagatgttgttctgggctcaatagcacagaattttgctccagggagatgcacagtctagaactcagattgaggcactatagaatagtgagcactgcaagagaagaaccaggcccaggagcaccaaatgaaagcaggaagggctctcatcgagtggtcagggaaggcttcatagaggccctaggaactggccataggaagagtactagaagcttggcaaactgacaaaatgaggctaagccaagaaagggcatggaagaagaaacaaaggagtgcatttggaatgaatgaagagttataattaagggaataacatgatcaaatctgagtttaggttagtggtggatgagagattggagaagatgagattggaagttggaaaacgaatacagacctgggtgtaataattctgctaggagataatgaaggcctgcagaagcagagaaacacgatgggacagatacacagatactaataaggtggaataggcaagatatgatatctgttgggaggcggaatggagaggtagagaattaaggatgactctcaagtttgtggcatggacacctggatggaggaagagaccatcatcacctcgggaaactcaggagcccatgtaccttttggtctcagggacttcttataacagagaaggctgctgttttcctttgctctactgctgaagctacattcttggggttgtgaggaatccacaagtcctagaaaaccaaaggtcagagtggcatttgtcccccctctgcctcaaaagggctgctgagaaacacgctcatctgccagtgaatacttctcccctgcaacctgctttgatgaattcaagagaattggtggtagcagcaaggagccatagtgggttttgttgttgttattttctttccagtagcactttgatgaataaaaaataaaatcctttgttgtctgagtgctttatgttgcagtttctggctttgccttttaccatcgttctagtcaaatctatgggtttttttctgactgattgagctgggctctttcactgattccttctggaatgtatatatgtattactacatcactgcaagatgtcaaaatggaaaaggacacgtactttccttttctgagaccagcctgaaaagctgcagttgggtggaagcagagcccaaccgtttcttccaggcaaggtgtaccaaaggagcagaattctggggtgagatcactcagaggtcacttggcttctcagaggtcccagtgtggcctctgtgggtaggtgcttctgtggtagctggggttcaggctgagtcattcccagccccagctgcctgctgcccttgactgcctatatagcccagagtgagcagaaatggaaaacaggcttcttcactcaaacctgattagtctcagggaccctctcacctccttaaaaaggcaggtggagcctcgtgtctggaaagggaacatgggaaatttagcttcttgggcttagctgcttcgtgccttcctagagacctgggagaactggttcagggagctccagagcgtgtggaaaggggagaattgggctgaggcagataaccagaggtgctggttgaaggaagctagaggtgtggctcagcagggtcccaagtcattgtttcttaaataggctctgatgggaatctggctttctgggcaggagaaaggaaggaaggaaggaggggaaccagctctggatttgagtctgctctggagtttagaaattggcacatgatccacaggcctcactgtgggacagccaaatcaacttctggctgcagggagggactctggagtagggaagtcatctaggaaagaggcctgtagcatctggcctgggagagagggtagacacatgcccgcaggagtttcctcctaggctttacattctcaggagagagttcaagcaaatctgtacttgtatttgttgttattattgttattcagagatagcaaattgaggatcggatggtttggttattgaaggtcaattttaagtttctgtgatggcggtgaggtatgtgagtgtgcatgcaagaggggacatacagctatgaatggtgttttctgaatgaccgttccagccctaagtctaaacatatgacaagaggccacacccaggcagaaacaagaccagtgactgtggctccttgcctggttttgcctgatttagccatcagattcttggctgttataagcagagtacatcccatctatcgagaacaatacctgaaggagcattttaaggtttattgaattggccgggcgcagtggctcacgcctgcaatcccagcactttgggaggccgaggcggtggataaccaggtcgggagttcaagaacagcctggccaagatgttgaaatcccgtccctactaaaaatacaaaaattagccgggcatggtggtggccacctgtaatcccagctactcgggaggctgaggcagaaaattgcttgaacccaggaggtggaggttgcagtgagctgagattgtgccactgcactctatcctgggtgacagagcaagactccgtctcaaaaaaaaaaaagatgtattgaattaactacatgcaaactgtggagtgagaaccacatatatttcaccacataaacataattatgtacaaggtataaattatagttccccccactttttttttttttttgagacagggtctctgtcaccgaggctggagtacagtggcttaatcttggctcactgcaaactccgcctcccaggctcaagcgatcctcctgcctcagcctcctgagtagctgggactacattcacgcgccaccatacccagctaattttttgtattttttgtagagaaggggtttcgccatgttgcctagactggtctcaaactcctgagctcaagcgatctattcaccttggcctcccaaagtgctgggattacaggtgtaagccaccacgcccgacctagttcccatattaatttcccattttatccttatgaaggaattggtgaagcccttggccacgcaccatgcacggtttagaccagcatttcctatagtattctgttaggaatattgatcctttgggatgcttcatgagggaaaaagtctccgtagaaaaatttctttgggaaagactatatgctctatcccatcacaatgcccactgacgttttaaagactctgagatatcctgcagtaaaggaaccttttcaactttgtttaattcagtgtttcccaagcttatttaactatagaaccttttttcatgttacatctgttaacatcttacagaaccaatgtgtttcatgggaaatactctttggaaaactttagcttagaaattagtatctgtgctgatccagtctagatttatagtcttcctagttcttttaaatgtcttttataacccacaccattttgccctatgctagttagtgtctaatgggatgttgctgatttgtttcagggtctgaacttgctattagtaggaagctcttggtgaactttggttaggtgcacaggcaaataccaagtgccttgtttttctcataatatttctaagggagttttatttcccttatgtccctctaccaaatgctggtttgatccttattttttttggacaactttattgagatataatttatatattgtatacactagccatttagtactttactgttttttgagacacagtttcactctgtctcctacagccttgaccttccccagctcaggtgatcctcccacctcagcctcccaagtaactaggactacaggtgtgcaccaccatgcccagctaatttttgtttttttctggtagagatggggtttcgccatgttgcccaggttggtctcaaattcctgggctcaagagatccacctgccatgtcctcccaaagtgctaagattacaggtgtgagccactgcacccagctagtactttacttttaaaccagtgtggctatcccatggctgaggttttttttttttttccgatagtttttggggaacaggtggtttttggttatgtggataagttctttggtagtaatttctgagattttggtgcacctgtcacccaaacagtgtacaatgtacccaacatgtagtcttttatccctcatccttctcccacccttcccctgtgagtccccagagtccattatatcattcttatgcctttgtgtcctcatagcttagctcccaccatggcctagttctatttctcatttttaccttgggctgtgctctatgcttttatgttctgccaagcagtagagaagataaagataatccaaatcttttatcaggaagaatcccatctcaattgagatttaaggtgaaaagtggattccccgattaggggatgtttcagtacttcctctgcagtatcaataaatgttctcactgttcacaacagctcaagaaacattcctgcataattattttataccctcctactccacaggctacataaagcatggatgataaacaggcattacccttcatgccaatgccccttgatcagtagttgctgcctggagcattgtgttaagatggatgctaaggtggactcctggttccatatgaaagactgacatggtttggttgattttccatgtctgctatggtcttcagcagggggaacaacagttctagtattctggttgccatcccagcggccctgaatcatcatagttatcttgggcaaagaacacaggaaaggggaactcttggggatgttagccagccaagcaatctgtttcactgaggggctaaagtcttatcatatggctccttaagaaatgaataaaggggccaggtgcagtggctcatgcctgtaatcccagtgcttagagaggccaaggcgggaggattgcttaaggccatcaattcgagaccagcctgggcaacatagtgagaccctgtctctacaaaaaattaaaaagtagccaggcatgatgatgcatgcctgtagtcctagccattagggaggctgaggtgggaggatggcttgagcccgggagttcgaggctgcaatgagctataattgcactattacactctagcctaggcaacaaagcaagaccctgtcttaaaaaaaaaaaaatgaagaaaactgtttttttctacttgatcttcagcactggtttctgaagtattgaattaatataaagtttaaaatccttttgaaataaataggccaggtgagagggagtaacctggactctgctgagcagataagagggggaaagaagcagattcaggaaaagatctcatgaatttcatatgagtggttggccacacttaatatgaaattataagcccttgaccaaagaagcaagaaggaataggctacaagaagagacccataagccagaagtcactggcgaggaaaggccctattataggttatacagccttagcgctcttttgtttacccaggctaaataggcctgctttttccttttaccatttcccgggacactggcttccaaattcgcagtcatcctagctgccctagtggatacttttaggtttctcacccctgaaactgaacacagagctgtacatgtgatctgcacagcacagattattgtgggactgccactacccataatattgatattgtacttctattattgtcagttgagcttccatgatcatatttaataaccatacctattgttatattgaactcagaacatatctggaacagagcagccctttcccttagcagtgtaaaatcaaggcaagaacctggaatcacatcttgagctaggcttactgccaatacaggttaagagtccactgaggatagtgagatgatggttccacatttgttagaaactacactacatgtgtgtcatgtgactcttattctcagaaaggtagctggctgaattcagcaagacagaatttcaataggaatctagggaggctgtgtgattggagaaggtagggacctttaaagcgagctagtgcttgagtggacagaaagcttaatataagtccactatataacaaagctaatgtgctgttggactacattaatagaagcatggaattcagttcctaggaggtaatcatcctactctgccctattctgtagtggtcatcaccatctgaagtcctccattctgtactgatatcatcattcaagagattgggtgactagaataatgaaaggagtcaaaagcatgtcatgtgagaatagttagaagaactgagctgtttggcctatgaataagcagtctcagagaaagcattttgaggttttcaaatacctaaaggactgggattaggaaagaaaaggaggatagtcttcatgttatctgtagcttcacagggagaaccagagccatggtgggaatgtgaatgtgttcttacctcacattctctatggtatcagttcttaaactgggccagaggccagggcaccaggaagacacactgctctgtgcaaatgtcctagtccttccaaagtaggtgctaggaataatattctagcagtaaacatggctctgttatgtgtgtgtactataaacgtgtccaagaatccactgtggaacttagcacaagcagcacttttctagttttctgagaataggtgtttgctaatgttttgtatatatcaaggcctgtcacaaaagcaccatcttcttcatgcatccctttctatccttcagtgagatgtgagctctccatttacctgtcctgtggccctaataccttgtcattgtgtaaagtttatgggtacagtgtcttatccctatctttaattccccccgccccgcattttttttttttttttgagacagagtctcgctctgttgcccaggctggagtgcagtggcacaatcttggctcactgcagcctctgcctcccaggttcaagcaattcttctgcctcagccttccgagtagctgagagtacaggtgcacaccaccacacccagctaatttttgtatttttagtagagatggtttcaccatgttggctaggctggtcttaaactcctgacttcaagtgatcttcttgcctcggactcccaaagtgctgggattacaggcatgagccactgcacccagcctatctttaattcctttttaaggtaggtgaaaagatgtttccaaagcacctgaaccatctcattaagcagattaggaaaatcattttgcccactttatagatctgcaagcagactcccagaaaggtaaacaggcttagccactacccagctggaggttggcgtggcctagattagaccctccttcgcaacttggaacccaattaagttcttctacatcaggcttgaacttctccactggcttttgaggcatctacactaggcttttacccctcaaagctggccatacttgctaccattcaagccaactttctttctagtaagtccagccatgtccttcaccttctttcacctattggcaccttgaggcctcctctcctcttaacaattctcttctgcccatttcactcatacacattcttcagagatcaatataaactcccattcttcagagagctttccctgaatattctagtgagctcttaaccaatccctaagcctctataacctctagcacataattttatacaaatgatattctggtttagggtgtccactttaatgtgctgtgagtcttgtcaccccaactcccctttgatctccttgacaagatagcttctacctctagaacttacagactggtgaagaagatacttgctcttatgaaacagaactacagaagaatacagctggctcctttaaagatgagtaagagtggaaaggagaggaggttgggaggttattctaaggaggggaacagcaaagacctagagggggatgagtaggtgagaattagtagagtggaagccacatgttggggaattaagggagattcaggggaatacagggatgggacattcattcattattcaaataacatcttttgagcatctgctatatgcaagacactgagccaaacataggaagtaaaatgatgaataaagcaaacatggtacctaccttcataagctggcaatccagtaggagagacagatactaaacaaagtgcacaaacacaattaccaactatgacaagtgatagaaaaggcaagaaatgcagtaggaaaagagagaataataaattattctcttgtggatgtcaggtaaggctgctatgagaaagtgatgtttgaactcagaccacaggatgagaaggattttgttcttacaaggagtgacgtgctcctggctccccagtgggcaggggtccctagctgagttagcaatctgagttccttacaaattggccttttcccatcttctccctttgcagcattaggtacattttcagaagtaagggacgtagaataatgtaagaaggccaatccagcccctctcccattggtagcagagctgataactgtgccgtcagctttgttgtgggggctggagaagctattaatggagttgtaagctttaatatttaatgaggaaaaaacttagttttgctgatgaagagctcctacctgagtcttccaacattatatgacctgtacacatcctcctggaaatggagaaagtctctggggatcttggaggaaaggaagagtgccagcctggatgtcctgttcttggtgtatcaggcataggtttctccttaccacaaaacccaaatgtataggtcattctctctggggacagacttgcctctggtgggaaagccagtagccacattggcaggcaaattgcagcagctggtgaaaggggcctccactggttctcctatgaatgccaaagctgttccctgaggattttagcttccagaaagtcctctctgctctcagctgacatgctgcatccagctctggcctagaggactcagtgaaaggccaagtggggataatgatatggggaagtggtagtagctagtggtttagggaaggggagggagaattatgtggagtcagggagggagaccaagttgagggttggtatttaatgtagcagacattggtaccaaagggaaccagtcagaaccaagatttgaccatctgttagcctccctatcaacttcctgatggaatctcatatttcacatccttcatttgccatgggctctgatacagcagagagacagtcacaggaagctcccacaggaggaattggtttgagtatgcttgagggggtggggaaattaggataagccagtggggggcacgggcctgagggcaggagctgtgcacagcagtggtaagtaggctgggtatatcctagctactatcacttttgttatgacctttggccagcctcctaaccgctttcaggcatttgtaaaataaataagatcatgtatgtgaaaatgagctgcaaattactatattatttctggtctaagggttgatgataatgaaagggttgctgattttctttttctgtctgtaattcccaagggaacttttgtgggagagagtgaggagatgggttattcttctcatcaccaaatgagaagagtctttggcctccttgacagggctgtggtgaggccaggctggagaaggacctgctctgtgctttcactgatctctggaagagattcccattgagtggggctgggctgggggacgtgtagagggcggctgagtctgttagcagagtgggccttcctggagatccccaccattggtgatagtggagggtgtcctactgctgtttcggttcccgaaggtcaattttcagggctcacgaaacatatgaaaaagtcaacattgctattattctccccaatgtcagtgggctagaggaggcagatccagattgctcacttccttcacattttttaatggtttgccctggaaatcttcaaacacataccccctagtacttgtcacccaacttcaacagctatcaacacaaggctaatcttatttcacccataccccacctactggattatcttgaataatttaatatttgaatatcgatttaatttaatgtttgaatatttgaattaaatttaataatttaatattcaagataatccagtaggtggggtatgggtgaataatcatctataacattatactatctctaaaaatgataattttctacataactaccattatcacaccattactatctttaacataaataccattatcacccctaaaaatcctttaattccttaacatcttaaaaattggttggttggtttgaatctggctcacacattgcatttggttgacatgtctctttttttttgttttttttttttgagacggagtctgtctctgtcacccaggctggagtgcagtggcgtgatctcggcctactacaacctttgcctcccaggttcaagcaattctcctgcctcagcttcctgagtagctgggattacaggcacgtgctatcatgcccgcctaattttcatattttcagtagagacagagttttgccatgttttccaggctggtctcaaacccctgacctcaggtgatccacctgccgcaggctcccgaagtgctgggattacaggcgtgagccgccatgcctggcctgatatgtctcttttaatctgtagtttctcccaccattttttcttttcttgcaatttatttgttaaaacacaaaaacaaaaacaaataaaaagttcagtcctttgtcctatagagtttcccacaatctggattttgttgactgcattcttgtgttgttttttatcctattctgtctcctgtatttttgcaaattggtagttagatctcaaggtttgatcagacttaaattcaactttttgtaaagaatccttctgaggtgtgatgtgtatgccacagtttaccttttgaggtgtgatgtgtatgtatttcataccaggaagcacataacatatgtttatcctattttttgtggtgtagttagcctgatctctccactataaaagttggctaggcatagtggcctgtaattcagcactttgggtggccaaggcaggaggatcacttgaggccaggagttcgaaaccagtctgggcaacatagtgagaccccatccccatacaaaaataatacaaaaattaggcatcgtggcatgcacctgtagtcctagctacttggcaggcaggaggattgcttgagcccaggaggtcgaggctgcagtgagccatgatcgtgccactgtactccagcctgggtaacagagcgagaccctgtctcaaaaataaaaaataaataaaagcccccttcagcctttcacctaatgtttttacagcccttgactgtcattgccttgattcattattccatcaggaatttccttcacatttgtacagcaaagaaccctgttaattctctgccttcatacccccacaggtatcacctggtctcgggccctctctcctttaggtctgcttcttccaccactgctcttatcctgtaccatcatttgcttccttatcagcccaagatagccctggagtgtcttcagaccacatgtatcccaccctgcttcactaagccctgtgcttctctgagaggagggtccttactgagtgtgttctcactggaacagcagtatctcacttcatgaagctcctgcatctgctctctgaatcttcctaggactatgcttgactcatactagggagtagaagcaactgtggtcttttcctcctctgggagagagttcagcaagggctgggtttatttttgcttcccacagatttcttagcagccttcttctatgctgaggagggtcttacttgtttcctgagcttcctgccccagcctgggctctggcaaggacccaaacctggtttcctgtttagctgggctacaagccgggagaggttgggggaagggatggggcaggcaattctagaactcttaggtccttttctctttccagccaagtttaaaaacctatgtgagagtcaggtgtggtggcattaagcctggagtcccagctactcgagaggctcaaggaggatcacttgagcccaggagttaaaggctctaagtgctatacgatcaggcctgtgaatagccactgcactctagcctgggcaacatagtaagataacatttctttaaaaattttttttttttttttttgagaccgagtctcactctgtcgcccaggctggagggcagtggcgcgatctcggctcacttgcaagctccgcctcccgggttcatgccattctcctgcctcagcctcccgagtagctgggactacaggcgcccgccaccatgcccggctaattttttgtatttttagtagagacggggtttcaccgtgttagccaggatggtctcgatctcctgacctcgtgatccgcccgcctcggccttccaaagtgctgggattacaggcgtgagccaccacgcctggccaaaaattgtttttttttattaagaaaaaaaaacctgtgagggctggaacacatcactaccttctggtactttggcatttctgtgttgccccagtatctccacccctattgtctctcctcacagaggagtgtacatgtgccccagacaaatacagtacatgcactgagggcactgcaagccagctcaccagagaagcacacagaagttgagagctgcctcttgcaaacctgtacccacccttaggtctggttccctgcccatgggagtcttcaacttctactacccagcctaacagctgttagtccccagataattatgtccaacacaatggagcatctgatggagcaggaagtctgagaggtggaggctagctagggaccagctgtgcaacagctagaaaacataggggtctgcagtgacagctgaccacccagtacaggattcctgataagagcctcacagccttggataccctgcccacactcctccttatgtctagttcttcctgaggctatgagaatccagagggcctcattctgttttgggaagggacctgttgctgattacttctttgctcccttctcctgggcggtcacagaagggactgtgtgaagccctatcccttttatccacatgaaagtaaacatcagaggaaagtgtcatcaagtagcaggagtgccccgtgtagccccttacacttcaacggcttccactcgttcttattataaagactcaaatccttagtataaccctaacatgtgatctggctcctgccttcctcttcagcttatctcatatcacattacccccagtcactacattcagcatcactggcttttcctccacttctctaatgtcccaggctcccttctgcttgagggcctttgcgcataatgttcttgctgcctggaatgcttttgctgcaccttctaccttttttttgttgttgactcctactcatctttcagttcttagttcagctatagtttcatcacagaggacaatccctagacttggtcagtagtcttccccttattgcacttttcacatttataattttacgtaagtatgtaaaattagtctattaacgtgggtccttttgaaggatgttgcatgaaaccagattcatttttacttaccatttgtctcctgtgccttcacataatggacattcactaaatagcttttggttgaatgaatgaatgactgaatgaattgtcttctagtctcatttacttggtaaccccatgtcgtatctgacattcaaccatataccctgcagacgtgtgtcctactgtttagaagtgtgtccggaattggtgggttcttggtctcactgacttcaagaataaagccgcggaccctcgcggtgagtgttacagttcttaaaggcggcgtgtccggagtgtgttccttctgacgttcagatgtgttcggagtttcttccttctggtgggttcgtggtctcgctggctcaggagtgaagctgcagaccttcgcggtgagtgttacagctcttaaggcagcgcctctggagttgttcgttcctcccggtgggctcgtggtctcgctggtttcaggagtgaagctgcagaccttcgcggtgagtgttacacctcataaaagcagtgtggacccaaagaatgagcagtagcaagatttattgcaaagagcaaaagaacaaagcttccacagtgtggatggggacctgagcgggttgccactgctggcttgggcagcctgcttttattctcttatctggccccacccacatcctgctgattggtagagcccagtggtctgttttgacagggcactgattggtgcgtttacaatccctgagctagacacaaaggttctccaaggctccaccagagtagctagatacgcagtgttgattggtgcattcacaaaccctgagctagacacatgcttctgattggtttgtttataaaccttgagctagatacagagtgccgattggtgtatttacaatccctgagctagacataaaggttctccaaggccccaccagagtagatagatacagagtgtccattggtgcattcacaaaccctgagctagacacagggtgctgattggtgtagttacaatccctgagctagacataaaggttctccacctccccaccagactcaggaacccagctggcttcacccagtggatcccgcaccggtgctgcaggtggagctgcctgccagtcccggtgccatgcgcccgcactcctcagcccttgtgtggtcgatgggactgggcgccgtggagcagggggtggcgctcattggggaggcacaggcctcactggggaggctcatggccgcacaggagcccatggaggggtgggaggctcaagcatggcgggctgcaggtcccgagccctgccccgcaggaaggcagctaaggcttggtgagaaatcgagcacagcgcccgtgggctggcactgctgtgggacccagtacaccctccgtagccactggcccgggtgctaagcccctcattgcccctggccggcagggccagccggctgctccgagtgcggggcccgccaagcccacgcccactcggaactccaggtggcccgcaagcgccacgcgcagcccgggttcccgctcgcgcctctccctccacacctccctgcaagctgagggagccggctctggccttggccagcccagaaaggggctcccacggtgcagcggtgggctgaagggctcctcaaatgccaccaaagtaggagcccaggcagaggaggcgctgagagcgaccgagggctgtgaggactgccagcacgctgtcacctctcagaagcacttactacttatctgccaccagacacacagtgtttcatttaatcttctcaactctgcaaagaaggtatacccttaatctacagagaaggaaagtgagacccaaggtcacacaacctagtaagtggcaaaaccatttcaagcccaggtgtatggagtctttaaggccatgctcttaactgtaacactgcactgcccccttttggcattttggagcattgtcactaggccctggttaattcaactcttaagtcggtatattctagaactgaaagccccaagaagccacgcttcagttctagcgctccacatttggccctggctgtggaaggacactggggatggaattcaaccaggactccccagggttccagggtatatatgtctcagggtctctcaccccatctgtttccatggatcctttgtagcctccagatcataacgtagtgtcctgttttaaagagaagggccagctgttgaaatggcctgatccggcagtgtcctggagagtaagcatgacctgattaagatcctagtcaagataattgagagagagagagtagtgtttgtcttcttgcaatttcctcatgaaagatagagccccggaaattggcttcaaggctttcctgggaagtgcaaacccattaagagggcaacgcctcttgctgctggttctcataactcaagttagtccacatcccaagttccttttggtggcagggaaattaggactgatgaatactttagactagatggaaacaaaaagtaaatgaggagagagcaacataaaaacaaacaaacaaaaaccagctaccctttgttgttcatgccaggcatgctgcaaagtgttctatatacattatttcatctcattctaacaccagccttgcaaagtaggtaatatgacacccatgaaaggaaagggacattaagaaaggtaacttgccaaaagtcatacaacgaggtggcttgagaactaatctaggtctttctaaattcaaaacccaagtacttaccacagccagttggtgagagtatacattgtcacagcctctctggaacaataactggcaacagtgtctcaaaatataatgtgtacatttcccattgaccccctcagctattctacttctaggactttcttaaagaaatagacaaacatataaagactttctttaataagaaattatcataggccaggctctgtggctcacacctataatcccagcactttgggaggccgaggtgggaggattgcttgaacccaggagtttgagaccagtctgggcaacaaagcaagaccccatctctacaaaaatttttttttaaatagccaggcatggtggcatgtgcctgtagtcccagctgcttgggaggctgaggtgggaggatcacttgaacccaggaggtcaaggctgcagtgagctgtggttgccactacactccagcttgagtgacagagtgagaccttgtctcaaaaaaaacccaaaaaaatcccagaaattataataattataaataaatacacatacataattttataataacattataatagttataatagatattataatagttattagtagctgcaacattataatagtgagaaaaaggtgagaaaagagcaatctaggctgggcacggcagctcatgcctgtaatcccagcacattgggaggccaaggcaggtagatcacctgaggtcaggagattgagaccagcctgatcaacatggtgaaaccctatctctactaaaaatacaaaatgagccaggtgtggtggtgggcacttgtaatcccagcaacttgggagtctgaggcaggagaatcgcttgaacccagaaggcaggggttgcagtgagccgagatcatgccattgcactccagcctgggtgatacagtgagactccatctcaaaaaaaaaagcaatctaaacctccatcagggaggactgatttaataaatcatggtacctccatcccatagcatacatatgggcagccttttaaaaggaggatgtaaatctaatatgaattgacataaaaagatattcatgatagatgcatttcattgtggtaaagcgcacataacacaaaagttactgagtaaaatacatatggaagatggatcatctgattccatgtatgtttaaattggtatatatgattacatatctttaaagtctggaagtataaaataaactggcaacagtaatgaattataggagaactttcatgttctgtattcacctttttgcatttgaatttgttatgacaaaacagcatcacctttttctttgaatttttttctatttggggaaacaaatggtcaaaaatcatgatctttgactctatcattttttcccaggtgatagagctcatgctttccatatttttaaattgggtatgcataccaaaagggggtaagatgaattgagtgtggaaatgctgccagagacctgtgtgtcacttgtctaaacaatcttgttcctgctatgcaccccagctttgacatgccacacttgactcacatcttcccaattccttctcaagttctacagagccctgtagcttctaggaggcagggcatttctttggaaacagaaaatcatcaacactggccaggcacagtggctcaggcctgtaatcccagtactttgggaggctgaggcaggcagatcacttgagctcaggagttcaagaccagcctggccaacatagtgaaaccccatctccaccaaaaatacaaaaagttagccagatgtggtggcacatgcctgtagtcccagctacttgggaggctgaggcaggaggatcacttgagcccaggaggtggaggttacagtgaactgagatcccaccactgcactccagtctgggtgacagagtgagactctgtctcaaaaaaaaagaaagaaagaaagaaaaccatcaacattgagcagataccttcctgtttcttactccctgttgagagatctcctacagttccactttcaccatataagaaaaggaaagcaaggggacaaatttactctcacattccccaaggtaaaactatgatcactaatatttgaatgttctggatggttctctttggcttctggccttcctcccattagtgttgtctcttgttgtgttatcgttttctgtatggccattttatgtggtaaagtaggaaagggaccaggaaacttggggcccagttctggatatgggacttcaggggagttactcagctttatagggcttcagattctttttctctgtaaaattgagataaatgatagatggattatcagagattaaatgaaataaaatgaggaaaaagccttgaaattttaagttgcaatataaaaataaatatctatattttctgaatttaaccttttctgatttgtattgtaaactcttatgtcaagaagcatgtctctaaatctgtttactgtggtatagcaatttaataggaagattggagagatactgaagaatctggagaggccacttcattcttttttttttttttttttttttttttgagacggagtctagctctgttgcccaggctggagtgcagtggcgcgatcttggctcactgcaagctccgcctcccgggttcacgccattctcctgcctcagcctcccgagtagctgggactacagacgcccgccaccacacccagctaattttttgtatttttagtagagacggggtttcaccgtgttagccaggatggtcttgatctcctgaccttgtgatccgcccgcctcggcctcccaaagtgctgggattacaggcatgagccaccgcgcccggccgaggccacttcattcttaaaaccaacctgagcaacggggagggcagaggagagtcggaggcttatttcctacttgattcacttctgtattgtgttactttccccattgaatatgcattacctttataagttaaggaaaccaatacagattttttttaatggcttaaaatgatacagtcagtctggatatagaaattggaagtcatctgcatagagggctgacagttagggcaaagagatcaaaggatttagaaagatggcagttggaggagcagccagattggcaaactggggtcatgtttttaaaacttattggatgtcaggttgaggagtttttaagtggtaggagctatcagaaggtcttgagcaaaggagtactgcaataagagcagtgtttaattctcagaagagtcttttaacagtaatatacaagatgagttggaggaagaggagacaaggtggggagatgagtgggttactactgcagtgatcctggaatatgctgagaagggcctgaagcaggttgttggctgataattttttttaaagataaacattagatattctgcagaaccttctaggttcatgattagtttcccatagagataaaggaggaagaagtagatcaaaatgagcccacagggaggttaaaacaggagccaacctgaaagtgttctcaatggccaaagctggaaacatttgagcaacaaaacaaatatgataatattggattataacctcccaaaataagtatacattaatccatactgatataaatacatgattgaataaataagtaaatggaggagaaaggacaaatatttctttcagaaggattccaattttttatatatgaagtgaatacaaagactctctggactttctttgtaactcttccgtaaatgcaaaattatttcaataataagccaggcatagtggctcatgcctataatcccagcaattcaggaggttgaggcaggaggatcccttgaggccaggagttcaagactagtgtgggcaacattgtgagacactatctctttaaataatttttaaaactaattcaataattgtttttaaaatgataccccacaccgcccctgccccatttttgagtttatttactgggaaagtgttttgccaataacaagatacagatagttaaaaggcagaacgaggctgggggaggaacgtgacgccagtggaaatagtacgcagttggaaatggggtctggagagagaggtcagagctagagatatgggcttgggattgtaaagcccagagagctgttacttgaaataatatgtttatatgagatgcgaagagagaacatgtggaaagagaatcactgaccactgggaaaggcgcttatgtctacagtataagaggagggacagtaggaagggcagtcaaaacagatagagatataatgtttccatgcaagccaagggaaaatagcttccagaaaaatgtggtcagcactgtccagtgatgcccaaggtggtagaagatcacctgagaaaaagccattggcttttaaccaggagctcagtgctgactgcagggagaacagtgttaagtagagcaggtaggaagaggtgagggtggtggatgtgagaatcaaattgccaggactcacagtgaggagcaggcttgcctaagccaggcaaatggactgactgacataaggagcccctggagaagaatggtacacccctgggcacaaaggcagaaagtgatggccagaacaagtgggcaaaagagctgaggcccaaagctcaagaagagagaactttgaccaaaaggaagccccctgccatctcctggctgtggctgcagaatgtaggctggaagctacaggtactattattttcttcatgctaaagatgaaacactgagacccagagagattagaaacttacccagatcacacagataaataaatggcacaaataggacttactctaaaaccaatgcttttaagcactgcactatactgcctcttactgacacattcacacatgcgtgcacatatgcacatgcacatacacccaaggacccgggctgtgtgccaggaggttaacactggatagctctagatagtaggagtaagtttatttttttcctttttcttttgtgcttatctggactttttacagtgactatgtattcctcttttttaaatgtttttattttttattagcttttcttagagagggggtctcaatatgttgcccagcctggagtcaaactcctggactcaagcaatcctcccacttgggccttcctggtagcagggactacaggcatataccaccacacccagctctctcctcttggatttaggaaaagaaataattatttaatttaagttttaagttttggtgctctttgccagatttctgtggtatctatgagggaaacaaagcaggtgcattctgctcaagtgcagacaaaagagactctaccttctctgcagcaatacaggctctgcagtgacagggaggagaatctggcatgcatgtatatgcgtgtgtgagtttgtgtgtgtgtccgtgtgtgtgcagcagctgctgagggcaggggaggagctgatgagctgtctgttgatttatcacatggagaattcccttcctcccctatggccactttgtccccaagccaggtctattttatcctgagcttccagagggactaggagatattttttcacacacacaccaagatcctctgcctcaccccttgaaaatctggccaggcagctaggctgctggcatgaagcccaggctgcagccatagagagagattggagtcatgcaggagctacttcagttcatgcgggccatgggtccaagcaagcagttgctatcaacaatgggcagagatgagccagtggcatttaagataggcattaaccagcaggcagggctcttgcccagagcctccaaggacttaaggggaggtggttcagaaccctggagagctcctcctgtttgtgccgggtctgaaaggcctggatgctgtgtccttaaggcattgtgcccatttaacttattgttgttgttgttgttgttatttggagacatggtctcactcgggcacccagactggagtgtaatggcatgatcactgctcactacagcttccacctcctaggctcaggtgatcctcccacctcagcctcccgggtagctgggactactggcatgtaccaccgtgcccagctaatgttttttgttgttgttgtttgtttgttttttgtctttttttttttttttttttttgagacggagtcttgctctgtcacccaggctggagtgcagtggcgcgatctcggctcactgcaagctccacctcctgggttcacgccattctcctgcctcagcctcctgagtagctgggactacaagcgcccaccaccacaccaggctaatttttcatatttttagtacagatggggtttcaccatgttagccaggatggtctcggtctcctgaccttgtgatccgcccacctcagcctcccagcatgtgttttctttttttgttttgttttgtagagacagggttttgacatgttgcctaggctggtctcgaactcctgggctcaagagatccacccaactcagcctcccagagtgctgggattacagggatgagccactgagccctaccatgcctatttaattttgcatagccttcctgcacatgtctttcgctgtgaaaggggcatgacctcttctctttccaagaccagccctgtaggtctagggattcccccttatcccctccaggtgctgccctacctccccccacacatgtctagctctctgttgaggtcaccatcactctgaaggtgaagtaagcttgcaagacaattatgtcatctcccaagctgtccctggccagggcctgataccctaatacttcaggatagtaggagtcctggggatggggtaagaaaccagtggaacaagggaatattaaaaggtcctctgtctctaatacccctgtacttccctcttcaatctggacgaagggagcatgaaggaggggaaattaaggagagacactgagcaggtttcaaggcctgaagcaggatcctttcatgagccatcactggactttcggcctaccaataggaatatacttaatttaaatatgcctttttttgcagagggaaggacattgacatgaggtgggtgttgtagcaaatggaagcagaaataaaactagcgagtctggagcttgcaacctgccaccccaaccctagtcatgcacatggcccccagagcccacaagcagagaagagttaaattcacactatagagggacttcctcccacttccccaagtcatgtgtgaggagtctgaaaggtcagaagaatcataatcatatactagggattaaattttctggttgaaagttcctcctctacctacaggtctcttccatggctaaatgaatcagagcagctctcactttatgattccctgagctggtgagtgaggagggtaagtctgcctggattgaggctcaatgaaaacactcaggaccctgttcctctcaaccagccctgctctgaatttgtgcaaggccctcttccttttgagaccttgttttcttcacctcttttaggcttctgggtcccttattgaaggaactgtcaagcccaaaggcatgcattatacctcaaagaacctcctggtcaaagaaattgatgctaaataatgaaaccctgagagaacagctgcaggctccctcttctagtgccaaccagtcataatgagaggggagagcaaggagaagaaaagaacttttggtgttcactgagccttgagtacgcctggcagagtttgggctagaaggactagggctgcccccagcccacctcaagaggtgttgcatgatagtgctcctggagatggggccgttgacaatgtagtaatgaatttatgggtgaaaaaatgtgcagaggatctggatccaggctgtccctcagcttggcctctctcttgctccaggaaacagcacattccagcttccagcagaggcccttactgtgggtttaagcacaggctcttttaatgcacaaggaagcctggagaagaaacaagaacagatgaggactttgccagatcccaagagggtttgtttgtgttgggttttgttcaagtggaacagacctaaactcagccagagctcgctctcagtctgctctcaggggcaaaggtgcccagtgtttgtcttcctcacagcggatgctctgtagtaattgttttatttaggagctgtgattatgtgtccacaaaccttactaaattgaatacaatcctgagcattcagaagaagaaacagtgcaggactcaggggagggcacagctggctgcaaacaagggcccatgaattctaatcccagggctgccatctggcattgacctgggagaactcatttactctctaccctggaggctctttctgggatctcagggcctgaataaaaacagacctagaagctcagaaagtgaaacaacctgtctagactctcagagtcagtgcagttcacaggtaaactgttcataggccctactctctagacaggggttgtgtttactattccaggaggtttcttgcattttcctttaccatctgtttgcccttatgtctaaatcctgaagagtttccctgccttgggtgtttactgcctgttgaacatggttacaagaaccaggttgtcagaaagcactttgaacagacagaggatcagaacagccccactcctatctccctccaaagagttttctgatggtttggattccaagctggtttcccattcttccgaactcagtaacaagagttgggccttaatcatttgattgtggaagtatatatctgcaagctaatggctgatcttagccctttagtcacaaagaaggctgcatctatctgctcagtttgttgttagtctccatgagaagttgacctgaaattgagttgctgctttggctgtggaccttaagtgaagttttaactaggccaagccttcaggtgagttgaaggagggtttgggggactcctactttggctgttctccaaaataactttgagcccctgaccagaggcttacagtgaagaagtagtcctacaaagagcacaaaatgcaacatctgtctgtgggacaccattagacaagactccagcatggtctgataggtcaggagtgtttgccacctctctgttatagaaagatccttgctatgccttcaaatcaagtagaaggcagtgtttgtcttttcagattatggcctttcattttctatgccaagcattgggaggacatagtggaggcaggcatggtccctaccttcacgaacatttattaaacaaattatacaaatagtcatttaaataaaatttgctaagtgcatgaaagaaatgtatgggggagcaggggctgtgagactacattatagaaggatctaactgagcctggcatttatgggaagcttcttttaagaggtgatgtgtcccagcctgggcaacgtagactccatgtcaacaaaaatatgtatgtatacaaaaattagccaggtgtggtggcgtgcacctgtagtcccagctacttgggaggctgaggtaggtggatcacttgagcccaggaggctgaggctgcagtgagccgagattgcgccactgcactccagcctgggcaactgagtaaggcactgtctcaaaaaaacaagaggtgatgtgtgtcagctgaggcctgaaggatgtagtaaaatttaaccagaaggggagcatgaggttaaaaaggatattgataccccatcaggagtaaagaagaccagtgtgcaaactagtaagcctggggaagagtggcacaagatgaggttggggagatagaagtaaaggcaagtgactactcctttgccatcattcttagcctggtctggagaaaaaaaaaaaaagtgctggttgagaccacccaaactgctgttccatcttcctagcagcaggggcctcacaggaatgctcagggagaggtgcttctagccccaacctggggatcacacaaatggaatggtcctcacctggcagcccagttcagaggagggaggaggaagaaagactaggcactcactttccctgcaatcctctctctatttttccattgctctgaactgtttattaatacatgacagaagccatttccctatttagatggttctgctgggaattccacaccaccaccatccctcctgaggcagattttaaagtcagctttcaagattttatacttggatttcagaaactaaattacattactacgtccagtgaaacggcgccattgcctgttcctatctgcatgctccaggcactgtgaggccgataacatcagcatgtcaaagcagctcgatccagacaatttgcagctagctagagctgggctattggtggggaaggggaggatgaaaaattatctcagaatccaaaacagcccagggtgtactatagactaggatctgggatttttgggttctttctatataccatcatttctcctatctataaagatacaactcatcttagccccacctggacataacaaggagctgaaaattcctctcctaaacataggaacaggacaaaatcactgatgtttcaacattcgggatgttttcattggagtgtaaaatagaagggagtggtggaaagagtgaaagtcattatataaaaaattcaggatcctactgcctgtgaaattaggtgtccatataaaagccaaaatactccttgaatggctattctgtgcttctgtgaagcccagatgtgaaggccttataactaaccctctgacagccacaaggttgcagagtaggtgaagacaaactattgctcccctgataggaacaaaggaattttggagtttctaattctaaccaaatttaattgtacagaacaagcattcccttcacaacaaaaatatttcagcctattgggttacttaaaatgcaccaaatagcataaaacattcattcaactctaacagcattcacagacctacttttgtaaatagccaagcacaggctgttctttcccagaatatgattttttttttaaataatgcagtaggtccgcaaggtcagagttttgggaaaagtcagtctaacctcattgaggctgccagtcctctgccctcgtgtgagcctggctttcctgcacctcagtgcactgcccactcactcataggtgtcagtgtttgcatgcaggagacagaagaacaaggatctccccttaacactaactgcacatttttcaacttctccaagcacagtggaggcatgcaggttactgactacattactggctctgaagactaataattaagtcaagtgattatttttatttattcatttgtttattttatttatttatttaagacagagttttgttcttgttgcccaggctggagtgcagtggcacgatctcggctcactgcaacctccgcctcccaggttcatgagattctcctgcctcagcctcccgagtagctgggattacaggcacccaccaccatgtccagctaatttttgtatttttggtagagacggggttgcaccatgttggccaggctggtctcaaactcctgacctcaggtgatctgcctgccttggccccccaaagtgctggattacaggtatgagccactgtgggcctcatttgtttatttttacagaaaactattattgaagggtttaaatgtgagaaagttttgactaggcataaggaataataataataaaagtgagaaagggctgggcgcggtggctcatgcctgtaattccagcactttgggaggccgagggggtagatcgcttgagctcaggagtctgagacaagcctgggcaacatggcaaaaccccatctctaccaaaactacaaaaaattagctgggtgtggtggtacacacctgtagtcctagttcctcgggaggctaaggtggcaggttgcttgagctgaggtggagattgcagtgacctgaggtcgtgccattgcactccagcctgagtgacagagtgagaccctatttcaaaaaacaaaaaggtgagaaagcatgattaccacataacagagtataggttccatggttgagcctccctctggatgttcactgttggtggaacaagtgttgtgggttctgggaaaatcgcaacgcaggctgctcctctctgtgttctggattctcaggccactcctggtaggtccgtgttggctttggccccctgcctcaaggactagaagtcaagggtctttgctgctttttgccatagcctggggacgataggccaaaactaagtcaggggactctggtgcagccagaatttggggcgactacccacctaactgcttactattgcctctagtttggccaagccctggtcagcctcccttgccttcagcccaccccttgcccacacttcctaaaagatagcaaatgtgccatgatctctggaccgtgactggacttttctactagagaatgtctctcggtgaggacttgcaagcctcacaagaatcagacccataatttcttagaacaaaataagtttttgctgaaatatcagcaagcctgagaacagcatcttgagtcctccctcatgtcttcaaacaagtggccattctatgctggttctttctcccggcctcaactattttccagtctctcttgtcatacaagagcccctctaggactccggttctggttcctctgtcttacattattcttctcaaaactctgcctttcctagacatccatgactctgatctcttcttggttccctacccctctgaccgtagctgtcagtcttctgcttactttttcaatattggtgttccttaattttttttctctaagcccttcttatttataaacatacacatatttacacacaaaacaaaaccacaagccttactcttatttctgtttctccatcttatttggtggcatcacaattcacgcagtcacctgagtcaggaggaaacctgggagtcatcctagctcaagtcttttccctcaaacccagatccagtcagccttagtgccccagcggtttgacctcaacatgtttttcttctccacctccttttttccaaccccactgacactgactttttcaagctttgtcacctactgcaatgacctttatctagcctccctgcctccagtttaatcattcctgcctattccttggacctgctcccagagcagtcagtctatctaaatctgacaatgggctgaaaatccttcagtggctccccattatttccaggtgaagtccaaaaccctgaacatatcttacaaagcccttcatgattttaagtcttcctgtcattctagactcatcacctgccacttcgtcccctaacattaacattctagtaaaattgacctgttctttttgcctgctctatagtcatgtgcatctttcccaccagtcctttctcttcttttttctttttgtttgccactcctttcctcatctggttcactaatacttcctattcttgcttcctccatcagttttctttggagaagtcctccctaattccccagagtgggatagttgcctctgtcctgtacacatacaaacctctgtcatagcactcagcatatgattaaaattatctgcttattcacttgcttcactcactggcttatgagctcttcatgggcaggggccttattattgttattattatttagaagaaggggtctcactctgtcgctctgtgcaatcatggctcactacagcctcaacctcccaggctcaagtgatcctcccacctcagccttctgagtagctaggactacagacacgtgccaccatgccgggctaattttctttaatttttctgtagaaatggagtcctactatgttgcccaggctggtctcaaactcctgggctcaagcaatccttccacttcggccttccaaagtgctgggattacaggtgtgagccaccgcgcccagcccatattatttttatatgtccagaacccagcacagtgcctagaatatagatgcccttaaaatgtaggaccagaactgaatttggtggctaaggcccctttcatctccttttcttgcactgccctcttcttttgtctcctgggctcaccattctcagtttccaacgcattttctttcttgttgcttcctgccagtctctctctccatcttgagctatcgactgcttcagtggctccaatatttccttcctgtggagaactcaattgagcaggaagcttgtgatcagaaagcatccatgctattttctaaagaggggctacaagtttgtgttgagctccagagacatgattgaactaggtaccagccttccaagtgactgctttgcaagacaacagtcccacagaggtgtaagttctggtacgttgttaatctcatgactttatctaagtctctgagaaggggctggggtaagagagatgaggaaattagattcaaattgcctaccaggtgtgactttggacatattactttatgcaacctagttcttcaattttaaaatgaaaatgatatttgccttacttggttttggggaggattcaatgaaataatatagataaagcacttagcaccatggccgtacctctggcaggtatttaagcaacattaactaaatgactggatgagttttggaagaactacacctgggctaaattgttccgaacaactccctgcctggatccagccagagttcttagtagagctgcctccccaacgtgagctttgagaagtccctcctcttctctcctctcttcccagactattgttccctcttgccactaggaatgtaaccaggttaaggtcagggtggagggctctttgagaggctgtctggggatggtgtgggcgtagagaggctggcctagagccacactattccaagtgtggtcgctgtattaacagcattggtaccacctgggagctaatatgaaatgctgacaattcaggttccagacctactgaatcagaatctgcatttaaataatatgcccagatgatttctatgcacattaatatatgaagaaacactgtcctaggggcacagatgggttcagcaggggtggagggttgagacagtgcaggtgtgtcagctgtctagaagaggtagaggttgtatgggggtgggggaggctgtggcaggggggtgtactcagagaagaggaagtgtcctcagagatgtgggttgtagagctgtagggggctctttgggaaatgttggtcatttgctgtttcagcggcctttcctattgatgcctggagtacgaggtggtaccccttcctattgatgccttgagtatgagttagccggtaagtgtcactgcaccagccagggagtgacaggtgggcaggcaaaggctctctactgccctgagcctgcagagacgttcctgcaagtatcctaggaccatctagcttagcagttgagtattgttttccatggagatgcataaccagcaactggctagcctcacccctaaaaacacaccctgagttggtgttactctacaatctcccctccttacctctgtacccccagctggcacacacacacccctataacacacacacatgaactttcttctcttgggagactcagatgggagttcataagtagggttaaccctccccttcccctctctgacctgcttgaccccaggctggcccccaggcctctatgggcccctcagccctgacctccctgctgcacggaacaggccttgtgagagtgactgcaggccctaggcttggctggatgcagcaaaatttgtttcagcagagccattctctctctctctctctctctctctctctctctctcacacacacacacacacatacacacacacacacacacgagtttcactctgtcacccaggctggagtgcagtggtgtgatcacagctcactgcagcctcaacttctcaggctcaagtgatcctcctgcctcaggttcccaagtagctgggtccacaagcacatgctaccacacccggctaagtttttttttcttttttgtagagatggggtctcactttgttgcccagactcgtcttgaactcctgggctcaagcaatcctcccacctcagcctcctgaagtgctgagattacaggctcatgagccaccacgcctggtctttctctttcttaagcactcttaggacaggactctcagtccctgattgccttcttaataaaaaccctttccagccacccacctagagcctcttgacccttcctttgggttatctgtttatctcaatggtaaaggaaaaggtcctgctgcaaatgaccccccaaaatgaggtggggagtaagtgagtgccctgtggcagggtaggaactacatcagcagcaacgaaaagtagagtcctagcccccagggcagagcttcaccagtagttgctttaaaccctctgccaaagtacccagtgaccaatagccaggtctccactttaacctggctcctgcccaggcccaatcttgtatgtcagagaagataatatcgctaccattatcgctctcctctgtgctcctaccaccctccatgcattcctgcctctgctgttcctctctcttccttaaataggctgatctgtgtgcctgtcatctctgcacttttaaattcttcttggcaagaaccagggcttggtgtttttccctccccagtgtacattgtgccctcccccttgttggggttcagtgattatcaaagttctgaacaagtggcaagttcaccaatgtttaattattgggatgacaaaaaggaaagactaggagactgctctggctagagagctgagctttagagctgcaaattatctttgtgggcaaagagtagtgcctgccaggcataatgggggttagagacttagaacaagctaaaaaggagaggaagggcagcgacaggaaatgccacagagaggaaaagctatttgatactagccctccaagtccattgtccattgcagacaagttggtccttattcttccaaggccagagggaagaaatcccatagactctgccaattactttgctttcctgcaaatcaaggagccccaaagatttatgaaccagtgcaggccaggctcagttccttgagtaattgaagcttactaaaaagccttaagtgagatttggggccaagattcagacaagaatccacacgtcaatctggcccagacaaatgtcagtgtctgctggcatttctcctgcttctgcttcctaccaggtgtggggctctcaaggagtctccaaccacatgtcttgtactgattcctgggcagtattctcctcagtgtctatgcctcctcccttatcttgaagaactggaatccacattctagaaggaaactgaaagatcctctggactgtgctccctaaagcgctgttaaccttgaacaaccttgccatcttcctgtcctctgggccctgtctaaggggcacctcaagtagaaagcccccagaaacccaaccccaaatccccagccccgtccaactcccctggtcttagaataattttccctctcctatgaaaggcctcatccccaaaagtctgtgttgtctgaatctgaatatgaaaagggaagggactgcctcctccccactgcccaccacacaccttcttattttgctgcctaggtcctgcttctcaatttttttaaaaaaaaattgtattagaatatgcataacataaaagttaccattttaaccatcatggggctttgtttgtttgtttgtttgtttgtttgtttgagacagagtcttgctctatcacccaagttggagtgcagtggtgcaatcttggctcactgcaacctctgcctcccaggttcaatagattctcctacctcagcctcctgagtagttggggtaacaggtgtgcaacactacacctggctaattttttgtgtgtgttttcagtagagacagggtttcgctgtgttgtccaggctggtctcaaactcctggcctcaagtgatccacccacctcggcctcccaaagtgctgggattacaggcatgagccactgcatctggccaattttaaccattgtagatctatttttaaagaactttgtaccttaactcctttctccattaaattagatgatctttccctaaagagattgaaatgggggaggcgagggtgatgtggggttcaaagaccttgtaggtcacaagacttgacataggccaagaccaatgtcttaaactggtccaaatgtaaggcaggagcatcctcaacatctggctaaggggatgagggccaggagtaggccaagccagtcctcccagaaggaagtaagccttctccacttatgattctggtgtctacctcctgggtcatgaggcttggcccttaggcccttatgcacaggcttcccccaagccatagctacagtgattatccctgagttgaggtatttatcctatctcccaaatgaagaattttttatgacagggttttctggtgagtggtaataggaatgaatagcagaacatcagtctaagacatcagtcttgtcctaaccatgaagaagcagagcaggattctaaatcatcttttaaaacattctttggccccctgtctcttcatttcaaaaacaaatcctttttttttttttttaccatctcactaccagcttcatactttcaccatccttttctctccctgttcctgagtagctatttctgaaaactaaataataggtagggtaataggagctgctgccctagctggggtaactccaaagccattttggttaattctcccaccccacatctaaaagcaagggacacactctgtgagatttgctttctggctccgcaattaccgtcacggttcctacagctgacatgctggcacaggtgaggactggctaaagcacagtgcccagttgccaggcagtgccagtgctccacttaaagcccttcccagtcttcagtgtaagagtcttccctccttttgttcttaattggtggcctcaagtcaggagtattttgtctggcaggtgatgcccagaggaaattctgttctatgaaagaagatttcccagagggaaccaggtaaatgaggactggaacagagctctcatggaagataatgggtaaatgtgatgacctgaaattccctggcacacagtgaaaaataaagcattaaaaaccagctatactctcagtcatgacaggaggcattgtaaattggaacaatcctttgggaaagcattttggcaatatctatcaagaaacttaaaagcactcatgttttttactgagtaatctactttatttaggaaatgatcctaaatgtaaatatatgtggatttcagtgtagcattatctataatagtgaaaagttgcaaacaacctgaatgtcaaaaataaatgaatggttacaaagttactctacatcctctctataggtattatgcagccattaaactgatagttacaaaaactatgtaagaatataaagctaggggctgggaatggtggctcacacctgtaatcccagcactttgggaggccgaggcaggaggatcacttgaggccaggagttcgagaccagcttggccaacatggcaaaatcctgtctctactaaaaatacaaaaattagccagatatggttgtgcatgcctgtaatcccaggtactcaggaggctgaggcagtgagccgagatcacaccactgcactccagcctgggcaaccagcctgggcaccagagcgagactctgactccaaaaagaagaagaaggagaaggggaaggggaaagggaaggggaagaaggaggagggaagagggaagaaggaagaaggaagaaggagaagataaagctaggtgcagtgacatgtacctgtaatcccagatacacgggaagctgaagtagtaggatcacttgagtccaggagttcaaggctgtagtaagctatgattgtgcctgtgaatagccgctgcactccatcctgagcaacaagaaagaccctgcctctatttaaaaaaaaaaaaaaaaaaaaaatggagagctgattatgttctgatactaattttaaaaatacagaaataaaaaaatcatacttttttttttttgagacagagtctcactttgttgcccaggctgaagtccagtggcatgatcttggctcactgcaacctctacctcccaggttcaagtaattctcatgcctcagcaccccaccacacccagctaatttttatattttttagtagagaaggggttttgccatgttggccaggctggtctcgaactcctggcctcaagtgatcctcctgcttcggcctcccaaagtgctgggattacaggcgtgaaccacagggcccagccacaaaatatactatgttctttaaatgttgttctatgcacatgtattagttgctactctctgattacagtaacaaaataaaaaacccaactgaagctaagaaagagaacagactatgaagacactagggtttctttcttttctctccgcttccttccttccttccttccttcgttccttccttccttccttccttccttccttccttccctccctccctccccctttctttctttctttctttctttctttctttctttctttctttctttctttctttctttctttctttctttcttttctctttcttctcaggatctcactctgtcactcaggctagaatgcagtggcacaatcatagctcactccagcctcaacctcctgggctcaggcaatcctcccactcagccttccgagtagctggggctacaggtgtgtgccaccacacctggctaattttttgtctttttggagagtcaccttcttgctatcttgcctaggctgggtttcttataatgcctaagcacagcatgaagtcaagctttggatgggtaaggcaggctctagaaccagagactgaaacctagggagcactctcaccatctcttgtgtttacttctttctgaacatcagctgtattcttgtttccctccccaatggctctctctgttacctaatccacagtcttgaactttacatctccatttaagtcccacttcccgattctgggggagactaatttgctctgcctcatccaggcatttatccaattgggtggaatcacatagaaccagcatagttcctagaggctcactcctatgaccatgaagatgggaacagcaccaactcccaaagaaggaagggaagccccagagttttgctgctgtagtatacgcaaaagactcacataccgtagaacattatcaagtgtttttctcaaggtggtgaaactaaaggtgatttgttaaaattttagcatgtattactttatagtagaaaaatctataaaacttttcatagctacagttgttactaggcctgggggcagtagcaccctccaccattttggttgtcccagtgacagataccattaaagatactaaggcttggcggtgcttacttttagtaatgaattctatactagcagctgtttaagcagtcagaaaatcctcagctactcccaagaccagttggagctcccaaactctagcccgagtgtgataatccttcccatttctttttggtgaacttgaccataccccaaaatgcaaatgctctgcagaagtgtggtgtgtggaaagaaagagtgttttcccaactggggcatcatagtgagaccccctctctaaaaaaaaaaaaaaatttagccaggcatagtggctatgtgtgcttatagacctagttactcagggggctaaggcaggaggtcacttgagcccaggaggtcaaggttacagtgagctgtgacagcaccactgcactccagcttggatgacagagtgagaccctgtctctaaaaaactaaaagaaaaaatgacaaagaaggaaacaaagaaaagaaagagaaaagatgctttcctcttctgcattctactgccagctcatagtccagagctggagagtggacactcagtgtgttgactttatttgaaatgggtcttcttttagagaaaaacttagaagatttgggagatttagactgataagagaagactccctgggccagccaggattctctgccttctctcctaaatgtaggcttcacaaactttctcttcagactttctgttctcccccatttgtaagacccaataacacttggagagatcctctccgttatgtttccctgattctcttccagatctcccacaaagaccttatccctataagaagtctttgtctttccctgtaagtgggatccctaaggacctttttattttgttttattttattttattttattttaagttctgggatacatgtgcagaacgtgcaggtttgttacataggtatacatgtgccatggtggtttgctgcacctatcccctaaggatcttaatatgtcccaaaaggacataagtcctggccaattgcctggctctgcaggcagtgcctggagaaaacttggagaaagggagatggggaacaaaaacaggagctacccaacagtgggattcagaaatggccaatgtgttgaggtgtgacttcaggtcatactgcagagtaagagctgtcattggccagataactcatatgttgaggtgtggagtcagagaagatgggaatgctttaggctgaatggacagccctctgcagggaaatagagccatctaactaatgcatagattgctactaactattcttggaccagaggcaagatttctacccaaccatgaggacttagtgaagttaagttatacttgctgggtctccctctaaaagttgatacctaaacatgcttatttctacacactgccatgagatgttttggaatggaatagccctgaacaggaagaccacagccccaagtttctcagctgaccaatggataaatttgtgataaggaacagagctggtctttgatgctctattttactgtgcccacttgtcagagagtggcctgagccacacaccttccctgacttcccatttcttatcagcactatccttcctggccctgatttctgctttctgcttttctgtctatcctgcctcctgctattatccagggaaaataaacaggtacaggcacgactttattccagaagtagccttccagcattctccaactcagaactgcctcccccaattagccttaaaactaaaggaaaattcttctgtgttctgtgaagaagggttagatagtattggtatgagcgctttgcttcttcatacgtcactctaaatccatttccattttcatcttcctaagaattagtacttggaggtgagaacagaggtcacctcttcttgggaaggctgatattgaatcatgtctctgccctggattatcatgttcaggccacaagacaatggcaagattgttcagcaccacggagagcgcctttcatcctcgggactggatcatggctgggtgacagatgaggattgtagctgagagcccagccagtctgatctccttccactctggccaactaccaaatattcctctttttcccaaccccttagtgttcacctttttccttttactaatgagttttttttaggaaggaactcccctaactttccaccccctttctgcctccatgttatctgattcccccacctcccttcctcctttcctctcctcacctcaccttccttacctcccttctgttttgttaaggagactccctcccatggtccaaagttctggctccatctgctcatgattcctcaaagaccatgccccctcaaacatctccttttctacacagcttccttcccctcagtctaggacaggtctggtattccctagctctaaaggaattctagaactctaaagctctctctggctgccacccattctcattccttcccttctcagtcttgctcttttaaagaacggcctgtggtcactctgtctgcttcttcatctcctattctctcctaaatcccttgtcatctgggctctgtttctactcttcagctaaaattgtgttcactgagactacctatgactttcttatttctaaattttgtctttatcttatggacccacctgcttatttgacactgttgatttcttccaccttgaaactctacttgaatggttcctagttctactcttattcctctctgttcctacccagtctccttcctccattcattatctaaggttggatatttcccagaacttcacccttggtttttttttttttcactccgctcattctgagagactttattcttcactgtgacttacatcaccaccagcccacacccattttctgagctcccacacttcaaatcctaccaactagtggtatcatctgggtgtccaaaagacacctcaaaattcaacctgttcccaaatgaactcatctgatttttccttagcaatgcagttgtgccttcttctgcatttaataacttgtcttaataattagtactcttcccaattacctccagacagtaaactaggaatgtccagaccctttgttttacattttatatcagaagcctgccaattctactgttttttgacatcttcctttctgttcttttatcttctgctgctgcttggttcaggcccctattatctcttgctggcattgttgcagtagtttcctaattatccttacctccaatctcactcccttcccaggcgtcttgcacatggctatcggagggtccttttccatctcaaatctgaccatgttactccctgcttaaggcttcattggctccccgtcatcttctgagtaaagaaaaaaatcaaagcccaccttccagcatgatctgagccccctcctgactccacaaacttgatttcctgcaacttttctccataccttctgagcttcaactatagcaaaatgccgactattccttgaatgtactatgctagttttatgcttctgagacttttcacatgttccctgaatgtccttactcctcactcttaaactaattggtgacctaatgttttaagatcttttcaagtgtctcctttgaccaccctccctttgtcccattctctctacttttatatggctcttggttacctttattaataattattgggaacttcttaaagatgggactgttttcttttctttctttctttctttttttttttttttttgagacggagtctcgctctgtcgcccaggctggagtgcaggggtgcaatcttggctcactgcaagctccgcctcccgggttctagccattctcctgcctcagcctcccgagtagctaggactacaggcgcccaccaccgtgcctggctaagtttttgtatttttagtagagatggggtttcactgtggtctcgatctcctgacctcgtgatccacccgctttggcctcccaaagtgctaggattacaggcgtgagccaccgtgcccagcccttttttttttatttttaaagacagggtctcaatatgtcaatatgttgcgcagactggacttgaactcctgagtttaagtgatcctcctgcctcagcctcatgtagctaggactacaggtgcatgccagcatgcccagctgggactcttttctatttgtatttgtgagccctatcatcattaaataaatgaaagaattgtatcatgctggagtgagggaagagaggaaacagggtgccctgtggtcaggtctttcatcaccctaaggagggcacaccttttctacagataccttcatatataagccaggctccaacctatgtggtgtcagggctacagctacaggccagccactcccagggcacactgaccatgatagtataggcctcactgaacctatactaatgatatctttacagttaacatggatatagtgctaagggtatactatgctaaggactattctaactgctttaatacatattaactcctttcatcctcacaagaacccttgaactaggtattagtgttagtcccatttatagatgaggaagctgaaacccagattgtacagctactaactggaggagctggaatttgaacctaggcactctggctccagagtctgtgcttttaaccattacaatctttctttcagtctgtgtggcaaggaggatgggattgtgtagattgtcttcctttagtcagagcatccccttggcactgagagtgaggtcagcccatccaagccatatgtctgttgcccagtggaggaggagtataatttgaatgttggggaggcaatcacatgtctactgggtacttatgagaatcagataagctcgtggatctgaagacatacattaggaactacaagaccctctacaagttttattttttgccacctagagtcctaccagagtagcccataaaagtctgcgggtcattcaggaaagcagactcttccatctacttatccagatcctccttcttaagactccaggcatgagccttgaaggttccacactttggtttttttcatttgtttcccttttttaccacccaattttatcctgcttatttgggatctcttgggtcccagcctaccattgtattgactgcactacccacagctccaacaagtgaggccagccagctaaagacagttcatgagttggtacagccctggggcagggggacaagggaagaggttaatatgcagactgatgcttgggcctgcaggaatggagcagcctcccagagggcctgtctttagctccaagcccaaatcatgttctcttccctatgtccctccctgcatgctttgaaaggttattgactccatcactgactttgggtaagacacttcccctctcggcccaggtttcctcatttttaaaaagaatgggtgatgatatttgttgaagctgttgataggtacctatgatctcactatactattttctctacttgttataatttccacaataaaacatttttaaacatttaaaatcaaaagatttcaaccttttttaaaaaatagaaccttttctccaaccaaaaagttgcaacaggctgatatataaatgaaataaaggtgaatctactcttattaaagggaaaccagacccacatcctatagcttccccttcacagtcactcagggaacacagtttaatgaaaatcagtggaccaaactattataattctaaggattcttctgatgcttttgccttcctctagctatattggctttgcactagccattagcctatatatcctgtcccagaaacagtgaggctgggctattaatcatctctgtagtcttcagagaatttatttgaagggttgcagaaacatgggctgctgttagagatgcatttcaatgtctgtctctgctgagtgtttattaataatcttgttaatctccactctagttcccggatctagctaacgccttcagatgtccttggggggcactttaaattctccctgatttcttggagccaggcacttccttctgcctggagtcttttctgatacttacattcatgaatattttacatttaatctccctgattacattgccatgcaatggttgtggtgcattggctgcatttctaagggaagacatagaggaagctcatagtaaaggcttatgtttgcaggcacagtgccagagatctttgtgcttgccactaaggtggccttctgtcatggatagtgatggaggagatgctgaatggtgggctttgcatgggacccctcagcctagggctctgccccctggtcaggccctcctgaattgtggtccaaaggagctggcagtttcatccaggatcaaataccatcaggaactgcccagtaggcctcaaggaccacatgtgagtccctgtgaccagagttgctcaacagctttctagccctgtccttcctgtgaaatctacctcccatgttaccatttatacccagtacctccagactgagagaagaaactttgatgaactcatctgcactgaggagtaaaaagttagctccaaatgtctaacggattgtgtttttaaaaatcagccccagggaaaggatggtgaggcctaacactctcatgtgatagatgggttagaaggttaaggaggagaagcaggattgaaacgccacagatttagaagtcatcagtgtaaaaatgccaatcagaactataggagacatcagggctccccaaggagagagaggagggccaagggcaggaccctacagaggaggcaaagggttgtgggaggacagagaaatgatagtcaaagaggcaagagatgagccaagggaggaagccttttccaaatggatgtggtatatgtgacatgtgacgaatgctaccaaaaaagtgaaggaatgtgacttgggacttagaaatgtgccagtgctgccctggtagggtcctatcagcatgtttatgggatttgccctttaaaaagccttccctctggctgctttgcagtgagcagtctctggggctcacaggaaatccagagcccagctgtcccatctccacctcccttgcaggtagcagctgctgagaggctgttttggctgcagagaggcatgtcagggccactagaggtttgcttttccaaggctgtgcaggacaggtgctgtctattagtctctcaaggaggttgctgagccagggaggatgaaggacttgaagcatgggaagttgcccaagatgcaggcactgcggcacccagcctctctgagcaaagcctcctgcccttcttctactcagtcaaggctaagggctagggatcaaagcaggagagggaggcacaggttttgccctcaggaacttgcaaaccactgtggcaacacaacccacccagagccttgtgctctggatggcctgaaggaacacagacaaggccaggatttccctctcaaacctgctagacttttccctttcccgttagtgacaagcatgttttcatgcccactgcctcattttaaagggaacagaagccaccataatggttatatatccttcccttgccaggtcaccagcaaccactcagatccctgggcctgacactgtggcagcattctacatgcccatctgtctactccctgcatccgcaaaggcagaacaggcagcagccttggatcccctctgcactcctcgcaccttaggcttagcaatctacaggccctggttaaaatgcaaagacaagggaagaggttaatatgcagactgatgcttgggcctgcaagaatggagcagcctcccagagggcctgtctttaactccaagcccaaatcatgttctcttccctatgtccctccctgcatgctttgaaaggttattgactccatcactgactttgcgtaagacacttcccctctcggcccaggtttcctcatttttaaaaagaatgggtgataagttgatatttgttgaagctgttgataggtacctatgatctcactatactgttttctctacttgttataatttccataataaaacatttttaaacatttaaaatcaaaagattttaaccttttttaaaaaatagaaccttttctccaaccaaaatgttgcaacaggctgatatataaatgaaataaaggtgaatctactcttattaaagggaagccagacccccatcctatagctaggatggcagcacccctgtcaatatttggtcctcagagtctcagggagaatgtggatgacttcagccacttgcacggccctggatcttgcagcagaggagggtgtttgggaggggatggcaaggctagataaggactcttagcaaggtatggtggctcatgcctgtaatcctagcactttgggaggctgaggcaggcggatcatgaggtcaggagttcgagaccagcctggccaatatggtgaaaccccgtctctactaaaaatacaaaaattagctgggcctggtggcgtgtacctgtagtcccagctgctcaagaggctgaggcaggagaattgcttgaaaccgggaggcggaggttgcagtaagccaagattgcaccactgcactccagcctgggcaacaaagcaagactccgtctcaaaaaaaaaaaaaaaaagactctggacaacatagttcccagcccaattagagattagtgaagtgaagagggcagtgaggaggatgtcaaaagttccagactcaggacaatacacagaatgtgtgctttcctatcttcctgaccatctgtagaatcaagtattttgcactctgggcagcaaaagactaactggccacctgctggtttgtcattatttgtcttctcacctactgtacctagccaacttttcaggttctccccggagacactctttaggtgtcatttgtgaactggagaagtcctcattagaactatttttttgtccagtggctgtagccttgaaggctggtgtggcttggtcagtcagttctctggatcctgtgaagggacctgtccagcacagggaaacagagggagaagacccatctcagacagcacctgctctccccttaacccagacttaaactcacaggaacctaggaagaccttgccaagcaagtacacaggaagggcctgaggggaagggctactagtatgggagttaggagaaggaagtcctgtgagtttaaagaaatcatgatgggctttctggaggaggctggaccacacaggactttgaggacagacaccaagttgggtgtacatggaacccagatccttggttcttctacctagcccagtgtttttgtcccacggtagatgggtctgcccctctctccctgaatgccctgcctgctctgaggggtgaatgctcacagaagcccagagggcaggtgggaaggctagcttcaggactgagagcagccccctgtcttcactccctaacaactctctgtcttactgctttctccccacaggacccagccgccgcctccatctctgacggagactgtgacgcccgggagggtgagtcagtagccatgaattacaaaccatccccgctccaagtgaagctgggtgagtgtgtctggggggtgagggagatgtggggagtaggcaagatactctgggctgggtctacaatgaggtgccacaaataaaccagctcagcctagatgattccaagactcaagccttcaagtcattggcactgcgaggcaccttgtctcctgcaggcaaagagggcagttacagttctctgcaggagcctgaaactctaagaggcatctctgaagccaagaacgttccaggtattctggggcatagctgcagggggaaaagcatggaaccccagagagaggacttggaagtcccatcaaacactggatcaggctgagaggaagctgccttagaagtgggatgttacttgttatgtctaagggatagaaaggaaagagagttccaaccctagaagccgagcccctctcccgattacaatctcagcccatctagagatctctgggcccagttggcacctatctgggggagttttcccttcgtttcttagaaaacccaaatatctcccttcctttctgggtcacatttcccttgtggctttgtctcatgtccattccaaagtcagtttactgtgcagcctgatcctgtgaagtcccctcgcttctggccactgtccacagctcctaccactattgccctcccttcacctcatgggctgtccctctcccttcagggaccaaagtttcactgtctcatggctgctgtatataacacacttttatgaaaactttggtttcttgaagagaaattacaaaacaggacatacaggaaagaatttacaattaaatataggtcattactatccttccaagttcctctgccatcaaggccaccctcctgtccatcctcctcctcaggctccagctgcccaacaattactgatgcctcctcagtcctaagggccctttgcctacaactttctccttcctttccacagaggcctgtattttattattcaactactatttttttttcttaccttgcttgcttctgtccttccagaccacatccagggagcccctcgagctgtttttctaaacaagaatagtcctctccttggaatttgtttctattcctaggacatcagattaaaactgcagccaattttatttatcaggggtgttggttgttgttgttgttgttgttgttgttgttttgagacagagtctctctctgttgtccaggctggagtgcagtggcatgatcttggctcactgcaacctccgcttccctggttcaagcgattctcctgcctcagcctctcaagtagctgggattataggcgcgcatcaccacgcccagctaatttttgtatttttagtaaagataggctttcgccatgttggccaggctggtctggaactcctggtctcaagtgatccgcccacctcggcctcccagagtgctgggattacaggcatgagccaccatacccagcctattattgtttaatatcacaatacaaatattttaacaagcataacttctttactctcccccatcacattctcctcctaagaggtaaccattccaagccttttcagtttttgtagttttactttgtattttaacataagtggtatcatattgtgcacattttctgaaacttggccttccctcttccaccacctaaatcttggagctccttccaatgtcatcatattgtgacttcattcttttaaatggttgtatagtagtctttagtttggttttgccagtttattgtttgcttttttcccactatttcaaacaatttcagcatgcttttaaaataacatctttttttctccccattacattaccatcaaagctcctcatgaaaattcacagcattgtcccagttgcacctagtaccaccaggaactttaaggcaaattgcaccccctagaggcctggagtggtaatggcagctgccacctgctggaaagaagctgggaaaaagctggaatcagctgagcactggcaaagaaagagggtcaaagagtagaagacagagattcagagacatgaggtcaggggaaatttccaagtgagtcacagtagctgtaaaggtccttcccatccttaccctctggagcatttggctattttatgagtcattttccctagtgtccctctccacctaacagttccttttcctagatctggcctttacttgagatgagtagggaagagtagatgggactcctccaagacccaggaagctacttctggtaacagttgtcacataccaggcagtggactgggtcacctgatggccagctccatgaagctggtaggctttggaaccttggagaactcagaccttggcaaaggagtcaggagcaccactcaggcagcgtagccaaatgggctcccccagccttctgccccttactttgtagccccatcctgcacctcccacaccataaccttcagtggcttcttcttccttctgcgttaatcccaaactcctctgtctggcattcaagtccttcatgttctgagtttgtaaccagagagggtcttcggccccttagcacaggaccagacttataattagtgacatggatatttgttgaataagtggctgaataaatgaattttacttctctaacctgacctctctcttcacccctctatccagagccacacttatgctcacttttaaatgcatttttgcacacactatccctccttcctagaatgtccacctctctccaggtcatggtgtcacctaaaggaagccctctctgactgcgccatccttctgtgattgtctctcccccgccagcctttccctggcatcaagtacacactaactaccctaacatgggagttgtggttcctgaaaaacagggggcagcctcctctttttgccccccactgtctgcctcaggttgtgcagggccaggtactatctccaccaagcagcaggggcctggagttgggatccctgcctcagtccttctaggagcaagtggtttcacagtggaggcccagcccaggctgccctgagtagtaagacagggtggcctcaggggcaggacacagcttccttcccatgttctcctgcagagaagcagcgggagctggcccggaagggctccctgaagaatggcagcatgggtagccctgtcaaccagcaacccaagaagaacaatgtcatggcccgaacaaggtagaggccctccctaccccacctggaccctgccagccaggacctatttctgctggtcctgagcctccccctcttccctccctcctcaggcccagctcctctctgagaggagacagccttaacaggatccaaggtggggagggagggaagaaagtggtgggacggggcccaacccagtcccttgccaggtttctatgctccactttgccactctaactcccgaaattcttcacctaggctggtcgtccccaataaaggctactcctcacttgaccagagccctgatgagaagccactggtagcccttgacacggacaggtgtgtatgggggcttgggggtagctgggcagcccaaaggaacctgtatagcacaagtgggctgtacaggccacacctgctatattgtcagaattgggatattcttcagccagaatctctccaagggtgaattctccagggatgggaatttttttacaccagggactgggggttgaagagaggtggcagagagaggaaaggggggcctgcgttgtctgctgtcatcctgggacaactgatccaatggttgtccctaattggcctgtgatgttgtctctggacagcagaatatgatgcttaatgccccatcccctcaggaaggagccctactccctggaaaacacctggctagacttggactttgggaatatcctacaagtcagggtgatttgagtctacaaaaaaaaaaaaaaagatgagaagggggtgaaaggagtaactgctatatttagaaggaggttaaggatagcaattgattttaagggtggggctagggaacttgtctttaaaatcctgcatttgcacagcaagcacagttcgtattgagattttgctatttggaactgtaagggaggtataggatgctgcctaatgggaggtgggattgcagagagttttctatgtaatttcttggtatcactttccctctctttcctccatggccagcgatgatgactttgacatgtctagatactcctcctccggctactcctctgctgaggtgagcccctaccccttctcaccctagacaccaccgggcaggatcactgccatcccgggggagggctggggccaatgcccaagtacaaggaaaaagagggctgggcaaggctgggtggtgccctgcacagggtgggcctgggataggatggaagagaagtggttactggcctcaagtgcatggagcccagggttaggagtggggctttagattgcagcaggccatttaaatagaatgggtgtaaaatacaggtgatatcctctagtagccggcctgagataggggcaaaacccgaataggagcaggaccagaggtgtgaagttgaccatagaatggggaggggtgactagaaagagaggccagaggcgaaggagggcgcctaggcaggagcggggcctgggggtacagacagacccgggacagggcggggctgatatccagggcactggctggactggggcgcagacggcctggagtggccgcagagctgtgggtggtgcctccctgccgctcgggcctgacctccctcccctttgcctacagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca
